United States Patent 6,812,339 (POLYMORPHISMS IN KNOWN GENES ASSOCIATED WITH HUMAN DISEASE, METHODS OF DETECTION AND USES THEREOF) - sequence listing, part 56

SEQ ID NO: 15524 - DNA, 256176 bp, Human
  misc_feature (1)...(256176): n = A,T,C or G
gaaatgaagtgcatttgccttagctttctacattctttccataaagcaagggttcttcaatcttcatggagtccccaaataacatgtgaatgtgaagtattgtgctaggtactgcacgggatgccaaagatgaacaaggcatgagttctgggggaatatactatctctcacaggagaaataagtaagtagcgtactcaagtattaaagtgagaacttaagtgctatatggcagttacaataaagaggaaatttaaagtaaggatagatcataccaagtaggataaatcaggaaatgaaggctaaactttggaagtgagaaattattctggaaattcgtggaactgcttagcggaatagggttttctaaggaagggtactgactaagcaaatgaaacgaaaaaagggaatgactatgtttccgcaacttcaagagatccagcttccctgcagggcaaaggagtaacaggagagaaaaaaagcaatgaatccgtgcatccgctaaactcttttaccatatattttactctgacaaaacaactatcacgtattggccttttgtttgtttgtttttttgagacacggtctccctctttcgcccaggttggagggcagtggcgcaatcaccgttttctgcagcctctacctcctcggcttaagctaccttcccgcctcgaccttccaaagtgctaggactacaggcgtgagccaccatgctcaggcttattggcacttttctgtgcacttttaaatgtaatcctctaaatcactcttctccacctttcctgtgcataggaatcacctgtggttcccgttaaattggagatcttgattcattaggtctggggcggggcctgagcttctgcatttccattgagctcacagctgaagcctaccctggaccacaccttccaatggaaaaggctccagtgtgatttctagccactagtattatctgcgaacttgggagaaataaaatgcaagttctcggcccccgcaagggctctactgaatccgaaacactgtggggaggcccaccactctgcagtgttttaacaagcaagtggttaaagtttgagagccacccgtaagtcacgggtttcctaacatgattggacactggaatcacctgcggatttttttttttttttttttttttttttttttttttttttgagacggagtctcgctctgttgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcctgcggattttaactaatactactgatgccgcatctcaccccccctcccgagattctcaggtacggggcgtggccttggcggcggccttataaaagctctcccaggtgattccaacctgtagtaacacttgagaactgcgtgaggtggggacttcaactttaactggacttattttcctcctatgtaaaaggtggacaatatgcaagtggtcctgactttgcttccagattttggcaactccagagccctagttcggtctggagagccagcttcccgccccgtgtcctaaggcctctgtccgagaacccaaagtcctgggaatggacccgcgggagcggacccgcgggagcatctgtgacgccgctcagcaacccggcgccgccccggcggctccgacgtggcccagtgtccggctggcgtgggctctccaggccgcacccactaaaccgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaaggtgggtgcgggccgggccctcgtccgggcgggtgtgggcgcgctgccaccctcagccgcgctttcttcgtgctcgcagcgggtgtctggctcccacccgggttctccagacgcccccgctctggccctgagcatcaccacctccttccttcccgacccggggcggcttctcggttcccgtgcagcactcacttgcagttcctttccccctcagtcttactttacctacgatttttaaagcttccctgctctgctttaatacgttgggatgtattagcatttacgcgtggcacttaacgcaagagcttctactggggtaggcagttctgttcagacagtgcttaaagtacctagtttcgtaatgatgacatcataccatcagctcctaggcttactatggggagggcagcttcctgcaaggtaatatttttcctgtatctcttccaacggaattagttcatgacctgtcatttactctgcagaacaaaacttgtagctattgcattttgccctttagtattctagttgagtaaaattagaaagttctttctcttagcaaaaatgaagttttacaccaatgacttaatggctgttcaccacagcaacagtgtgtgtccctaaaaagagactccatgactccacataagttcatgtatttgatgctaaaagttctttttttttttcatttctatagtttattggggaacaggtggtgtttggttacatgagtaagttctttagtggtgatttctgagattttggtacacccatcaccccatcagtatatacactgcacccaatttgtagtcttttatccctcactcccttctcaacctttcccccgagtccccgaagtccattgtgtcaatcttatgcctttgcatcctcatagcttagttcccacatatcagtgagaacatactatatttggttttccatttctgacttacttcacttagaataatagtctctaatctcatccaggttgctgtgaatgccattaattgattcctttttatggctgagtagtgttccatcatatatatgccacagtttatccactcgttgattgatgggtatttggattggttccacatttttgcacttgtgaattgtgctgctataaacatacttgtgcaactatctttttcatgacttcttttcctctgggtagatacctagtagtgggattgctggatcaaatggtagatctactcttagtactttgaggactccccacactgttttccatagtggttatactagtttacattcccaccagcagtgtagaagtgttccctgttcgctgcatccacgccaacatctattatttatttttatttttttattatggccattcttgcaggagtaaggtggtatcgcattgtggttttgatttgtgtttccctgatcattagtatgttgagcattttttcatgttagccatttatatatcttttgagaattgtctattcatgtccttagcccactttttgatgggactgttttttttttcctgctgatttgagttccttgtagattctggatattaatcctttttcagatgtatagattgtgaagattttctcccgttttgtgggttgtctgtttactctgctgactattccttttgccgtgcaaaagctgtttagtttaattaagtcccagctattttttttattattatactttaagttctagggtacatgtgcacaacgtgcaggtacatagatatacatgtgccatgttggtgtgctgcacccattaactcatcatttacattaggtgtatctcctaatgctatcccccgctcccccaaccccacaacaggccctggtgtgtgatgttccccattgtgtgtccaagtattctcattgttcagttcccacctatgagtgagaacatgaggtgtttggttttctatccttgtgatagtttgctgagaatgatggtttccagctgcatgcatgtccctacaaaggacatgaactcatccttttttatggctgcatagtattccgtggtgtatatgtgccacattttcttaatccagtctatcattgacggacatttgggttggttccaagtctttgctattgtgaatagtgccgcaataaacatgtgtgtgcatgtgtctttatagcagcatgatttataatcctttgggtatatacccagtaatgggatggctgggtcaaatggtatttctagtcctacatccttgaggaatcgccacaatgtcttccacaatggttgaactagtttacagtcccaccaacagtgtaaaagtgtccctatttctccacatcctctccagcacctgttgtttcctgactttttaatgatcgcccttctaactggtgtgagatggtatctcattgtggttttgatttgcatttctctgatggccagtgatgatgagaattttttcatgtgtctgttggttgcataaatgtcttcttttgagaagtgtctgttcatatccttcacccactttttgatggggtcgtttaatttttttcttgtaaatttgtttaagttctttgtagattctggatattagcccttggtcagatgggtagattgcaaaaattttctcccattctgtaggttgcctgttcactctgatggtagtttcttttgctgtgcagatgctctttactttaattagatcccatttgtcagttttggcttttgttgccattgcttttggtgttttagacatgaagtccttgcccatgcctatgtcctgaatggtattgcctaggttttcttctagagtttttatggttttagatctaacatttaagtctttagtccatcttgaattaatttttgtataaggtgtaaggaagggatccagtttcagctttctacatatggctagccagtttttccagcaccatttattaaatagggaatcctttccccatttcttgtttttgtcagatttgtcaaagatcagatggttgtagatgtgtggtattatttctgagggctctgctctgttccattggtctatatctctattttggcaccagtaccatggtgttttggttactgtagccttatagtatagtttgaagtcaggtagcgtgatgcctccagctttgttctttttgcttaggattgtcttggcaatgcgagctctcttttgtatccatatgaactttaaagtagttttttccaattttgtgaagaaagtcattggtagcttgatggggatggcattgaatctataaattaccttgggcagtatggccgttttcacgatactgattcttcctatccatgagcatggaatattcttccatttgtttgtgtcctcttttatttttttgagcagtggtttgtagttctctttgaagaggtccttcacatcccttgtaagttggattcctaggtattttattctctttgaagcaattgtgaatgggagttcactcatgatttggccctctgtttgtctgttattggcatagagcaatgcttgtgatttttgtacattgattttgtatcctgagactttgctgaagttgcttatcagcttaaggagattttgggctgagatgatggggttttctaaatatacaatcatatcatctgccaacagggacaatttgacttcctcttttcctaattgaataccctttatttctttctcctgcctgattgccctggccagaacttccaacactgtgttgaataggagtggtgagagagggcatccttgtcttgtgccagttttcaaagggaatgcttccagattttgcccattcagtatgatattggctgcagatttgtcataaatagctcttattattttgagatatgtcccatcaatacctaatttgagagtttttagcatgaagggctgttgaattttgtcaaaggccttttctgcatctattaagataatcatgtggtttttgtctttggttctgtttatatgatgaattatgtttattgatttgcatatgttgaaacagccttgcatcccagggatgaagcccacttgatcatggtggataagctttttgagatgctgctggatttggtttgccagtattttattgaggtttttgcattgatgttcatcagggatattggtctaaaattctctttttttgttgtgtctctgccaggctttggtatcaggatgatgctggccttataaaatgagttagggaggattccctttttttgtatcaattggaatagtttaaagaaagaatggtaccagctcctctttgtacctttggtacaatttggctgtgaatctgtctggtcctggactttttttgtttggtaggctattattgcctcaatttcagagcctgttattggtgtattcagggattcaacttcttcctggtttagtcttgggagggtgtatgtgtacaggaatttatccatttcttctagattttctagtttatttgcgtagaggtgtttatagtattctctgatggtagtttggatttctgtgggattggtagtgatatcccctttatcattttttattgcatctatttgattcttctcttttcttctttattagtcttgctagcggtctatcaattttgttgatcttttcaaaaaaccagctcctgaattcattgatatttttttgaatggttttcttgtgtctctatctccttcagttttgctctgatcttagttatttcttgccttctgctagcttttgaatgtggttgctcctgcttctctagttcttttaatttgatgttagggtgtcaattttagatctttcctgctttctcttgtggacatttagtgctataaatttccctctacacactgctttaaatgtgtcccagagattctggtatgttgtgtatttgttcttattggtttcaaagaacagctttatttctgccttcattttgttatgtacccagtagtcattcaggagcaggttgttcagttttcatgtagttgagtggttatgagtgaatttcttaatcttgagttctagtttgattgctgttgtctgagagacagtatgttataatttctcttcttttacatttgctgaggagtcctttacttgcaactatgtggtcaattttggaataagtgcggtgtggtgctgagaagaacgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaaatctctttctaggtctctaaggacttgctttatgaatctagttgctcctgtattgggtgcatatgtatttaggatagttagctcttcttgttgaattaatccctttaccattatgtaatggccttctttgtctcttctgatctttgttggtttaaagtctgttttatcagagactaggattgcaacccctgcttttttttgtttcccatttgcttggtagatcttcctccatccctttattttgagcctatgtgtgtctctctcacatagcaaggagctgcgttcctttggaggagaagaggcactctgatttttagaatttgcagcttttctgctctggtttctccccatctttgtggttttatctacctttggtctttgatgatggtgacgtacagatgggattttggtgtggatgtcctttctgtttgttagttttacttctaacagtcaggaccctcagctgcaggtctgttggagtttgctggaggtccactccagaccctgtttgcctgggtatctacagcagaggctgcagaacagcaaatattgcagaacggcaaatgttgctgtcttattgttcctctggaagcttcgtctcagaggggcacccggctgtatgaggtgtcagtcggcccctactgggaagtgcctccccattaggctacttggggttcagggatccacttgaggaggcagtctgtctgttctcagatctcaaactccgtgctgggagaagcaccactctcttcaaagctgtcagacagggacatataagtgtgcagaagtttctgctgccttttgttcagttatgccctgacccccagaggtggagtctacagaggcaggcaggcctcctggagctgtggtgggctccacccagttcaagcttccagactgctttgtttacctactcaaacctcagcaatggcgggtgcccctcccccagcctcactgctgccttgcggttggatctcagactgctgtgctagcaatgagggaggctccgtggacatgggactcttcaagccatgcgcaggatataatctcctggtgtgccgtttgctaagaccgttggaaaagcgcagtattagggtaggagtgacccgattttccaggtgccatctgtcacggcttcccttggctaggaaagggaattccccgacctcttgcactttccgggtgaggcgatgccttgccccgcttcggctcacactctgtgggctgcacccactgccctgtacccactgtctgacaagccccaatgagatgaacctggtacctcagttggaaatgcggaaatcacctttcttctgcatcgctcatgctaggagctgtagactggagctgttcctattcagccatcttggaacctctctcctatttatctttgtttttattgcatttgctttggggttcttggtcatgaaatccttgcctaagccaatgtctaaaagggtttttctgaggttatcttctagaatttttatagtttcaggtcttagatttaagtccttgatccatcttgaattgatttttgtataacgcgagagataagaatccagtttcattctcctacatgtggcttgccaagtatcccagcaccatttttttgaatagagtgtcctttccccactttgtttttgtttgctttctcgaaggtcagttggctggaagtatttgggtttatttctggattctctattacgttccattggtctatgtgcctgtttttacaccagtaccatgctgttttggagactatggttttatagtatagtttaaaatcaggtaatgtgattcctccagatttattctttttgcttaatcttgctttggctgtgtgggctcttttttggttccatatgaattttaggattttttttctagttttgtgaagaatgatggtggtattttgatgggaattgcattgaatttgtagattgcttttggcagtatggtcattttcacagtattgattctacccatccatgagcgtggggtatggttccatttgtttgtgtcgtctatgatttctttcagcagtgttttgtagttttccttgtagagatctttcacctcatttgttaggtgtattcctaagcattttatttttgttggagctgttgtaaaaggggttgagttcttgattagattctcagtttggtcgctgttggtatataagagagcaactgatttgtgtacattaattttgtatctggaaactttgctgaattcttttatcagttcttggagctttttggaggagtctttggggttttctaggtatataatcgtatcatcagttaacagcgacagtttgacttcctctttactgatttggatgccctttatttctttctcttgtctgattgttctgactaggacttccattactatgttgaatagaagtggtgagagtgggcatggttgccttgttccagttctcagagggaatgctttaaacttttccccattcagtattatgttggctgtgggtttgtcatagatggcttttattacattgaggtatgtcccttgtatgccgattttgttgagagttttaatcataaaggggtgcttgattttgtcaaatgctttttctgcgtctattgagatgatcatgtaatatttatttttaattctgtttatctggtgtatcacatttattgacttgcctatattaaaccatccctgttatgaaacccacttcataatggtggattatctttttgatacattgttggattcggttagctagtatattgttaaggatttttacatctgtgttcatcagggatattggtatgtagtttccttttttggttatgtttttttcctggttttggtattcggatgatactggcttcatagaatgatttcaggaggattccctctttctgtctcgtggaatagtgtcaataggattcgtacgaattctttgaatgtctggtagaatttggctgtgaatatgtctggtcctggacgtttttatgttgacaattttttattacaattttaatctcgctgcttactattgttctgttcagggtatctaattcttcctgatttaagctaggagggttgtatctttccaggaatttatccatctcctctaggttttctactttatgcatataaagttgttcatggtagccttgaatgatcttttgtatttctgtggtgtcagttgtaatagctcccatttcatttctaattgagcttatttggattttctcttttttcttcttgtttaatcttgctaatggtctatttatgttatcttttcaaagaactagctttttgtttcatttatcttttgtattttttgtttgtttcaatttcatttagttctgctctaatcttggttatttcacttctactgggattgggtttggtttgttctgtttctttagttccttgaggttagaccttagattgtctgtgcaccttcagactttctgatgtaggcatttagggctatgaactttcctcttagcagagcctttgctgtatcccagaggttttgataggttgtgtcactgttgttgttcggttcaaaaacattttaaatttccatcttgatttcattgttgacttattcaggagaaggttatttaatttccatgtatttgcatggttttgaaggttccttttagggttgattttcagttttattccactgtggtctgagagagtgtttgatataatgtcagttttcttaaatttattgaggtttgatttgtggcctatcagtggtctaccttggaaaaagtttcatgcactgatgatgaatagaatgtatattctgtggttgttgggtagaatgttctgtaaatatctgttaagtccattttttccagggtatagtttcaatccattgtttctttgttgactttctgtcttgatgacctgtctagtgctatcagtgcagtattgaagtctccaactattattttgttactgtgtatctcatttcttaagtctagtagtaattgttttataaatttgggaactccattattgcatatatatttcagattgtaatatttccgtgttggacaaggccttttatcattatataatgtccctctttgtctttttttaactgttgttgctttaacatttgttttatctcatataagaatagctactcttgctcgcttttggtgtccatttgcatggaatatctttttctacccctttaccttaagtttatgtgagtccttaggtgataggtaagtctcttgaagacagcagatggttggtgaattcttatccattctgcagttctgtatcttttaagtggagcatttaggccctttacattcaatgttagtattgagatgtgaggtaccattctattcattgtgctatttgttgcctgtataccttgtttttttaattgtatttttgttttataggtcctgcgagatttatgttttaaagaggttctgttttgatttattcccatgatttgtttcaagatttagagctccttttagcagttcttgtggtgctggattggtagtggcaaattctgtcagcatttttttgtctggaaaagactgtatctttccttcatttatgaagattagttttgctagatacgaaattcttgactgataattgttttgtttaagaggcagaagatagggccccaatcccttctagcttgtagggtttctgctgagaaatctgctgttaatctgataggttttcctttataggttagttacctggtgtttttgcctcacagctcttaagattctttccttcatcttaactttggataacctgatgactatgtgcctaggcaatgatctttttgtgttgaatttcccaggtgttctttgagcttcttgtatttggatgtctaggtctctagaaagggtggggaagttttcctcaattattcccccaaatatgttttccgaacttttagatttctcttctttctcaggaatactgattattcttaggtttggtcatttaacataatcccagacttcttggaggctttgttcatattttattatccttttttctttgtctttgttgtattgggttaattttaaaaccgtgtcctcaagctctgaagttctttcttctgcttatttgattctattgctgaaactctattttacatttctataagtgcgtccattgtttcctgaagttttgattgtttttatttatgcaatctatttcactgaagatttctcccctcctttcttgtatctttttttttttatttccttaaatggggctttgcctttctctggtgcctccttgattagcttaataactgaccatctgaattcttttcaggtaaatcaggcatttcatcttagtttggatctattgctggtgagcgagtgtgatttttttggggggtgttaaagaaccttgttttgtcatagtactagagttggttttctggttccttctcatttgggtaggctctgtcagagggaaggtctagggctgaaggctgttgttcagattcttttgtcccatagaggtgttcccttgatgtagtactctccttcttttcctacagatgtggcttcctgacagccaagctgtagagattgttctggatctagccacctagtaggtctaacaggctccaggctggtactaggaattgtctgcacagagtcctatgatctgaactgtctatgggtctcttagctgtggataccagcacctgctctgctggaggtggcaggggggtgaaatggactctctgagggtccttactttttgttgtttaatgcactatttttgtgctggttggcattctgcagggaggtggccttttcaatagagcatcagctgtggtagtatggggaggatcaggcagtgggtgggccctggaactcctaagagtatatgccctttgtcttcagctaccatggtgagtagggaaggaccatcagataggggcatttctagggcatgtctgggctcagactgtccttgggtgggtcttgttgcaactgctgtgggggatgggggtgggattcctaggtcaatggagttatattcccaggaggattatggctgcctctgctttgtcatgcaggttgtcagggaagtgggggaaagcctacagtcacaggcctcacccagctcccatgcaacccaaaaggccagtctcactccctctgtgccccacccaacagcactgagtctgtttccaggcggtgggcgagcagggctgagaacttaggtggtgggcgagcagggctgagaacttgccccaggctaccagcctcccagctgcaaatgcaaatagggctctcatgcttccccacctgtggagtttgcacaccagattcatgccctctcccaagttctggccaggagatttcttgttcctttgaaattgttacaaggttcagctggaggtttccttctccctgtggcctcttcccagtacctctggcagccctacccgaggacccctgtgaggcaaggcagaaatagcttcctaggggacccagagagcccacagggcttttcctgctgcttcctctacccttgtattttgcttggctctctaaattgactcagccccaggtaaggtcagaatcttctccagtgatatacaccttcgggttccccagtgagagtgtgttttcaggggcagacaatccccctttcccactctcacagtttgggtactcagagtatttggggtatctcccaggtcctacaggagcaattcatttccttcagagggtctgtgggttctcttggcttttctaatttattcctgcagcagttctggagcaaaggttcagaattcaagactccacatgctgctctgtccatttgagtgggaggctaaaacggtttttatttaatacctgattctagcttaattttgatccccttcctttatcctttccccagtatttaactgtttgcctagatctgatctcacacttagctccaaatcagtctaactttttccagccttagactgcttgttacagtatctggctttacatttgccttgagagtcttagagttggaactgctgtgttatgctccttaaggtccttgacagtctagccgcagtctgatttacaaaccccatcacttgtacaaattgtccccaacttatcatggttcaatttaggattttttgactttactatgggtttaccagggtattaaatgcattttttacttatagtatttgcaacttaatacttaataaacccaacttaatgggtttattgggaggtaaccctaagtcaaggggcatctgtagtaggttgaatgctggcctcaaaaagatatgtccacatcctaactcccagaacctgtgaatgttaccttatttggaaaaatgtctgtgttaatgtaagtaaggatcttgagatgagatcatcttggattatctagatgggccccaaatccaatgtcattttaagagacagaagcagagaagacacaggcaaaaaggagaaggccatgtgaagttagagattggagttaggcagcctcaagccaaggaacagctgaagccaccaggatggaacagtctcccttagagccttcagagggagcacagccctgccaacaccttgattttggacttctggcctccagaattgtgagagaataagtttctgttttaagtcaccaaatttttcataatttgttaaacagatctaggaaactaatacagattttggaccaaaaagttgggtgctgctgtaacaaatagttcaaaatgtagaagtagctgtggagttggacagaggctagaataattttgagaagtttggtattaaaagcctagactgccttgaggagacttcagaaatctggacattaagggtgattctgctgagggcttagaagagattaaagggcatagttgaaaaaacttctgtcatcatagagaatacttatatcatcctgaagagaatttcagtagaaatatgaacattgaagtctgttctggccatggcttggaaggaaatgagagacattatattggaatctagaagaaaggtaacccttgttatgtagtgatacaataccggctgacttggtttctacagtttgtggaaaacatcttgaaactggtgaacttggatatgagctgaaaagatttccaagcaaagtgttaaaagtgctgcttggtttctcctcgctgcctatattaaaatgagagaagaaagagataaatttaaaaaggaacaggtaaggaaaaaggaaccaacacttgatgattttggaggttctcagcctatccagattgtaaagagtgttacaactaggaaactcagtgttgggaatgtgtgctctggagagaaagacagaaacctggcaggacaaccttttgctgaacaggttaagcatgtgattcatgggtcccctcaaccatctccccagaagcttggtataaagaaggtggggatatccaggaaggatctggggaggatccgtgtaatgatgtggctcttggtgaaatatacaatagtcttacaaagttttggggaatgtattagaaacactgtcagcttggaccgaaagagacaagacaaaatgaaagaaggctgttggacttccaaaattctataggcaggaaatggactatagagctacttggctgtaaacattgtgctgccctttcaagaaagaaagaataactctgcaagcagaaccatggcaggcagcacagagggtgaagcatcaggccacagagagttattctcaggctttgaaacataatggaaatttgccctgctggattttgaacttgcctgtgaccagtgacccctttattccttctatttttttcctttgggaattagagtgtccatcctatgcctgtctctccattgcattttggaaacataacttgttttctagtttcacaggtggacaggggagaattttaccccaggatggatcatacccagagtctcacccatacatgatttagatgataaaatttgtaaatgaagttgacgatatttacatgagattttggacttagaattgatgctgtaattggttgagtttttggaggttgttggcaaagggaaatatattttatgtaggggaggtggattttgggggcttttgggggctagagggtggcttgaatgatgcacccaacaaaaaaagggcagcttttagaatcttttgcattaactctgctcaaaccttgacttcagacttttggcctccagaactatgagagaataaatttctcttgctgaataggttagacctgtgattcatgaatccactcaaccatctcagcagaagcccagtacaaacatggcgttatccaggaaagatgtgtagaggatccttgggtaatggtgtggtagccctaggatagtaatatatcattcttttacagtcttcctcattgataccttacttgtgggcataccatattactctatcttgcctgatactttcccatgacaaaattaataactttctattattctctcatagcatttggccagtatttctgtaataatccttactgtaaggtatcatatatgctaatctctgttgttaaaaggtgagcttcagagacaaaactgttttttattcatgtttattttgccaaggcacagtgcacaaaagttgggtactcagtaatgctaattcaacaaaaggtactttttatagggaaaggtatactttaagccaccatcagaattacctctacaatataccttacttgtggaaactagtttgtccttggaaaatccagagaggatgctcagtgttacctcatgtgccttattgttttgttgtgaacaaatcaaaattgtaggaggtcctttattatataaactaaaatctttctctctataccttttatctactgatcctctctttcagaaccaaatctgtttctgtgtgtgacacattatgtgagaatagcaggccaaaagcctgtagtttcttcaaccactgcacttcaaaaaatttattttatatagttcgttattctgctttccttcaatttgtttatgtttctcttaaaattgtaggaaaagcaaagaggttgagaagagtaagtgtggaagtggaagaattgaagagcattgaataggttgaaggagctgggcagataggaacttaaggaaaataatgtgggagcaagtgagggaaatttttaagaataatgctttaaatccaaaaattgagcttcccaaccaaaatctataaatgcatacacacacacacagatatttttcagttcatcctggaaatttgagtgcataacttgagtatagtcttatgtaggaaacaaagatgaataaggtatgtcccctgtataaagaaatttatagtataataaaatttgcggccaagcgcagtggctcaggcctgtagtcccagcacttggggaggccgaggcgggcagatcatgaggtcaggaatttgagaccagcgtagccaacatggtgaaaccctgtctctactaaaaatacaaaaaatagctgcgtgtggtggcacatgcctataatcctagctactcaggaggctgaggcaggagaattgtttgaaccagggaggtgaaggttgcagtgagtcaagatcgcaccactgcactccagcctgggcgacagagcaagactctggctagaggtggttataggctgaagaggctagcattttacagtatgcataccttaatttgtacatctgaactgcagttattctacttgtgttgatctgactgaaaatatttttgaaattccacttataattactgtcaaactctttagtgcgtataaaaacaccctttgtagaaataactgttttctctgggtagaattttttgaagaaatacacttattttgagccatatattttgtaaggcaagtgaacaattgcaaatgccagcttgttacctttaaaaaaactttgtccaaaagagtgaactgggcatggtggcatgtgcctgtagtcccaactacttaagtggctgcagtgggaggatcgcttgagacctcccaggctaaagtaagccatgtttgcaccactgcactccagcctgtgtgacaaagggagatgctgtcttaaacaaacaaacaaaaatgttgttcaaaggtaatatcttaccttttaccaggtgcagaactggtttagatggtctcaaggatgtttgctcttcagtgattaataatgagttaccagtaaatggcctctgagattccagaagagttccaaaagtgcttagagcagtgatgtattgagggaataacttttaagtgaatactttttttttttttacttgaacttttaagttccagggtacacatgcaggatgtgcaggtttgttacataggtaaatgtgtgccatggtggtttgctgcacagatcaaactatcacctaggtatgaagcccagcatccattaactttcttcttggtgctctccgtccccttgcacctttccaacagagtccagtgtgtgtcgttacccccatgtgtccatgtgttctcatcattcagctcccacttgtaagtgaaaacatgcggtgtttgggtttctgtctctgcattagtttgctgaggataatggcttccagctccatccatgtttctgcaaaagacatgaccttgttcatttttatggctgcatagtattctgtagtgtatatataccacattttctttattcagtctatcattgatggggatataagttgatgccatgtcttcgctattgtaaatagcgctgcagtggacatatgtgtgcatgtatattcataatatgatttatattcctttgggtatacacccagtaatgggattgctgggtcaaatggtatttctgcctctagatctttgaggaattgccacactgtcttctacaatggttgaactaatttacgttcccaccaacagtgtagaagcatttttttctccacaaccttgccagcatctattgtttcttgacttcttaataatcaccattctgactggtgtgagatggtatctcattgtggttttgatttgcagttctctaatgatcagtgatgtggagctttttttcatgtttgttggccgcatgaatgttttattttgataagtgtctattcatgtcctttgcccactttttaatggggtcgtttgtttttttcttgtaaatttgttgaagttccttatagactttgcatgttagacctttgtcagatggatacattgcagaaattttctcccattctgtaggttgtgtgttcactctggtgatagtttttgttgtgcagaaactctttagtttaaatagatctcatttgtcaatttttgcttttgttgcaattgctcttggcatttttgtcatgaaatcattgcttgtgtctatgtcctgaattgtattgcttagattttcttatagggtttttataattttaggttttacatttaagtctctaattcatcttgagttaatttttgtataaggtgtaaggaaggggtccagtttcagttttctgcatatggctagccagttctcccagaaccatttattaaatagggaatcctttcattgcttgtttctgtcaggtttgtcaaatatcagatgcttgtaggtgtgcagtcttatttctgagttctctattctgttccattgatctatgtgtatgtccttgtaccagtagcatgctgtattggttactgtaaccttgtagtatagtttgaagttaggtagcatgatgcctccagctttgttctttttgcttcagattgtcttggctatttgggctctttttcatattttctaattctgtgaagaatgtcagtggtagttttgtcacaggataaggatcccgtgataagggttttggctttgccagccggaaacctctatggctggtagcacctttgccctagttttgctcgggcctgctgtgctccttttgtccactcggcctggcaggctatgctcggcttgtgttactggcctggatcccacacctgccaagggggagccaggtgcagggcggcggtgagtgtgtgagcaagcacagggtccggccactgcgcacagccaggagtgccagctgcagtggggtgggcagctccaggtactggcacaggcaccagctttgtacaagactgtggctcgaccaggcatactgcaggtggcttccactgcaggcactgtggtggaatgcagtggcacctggaagcttggagataccaggaaccacacagccctaaagagagtgagtgtcacagctctggctcagggagcctgtaggtctgggctccccaaagggctgcagctcttctctccttttcattgcctgcaatgtggtgagtggggcacgtgtttcagccctgttcatgttacagctctttcagtcctgccatttggtgagttccaagttcttgttgcatgttcaggaagaatgaggcatgtagacaactggaaggtgagcaaggcaaagaggtgctttattgagagacagtacagctcttaggagaactgaagttggtagctcctttctgctggcagatcgtcttgatgagcgcagctgtcactagagaggagacatggagtgggtagctccttttcacaggcaggtcattctgttgagtctgcagccctcagctgagaggagaaatggagtggccaccttccacctgcagtcaggtcatcccgatgtctgggagaggacacctggaatgggtagctcctatccacaggcaggtcatctcattatctgcctgagtttggctgagtctggggtttttatgggcttcagaggggggtaagtgtgtgctgactcgtccatgggaggccctgggtaggccgggacaaaaacaccgtacgttctcactgcagtccatggaagaggtagcccagcccccaggcttcaggttgtccttagcttgaaggtggggcttcaccggggacccatccctttttgcccatctgctccctgccaccattaacctgccatctaccatgtccatggcacccaggcagttcgcgtcatggggcacctttcaggcctgtgccaagctgctcccaggccctcttggcctcccttccatgcccattggtgcccaaagtctggagggggctgaggtggtagggggctggcatgtcagcactaccccaaacatgtacaaccagccgggttgtggcagcttctaggctcaggtgcaactttgctccgaaattgaagcagggattgggagcagagaagaggccaggaagcaggagcaggcactttcaagtctgtgttgggacagggggctttgcaggcccctgagagtgcagggatgcgttggtccacagctgcagctgggtggttgcagctgcacccagggagtgcagggctcccaccccgccaactcagtaggaggcatgggctcctacctgccttcagcccccaaaagcacagggatgtccgggtccggacagctgcacctggggagtgcgggccctccaccctaccaactcagaagtgggtggggcttccacctgttccttgctcccaccagctccgtggagtacacaaccctggccatatctcccttgctacagctggcgtttttgcagctgccactctagacaggtcactgctgccatcagtttactaggaatagcattgaatctataaattactttgggcagtatggccattttcacagaattgattcttcctatccatgagcatggaatgtttttccatttgtgtcctctctgatctccttgagcagcgatttgtagttctccttgaagaggtccttcacttcccttgttagctggaacactttcttaaggcgatcactttgaaggatcagacttagttagatgtacagattctggtagttggaagaagtttttacctgtggttgcacagtatatgagcatgtctgtagctgtttggtcaaatcagttaagccttgcccagtgttgatttgaagttacttattactctaaattcctatgcttgtcgtgtttatgttgatgaattaatcagtctttctgacttcctttttcctttttagtggccatgtcagactcacaagaattagttaatctgtatgtgttgtggatgttctcaatactttccatttattttaagcattagtttaagtttaccaagcctagagagaaaggtaaggtgggcaataacaaataatcagcaccatgtgtatggtggctgttttgtttctagcttaaatatttaaccctatttgttttagctctctagtgttttgttctgtgcagaactaaatctttcatttatttcattatttctgaaaggctttaaatggctttggccattttttcttaaataccatgaaaatttcattgggctttatggccaaagacatagtgcagtacactgatttcctgtttttaaaattaagatcttttctgttttaaataataaaaaagattttctacacaagtaaaggcaatagataatataacttctataaaatatttatagaaccagtttttgtttatgaaacaggtggtcttttttttctactttttacctttatataatgttctatcttaattataatttttgtatttctcagtggcatttcatatggcaagatagaataaactatcaattttttagttgttgctaataacaaggaaaagccaaaggtaatttctcatgaagccttttcctgacatgattatatgtttatagttgagaatgatatctcaggtaagaatagtcagtgtgtttttttccagtgttatagtaaatggaaattagtaatttgacattaatttttaggggtttttgtttttgccatagatataatttggttcttgagtacagtttatagtatctaaaccattttaaattccatctactaaccgattacttctatttttttaatagtgaatttatggcagaagaaagtaatgaaaaattttggcagtttttggaaactgtgcaagaattagcaatttataagcaaacaggtaggtgatatgtaaattttaacttgtaagatttgtatttatgtacacacattgtaatgtttattattttttaatggtaatggttaagtgtgaatgcttcactgggttagtaaatccgaacattaaatttgaaaatatgttttaatagaaaccattctaagcatctgtttccaaaaatacaaggttttaatactttattataagatacctcatataattagtcatgtttggatattgcattctcatcaagaagaaatcaaaattgttacctgggcatggtggtgtgcatctgtagtagcagctacttggaaggcccaaggccagaggattgactgcttgagcccaggagtcagagactagcctgggcagtatagcaagaccctgtttctaaaaaagaaaaataaaaaaataaaataaattggccaggtgtggtgtttcacacctgtaatcccagcactttgtgagactgaggtggaggatcacttgaacccaggagtttgagctgtgtttgtaccactgcactccagcctgagcgacagagagaggccttgtctcccctgtccccccccaaaaaaattaagatagttttctttttacctagatttctttgaagtaataattttgcatctagtaatagtacatttttttcttttttaaaagtagacttaatttttttagagtagttctaagttcatagcaaaattggacagaaagtacagagatttcccatattcccccttcccctacacataaatagcctcccctgttatcaacatccctcactagtgtggtacatatatatctgttgatgaaccttccttgacagatccttaatacgcaaggtccatagtttacattagggttcaatcttgctgttatacgttctatgggtttggactaatgtatactgacacgtatattgcatttttattggcagaatactttgactcttaaaccattaaagaaacttttaatacctcaaaaagtcaggtaactaatatgctctcatttcactatttgtaagatagtaatttctgtttttatatgtatatgagagtatatacctatatatacgtatatcttcctcagaattaaaaagtgtttattaatgtgtttattattttcctatctctgcagagactagaatagatgacatgagcatggaatcccttaagagtaaaatcttcagccatttagatatagagacatcttcttactattggtgattaaaatagtttattattttgttcctgagtgtaaatgtaagataaactaagtttcagatgttttaaatgctcatttactgaagcctgtttggctcaggtagccttgaagttcagtgattttgtgatttcacaaagtagattttaaaaataaagagatcagacatgcttttaataacattttaaactgaaatatttccaaaagcaaataatttttcctttcaaaattttttcctgaaaaagctttttagtcataagaaatgctggaggtactttagatgatgggaatacaaagatgaataaatgggatctacatccacaggactttgtgaaacaatgaaggagacagcaaaacagtgatgtacactattaggcgataagagctttaattgggtcatgcataacatgaaaacacataaaagaggcacctagtcagtgttccagagagagcaagacaggattttcagtgctgaatgctggagctgagtttgaatgatgagatttagccagggagtagggaacacaaatgagtagaagagaccggaatggaatgtgtggaggaacctcgatcacttagtaatgtttactttcaaatcattaggaaattactgtctgttgtcctcatatttgtcctagtaattttattaatagttttggtgattgaggtaaaagtaggctagattaatatgtaaggttttcatggttaatgtcaagtatccaagatagtttaaaaaaacctaacaccaaatttcgtgtctctcacctaaaatcctcaatatatctgtcccatatatgttgttctcagtacatgctttttggccttattcagtgctattttttattggagacgcaatcttaaaaattactcctgtaaatttcaaattcattttaagttacttaaatatatcagcatattttatacctaaatgaaatgatatacctggacaatctggtggcagatcattcacaagctggaatataagctcaggagtacctaaactctacatcaagcatatatggaaggaggtatttcaagtgttttcagggttgaacctaaattgtattaaagtaggaattactagcacagcacagtggctcatgcctgtaatcccagcactttgggaggctgaggtgggcagatcacttgaggccaggagttcgagaccagcctggccaacattgtgagaccccgtctctactgaaaatacacaaattagctgggcgtggtggtgcgggcctgtaatccagctactcgggaggctgaggcacaagactcacttgaacactggaggcataggctgcagtgagccgagatcacaccactggactgcagtctgggcaacagagtgagactctgactcaaaaaaataaataaataaataacacttaaaatataattctattggctttatttataatggcagagtctaatgcatgtggtgatattattgctgaccttgttaaatgtggaaaagaatggtacaaatgagaaataatgagcagagatttttttttgagacggtgtctcactgtgtcgcccaggctggagttcagtggcatgatctcggctaactgccagctccgcctcctgggttcacaccattctcccacctaagcctctgaagtagctggggctacaggtgcccaccaccacgcccggctaattttttgtatttttttttttattagagacggggtttcaccgtgttagccaggatggtctcgatctcgtgacctcgtgatccgcccacctcggcctcccaaagttctgggatttacaggtgtgagccaccgtgcccggcctaatgagcagattttactgaatttgttttcaagacatcttagaggaaacatttaataatcctctgttacttgtactaatttaggttgttgaatctccatgagaccttctaaatactctttactaaagcatgtcttagtgatccacctgcctaaaaaaattgtaaatattgaacatttaactttttgaattcaagtactagttttataccatttaatgcaattactttatattatatgccagcaaattaagactttttaagcaatgaattgcctgtttaaaaaaatttatatggttctgccagacttacatatttattgatgcttcaagattcaagtggcatattagttaacctatgtagttttgtgaggtgagaaatgtcacccaagatttatctgatttccaaatgcctgtttatttttacttcttcacatgctgctcagcatataagaatgtcattttcaaagtccttgaagattttagtggtttttacacaaattaagttgcttttgtattttattaatggaagaaattttcaaaaaatgttaaggctttctaacatagttacttttacccaagaaccagatttgggggaagaaggtaattggaatttggacgtgccacatttgaaatgcttgtgaaatatccaaatataaatatatcggtaagctgatatatgagtgagagatctagataaaataaattataggataaagggtaggatttcagagtgatcaatatgaaaaacggtaatttaagttgtagggagaaggcacagaatgagaataaaatagtgcccagtggcagaaccctgagaacagcaatgtttaagggaatctgatgagaagaacagcacacagtggagactaaggaagagtacctgtagtggtagctgaaatcctgtaaaagtattagatcatgaaagccaggagaatattaagttgtaagtgattgctgttatcaaatactgtagacagatcaagtaatatgaatattatgcacctactacttttaaaaacagagaaattattagtgcctttggtgagaaccatttcactggtatagtaatcaagactttagtaagttaagatgtgagtaaagcttttcatatctctgttatttggttatctaatttctgagtttcttgtcaaattgtcacaatcagcaaataacccagtctccaaccacccccaaaatgtccccttccagtagagctacgtgtcgttaagtcttttaagacctttgactatgaagggaataagatgagtcagtagctgtctgtggaggctgccacttattttttttaataagagtgatttttgaatattaggtgccagtagtcaaaaattgagtaaaagctgaggttgaagataaaggcagaaaatattgaaggggcatttttagcaggtggttggtgagcatggatttagttatttaacaaatcagccaaaatagcccaatgcatccatttcataatagagatgatcttgctagttacatctaaattataaaagtttactttctataaactcctgaatcctacattcattactacataagggacaaccttgatggtgaccttgatgaaatttggtatctgttgtcaggcactactcacatttcttttgacttttctctgcttccctgggtgaccagtcctttgactgatgtagtcatattttagatgttattacattaatttttattattttcttgctgaccttgtaactataagtattttaagaatattatttaaaataacatttattttctattttgcttttactgttgaacacgaatcttatttgcattattttttgattcttggaggaaaactcaccatatctcccaagttctgagaaatcatctatagtttgttaaagaattaagagtgggctgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggagggcgcctgtagtcccagctactcgggaggctgaggcaggagaatggcgtgaacctgggaagcggagcttgcagtgagccgagattgcgccactgcagtccgcagtccgacctgggcgacagagcgagactccgtctcaaaaaaaaaaaaaaaaaaaaaaagaagagtgaaagaggcaatgcttattctcatatgtcaactgtttaaagcaactggattaggaaaatattgtttagaatgaagaaacttatttataatatttattaaatattaaagaaatttattgaatgtctattttgtatgccaggagtagaaatgtacagttgaaaaactatgatagaaaagatcctttccttcatggtttatagcttaataagaggcaccaaattaaacaattataccaatactttttaatgacttctttgtgaattgatgtagagatggtatagagctcacaatcagactttatgctgcaatttctccaattatttcttggttatataaagtttgctctctggttggtgcctcatgaataactcttggaaaaatagcccttgagttcttcacatacttaattgttcatgtgtgaattcgaaacttctgatttttaactttagagccccagagttgttttttgtttgtttgtttgttttttaaactagagaatgttgcaatgctgatcattctgtgtcttttttgttttaggtatgtaagttcattatttttaattctggaaagttttcttggattatagttttctttaattattctgttccattcccttgattttctgccttagggtctacaagtatacatatattaatctcctttgcctgacctctgtgtttgtcatttactctcaagtcatttttcccttctctcctttttatttgtttcatttttatcacttttcctctgcatattctgtttctcctactgttttccacagtgtctctttactcttgtgctccttctaatttaatctgtattttctagtattattttctttctagttcttatttgtattctttcaggaaacttctcatatctccctctttttttggtcatctcatttctgagctttttgtcaagagctgtgaaggggctggaatttttaccctgcttgcaagctaaaaacttagcttgccacagtttcaggaatcagatggacaacataagactcttggatcagagctgaaagactttataactgactagaggaaatctcctgagtgattcatagcttctttatatcagccaggacctattgaactaaactctgagactttttattgtcatctttgaaaggatctaatattggcaagttggactgtaggaggaatttagtcataaggtgccactaagacattgtttgggagatatttttgaacttatttcccttggcctataaccttttcttcttctcttcattaataggcagcaaaattaagatgactcattgcctgattgactgtacagttttgtcagaatatccactattacttctcaagcactctcctcaaatcctattaattggaccatgggactgggtcttttattctccagaaatccacgtatcttgtcagcattccattttgttgtcagatctgtcaagtactgtgaagggtctgagatgttaccctatttgcaaagataacagattagtttcatggatgctgacagatgacctgaaacccctgattcagagacagaagaaggctttattacatataacaaaagcaataaccacaatgtcccatatttgcactggttgcctgagcctcagttcccacaggacaacttggagggccagataacacctgtaccctgaatgggttgtggtaaagagaggaactgagggtcaagggcccagcactttcggagcaaatagtaaacattgtcacaatcagcaaacaacccagtcttccagccaaccccaaaatgtctgcttccagtcagaacatccttttcctcctctcagaaagagagtatctggtgttgcagtctggtgtaaccacattcttcttgttatccctttcacatcagatatccacagggaactgctcttcatctacctcaactctgttcttttgtatgagaaatttccatcacttgataacccagtgccaagatgtagaggagaataaattaccagagaatgtctagaggccagcctctatggatgcctataccaaatggactccagagctgccctgttattaccttaccatctctggctggccctggaatgacattacagttttctgacacaatgcagtcaatggttacacccagggaagagtagagaaaggaaaagggcacagacagaaagttctgcccacccctgcttatccccgttagtgccaccaggtcttcttcagctctaggctgcacttttctgccttctcccattcaagtgatctctgtctccccaggggtgttggagaatttttaattaaattctaggatccctccttctcctttatgtctttgagttctttgaatagggtttatagtaggcaactcgcagctcaggttagtttgttcaagttccagacaagatgacatttagttttgaagacctggttcaaattttgtctcctaaaagtattctggatacactaattatacttggctattggcactaaatctcagtagaatttattcatacaggtactttaaaattcattaacaatcatattatttaacttttctgctgttcttaatttctaccttgtaggtaggacttatatcttatccttgtaatataaccccacaactttggagtaagttggtctgaaatgttggtgtttccaaatagattttaatggcaagattattttcacctggtctcatgttgattacttggacattactggaagatccaaaatgaagttgattatagaactgagatcttgatttttccatttttctctagcattatccataaccaaacttcagatatgattatatgacattaagttagccttacagtggaagatgtgccaatgtgcagtgtataaaatgctaacatttattttcttttgacttctttttatagaatcagattattcttattacaacttaatcctgaagaaagctggacagtttctagacaatttacacatcaaccttttaaagtttgctttctctataagggcatactccccagctattcagatgtttcagcaggtgcgtaaaaatacccaatctgtatttgacaaagaggcacgctagcaatgtacatagagttctttaatatgaacatctttagttcaaaatgatctacaagtttatagttggttccatagcctatcattgattatattattattgttgtcatttattataatgtaattgaatatattctgtaatttttatagttatttgggataaggaaattatgaggacaaataattgaaatgaagtatcataaaattttaatagaattttttcaataactatgaagcatgtctttcctaggataaagttgattttattaaaatatttcttagattctacctacgtatagatgtttttttactttaattagagcaataacttaatagtagttgatgagttattttaatcaaagtaatgtgtgagggttttaaaatcatattgtaattatcaactgctgtagctaaatataatctttgaaatcttagattgcagctgatgagccaccaccagatggttgtaatgcatttgtggttattcataagaagcacacctgtaaaattaatgagattaaaaagctgctgaagaaagctgcttcaaggtaaattaataatagcctataatgaaagaagtggttatagagaggagagttcaatagcagaaacttcttataataaaaaaaatttaatattctaagacattgtatattcaagaatgtgatttgtattgaaaaccgtaatatatctgagaatgttttgtcttgattagcttttgattttagcatataaattgtgccaaaataacataaaatgtatgaaatgtttcatataagcataacttgttttttgaaataaacatgcaaaactgagtttatttggcctatagctctttaaatataaactgaatatatacctggggaataacaaagtaatcaaaacaatagatgaggttgcttcctatattcaaaactatttttttgcttttttgcaagtatttaatttaaaaaatggcaaatcagaagtaaattattaatttattagtgattttttagagtaatactaccagtatattttttttgcctgattatttatactttaaaaaataataaagtagtttttttaattttgaaagagctctattaaacagtaatatatatttatgcatattaatacttaactcacttgttaacaaaccatttctaacattttcttatacttgtattgaatttcatatacaaaagacttttatttttatgtagccaaattttcctgtgtatgtgacttttatattgtttttatactaacagtttttcccgaacctgattgggagattttactaattctttctgtagctttctaaaagtttttccttttattttacattaaacttttaatctatctgtaatttattttcatcaaaaggtaagaatccaaccagatttttttcctcaggtacctagtcaattgtattcattatatttatattatggtctatttcatagctctttgttctgctccattatctatttcttatagtagtgccatactgttttaatatttattgctttattatccagtttctgacaggaggatttcttcttcattgtggctcttttttcctccagaatgccttagctccttgtatttgttgatgcttttaagtcaacattggaatccttttcctccccaagctccccttccccaaaagccttgttagggtttaattagaattatgttaaaagtattggttaatttaggaaaaatttacatctgtgttgtattgaatctcttatcaaataacatggcatgtttctctgttcacacctgcttttaaaacttaaaggcagaaataattgctttattttatcaattattttttcaactattgggatggatacaaggtttttctcattggacatactaatatattacaaaatactttgaaatattataccttcttttcaattctgaggaaaactactgattattaatggtgtgggattatcttaatttgcttttgaattaagattgctttcattttgttttcatgtttctgtgttaataaatgaatagctgtacatttattgaaattatttgacatctttaatttttatcggtcattctactttcgtaaagtgaattaggcagccatattattcttattctggatgagttaatataggaattatctattcctttatggcattattagactcactataatataactcactagtgcatcttttaaaggaaattttgtaatgtttaaaatttattgtcattggtttctgatgtcaacttttataattatagaaactaaagtatcttgaagattacaaaaaaattaacatcaaactattaggaaagtccatctgccatgggccctgtgagtccttgcatgttctttcttggtctgaccagcaaaaaatgcaaggtcctgaccactctttacctgggccatttctcagggttgtgtttgcagtgagcaaccttgaggaatgaggtaatgtttgcctttgggattggggacagggagcaagtgtgttttattgcttactataaaacagtgcttccccaagcccagtgttccttaacggaaacatatgccaactctgtaggatccatctaagtccatattttgtcaccccctgtgggactttgggggcaagcatagtaacgcttatactgcttgctctatgtcatgagcagtaaagtcatttgtctttgacccaggagtctgtcttatgtcttctatcagaatccataaaagaataaaaggctaacttattagtttgtaagtcaggtaaaatcataccttagacttttacagttcttggtagttttggagactgtcatgggtgggatgttgactgacacacagcttctggaagaggaagttcgtaagggcccatgggtcgagaagaaaaaggtcaatacttacatttcttcccactgctcacctctttctccctgtactcctggtgggtgatagtagtctcctgataactgtgttgtagtctgacacatgttccttgatctgggctcctaaggaaaaggcactcaaacttgactgatttaatggtttattgttttggctctgattatataactggtattggtattttacatgcttatactgtgaatgctgtcaatgtttgtgaagcccagagggaaactgtcattcagagactaccacacatggacacccccaggtggtccagcagaaacaacaaagaatcaatcccaggaggagaaaggacaatcacaactttgtatagacttcatagctgctggactaccccgagagactgtttctaagtacaatagtgccacctgcctgactcagccacttagtacacccctttttaaaatagcagttcttaagctcttgttgaaactgaatgcctgacccatggaggccttgtgactctaccacatgacatttacattttcacgtagttcaactaggagtcagtgtctcgcaaggtaaaagggacccaataagcctccctgctcaaatggaaattatatattcaaaagcccagcttctgggccctagcatggtatcaggtatatgtgaaaaagtggcagctactcttttgggagtgaactaaataacccatttcactacctgaagtaaggtcactggctcaaaagggccctcagttcacagtggtttccctaaatgcctgggccaggctgctgggacgtttagctaagttaacagctggtgggctcttcgggctgcctctgctaccatttcaccaggcataagccttgtaaaaccaaaagctgaagtggtcactctactcagtgggcagaactcaaggccgtcatcctctccctgaacaaaatctgaccccttggttaaatataatacattcatactgactcttgtgctgttgccaatggcctacctgtctggtctgccacttggaagactacagatgggcagcttaaaaataccactccttggggcttgcacactgtgaaagtaatttgcacttgcccatctgacagtctggtttactcctttagatgtacatattatagacccattccctgataagtgtgaatagagacaaactgactatgccaagaccgtgtgaggccctgactgctctttaccatggccttttctcggggtgttttcagtgagtgactttgagggataagtgagtgtttctccctgggacaaagggcaacttacttactgcttgttattaaatgatgggtttcccacattcagtgttctttagatgtgatccatacccactgcctgtgtagaattcttgtgggtccatcatacttctccctatggaatgtgggcccatggggaacccatgtaaacatactaatgttcatgttgcttgctgtgccacaagtaatcaagctctttgactcagaaatctctgtcttttgccagaatccatgaaacaatgaaaagctaacttattagcttgtaagtagggtaaaacaattctacagcctgacagaaacattccccccccccccccccgctatgtagggcaaagttaataattttttttttccttttgtgaacttcaggcatatactcttgggtttgtgatatcttatcaatattggtcaatggtttttttttcttatttaagcatataatttatgtttttacataggttatgtatagtaatataaatattttaattttttcctctctgtagatatgtttctccttcctagattttctttagttttcattttctttcagtttttccagattaggtttttatctttttttaaagaaatgactgataaattttttctgcttttttattctaataggttttgcatttatgtattttcttctgtctgtggttgagctaaacacttggttttttgtgttttttttgttttttttttcaattataacatatttaggtcatcaatgttgcctttctttactatgtgatattctcattgtcccaatttcgtaaaattcttcttaacagtagttttatttacatgttggaaagtagagtgaccactgggagaaagttatactcatttaggatggtaatgattgctgtcactttcccccagatatataactcatattttattttgttttatttatttatttttttgagacaaggtctcactctagtgcccaggctagagtgcagtggtgcagtcttggcttactgcaacttctgcttcccaggctcaagttgtacttctgcctcagcctcctgagtagatgggactacaggtacaaaccaccatgctcagctaatttttgtattttttgtagagacggggtcttgctatgttgcccaggctggactcgaattcctgagctcaagcaatctgcctgcctcagcctcccagagtgctgggattacagacatgagctaccactcctgatcttcattcacattttcgtattatgtctataaagttttggggcagttccagaccatagatttttgaaccagggaataggaaatagggagagatgaagaatcagtttactattctttttttactagcatgttcttgttctaagtggtagttgactgtcagttatgattctaagttgaacagcataggttttatagttagtagactttactcccaatttatgtatgatacaaagttatttttagtttgcaacttcattaagaatttttgtatctgagtctttgtaaatatttttggagatactgtaaaatttagtgtcagggactgctctccaaatgccacttcaaatcaatatgaccatcttttttgtggctttaaacttttgtcccaaatggaaagctgtatgtttaaagttaaaaaaatcccatatggtcattataaaagaattcaaatactttagaaaaatgcaaagtagaaagggaaaatggcctataattctgctaacagtttagtatatgttcttttttaatgcatatatgcatatacagacatacttaaaaaaacatttattgtactataaagggtatcttagatccttctcccacaaagttattgtgttcttacatgtaaataaataaaattactggtatgtaccgattttatgtgttaggctgtttttgtgttactataaagaaatacctgaggctgggtaatttataagtaaaagaggtttagttggtttatggttctgcagtctgtacaaacatggcattaacatctgcttggcttctggtgagagcctcaggaaccttacagccatgacagaaggcgaagctggaacaggcacgtcacatagtgagagcatgagcaagagagtaaggggggcccctgggaattgcatttcaacatgcgatttggaggggacaaatacccaaactatgtcattcttttcctagcccccaaaatctcatgtccttctcacattgcaaattacagtcatttcttccccatgtcttaactcgttccaacatcaagtccaatgtcctaagtgccatctgagactcatctgcttccacttatgagcctgtaaaatcaaaacaagttatttacttccaaggtacagagatggtgcaggcattgggtaaacattcccgttaccaaagggagaaatcggccaaaagaaaagagtaacaggccccatgcaagtctgaaacacagtaggcaggcactaaatcttaaagctgtcatgtaatccttgactccatgtcccacatcgtgatgtacatcctggtgggctccctaggccttgggcagctccagcgctctaactttgcaggatacaacccacgtggctgctgtcatgggttggggttgagtacctctgggttttccaggcacaaggtgcaagctgctggtgaatctaccatccttggttctgaagggttgcagccccccctccactagctccactaggcagtatccaggtggggactctgtgtgggcgttccaaccccacatttcctctatgcactgccctagtagaatatctgtgggggccttgcctgtgtggcaggctcctgcctgggcaccaggcttttccatacatcctctgaaatctagatggaggcctccaagcctccttcatgcttgcctcctgagcatctgcagacatgagaccatgtataaactgccagggcttatggcttgtgccctctggagctgtgacctgagctttacctgtgcccctttgagccgaggctggaactggagcagctggatgcaagttgcaacctgctggcatggcacagggcagtgagcattctttccttttaggccttggagtgtatgatgagaggggctgcctcatatatctctgaaataccttccaggccttttcttcattgtcttggctgtcagctcctggctcccttttagtcatgcaaatctctctagcaaatggttgcccaatagcccacttagattcttcccctgaaaatggactttttcttttctggctagggctgcaaatttttcaaacttttatgttctgcttccctcttaaatatgaattccaacttaaagccatttctttgctcctacatctgaacatatgttgttagaagcagccaggccacttcttgaatactttgctgcttcgaaatttcttccaccaaacgtcttaagtcatccctcttaagttcaaacttccacagatccctagggcataagcacaatgcagccaagttatttgctaaggcataacaagggtgacctttactccagttcccaaaaagttcacctaccatgtagtagatgctgaaaaatattgagtgagtgataccgtaatgaaatgaataaataagtttcattattccactccttgcggtgtatatataggtagtttacagtaaacaatatctaattgaacttccttgtacatatatctttgcatagttaccttggttattttcttaaatttctagaactaaaatctctaggtaagtacatgtatattaaagtgtatactacaaaattgtcttcagaaagctgaagttttatactctacttctaaaatttttaccaatgctaatttgtattaattctctttaacaccttagtcaattcagtaaattgctacttttaaatataattatttaattttcaaagatcattttcctcttatccagccatcctctataggtataatttttctacctatgatatatccaagcagttcctgaaataatcataaaagcaaattttgaaagttatgtgtctataggtacaggaaggaaggtactgtcgattacagactcagcaaatggtagagagcccttacctttgtgtgtaaagtctattccatttcctctaatttttccttttatattcaacctcaatatttatctcctagcatagttttattggcagcctttctagttttctttctttttttttttttttgagacggagtcttgctctgttgcccagactggagtgcagtgatgcgatctcggctcactgcaagctccacctcctggattcatgccattctcctgcctcagcctcccgagtagctgggactacaggcgtctgccaccacgcccggctaattttttgtatttttggtacagacagggtttcaccatgttagccaggatggtctcgatatcctgacctcatgatccgcccacctcggcctcccaaagtgctgggatttcaggcctgagccaccgcgcctggccgcctttctagttttcaacagtagtaaattctttgaaggaagaatttttcaggcttaaattaaaatttaagattccttatataaattactaaatgtacttctatgatactgatttgataaaatcaggtttataaaatgataatccagctgctatataagtgacatttgagttccaagatttcagttaaaatttatgagaataattttaatagtttcatgcaagaatctctttcacttctcttttcaaagtgaagtatgattttgtatccttttagcatttattaatagcctctcatgaagaaagacagcaaattcagtgtctcttgttttgcacattcatgtctcttcatcggttacagaagattaataatgaagtgaaattctatttggggttaagattctatttactttatgcttcagctgtccaagcattgacagtagtaacatttctatattgctgttgagtaatggcacaaattctaagccaaataactgtggaaatctctcaaattattctgttagtcaataagattgaatgcttgaatgattttgatttagaatatgttgagtcagtaagtagttaagctagaattgaatccaattctgcctgatctcaaaacccaccttcttttcactaacgtgctgtaggaatgttactcataccttttttcttctgtccttaatatttgttatccaaaggtagtaattgactgaatgattgtagagatcagaattcactaaataaaaggttatttctcaacatccttgttactctgaacttccttatctcttggtttgctttctacctgtataaattgccaaaacatatgggctttggaattccataaacatgagttgaaattctggctttccatttgatcttttcctgaatagttaacttatctgagcctcagaaacttaaaagtttcagtgatggtagctgtctaatttttcttgtgaaatagaatttactaataagtgtaaagaacctagcacagtgcctggcaaataagaagtcagttaaagtctgtttctgatgataatgctagaccataagagtcctggtttctttgcttatacttggggatttgatgagtacttgttcatactaagtactgatagtctttgaataaggtagtacttttgctttgtgccttaaatatttataccttgttttcaggaaatatgagctgtaatgaaaaattataacctaactgcataaaatataaattttatttcactgaaaattgtgctgccattatatgttattgtttaaagataataaaccttgttgggaaataaagtatttttaatattagatttgggttaaccaaattcttttctttcttttctgtcatttagttcaagttatgtgtacaaagtcatcacaggaaatttaaattctttttctgtgattatgtatattatgaattgtttgataagcagtaattatacagaattgatatgccattaactttcagttttttcaaaactttgtgttttgcttttatcttaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcaggtatgcgcttgttttttccaaggttgcttttggctgtagaaaaaaacaattattatgataatcgtcttactagatttaaatattaattttcaccagaatagttatctaactttttttaacttaacaaatgtgaatttcatgtggaaaaatatattgggattctgtctcttctgggggtatgatgtctataattctttgccttatatctggcacaaatttaaaacttggataaaaaacaaaaacatacttcaataatgtgtataatatttgctaagaatttgcaattaagaaatctgatttactcaacatactgataatatatacagtactagatcaaagtgcaaagcatggtgttggaatactgttaactctttcttttgagacctgactacttttcattcaggtatctggtatgtgctgtattgttcccgttcctctagcctgccgttgctatgacactatcacatttttctgttttaatgatttcatagcacttattactgtatctcctcaagtttatttaacactttcagagcacatacatgcacacacacacacacacacatgcgtatgaatataatggccattagaggaaggactatgctttgttactactgtcttcccaacatggagtgctttaatttgcatttcccaaattattaagatttatatactaatatttaatctaattaaaaccttaaaaatatatttgtaaattgcctgtccgtagcctttgcctatttttgaattgagattctttttttctcattggtttataggtgtttttaatatattttgaatactaatattttcttccatacttcgcagtatcttctcctagtgcatttctggtcttctgattttttttaaaaattgtttatgacatcttttacaaatattacttgtgatatagtcagatttactcaactttacctgaacgatttcctttatgctgttataaggacattctcttgtaagagttgaagttctattttttgttttggtttttaatccatctggaatttatttgaatatactacggggtagagatataattctgttttttccatatgaaaaattattggtcttcacatactttgttgaacagtcaagtctttattctactccatcatatgctaatttttcatatagacatgtatatgtttttagactttccattctgttgcagtgatatatatgtctattctacacaaaaataacatcattttaattgctgtagctttaaaatatattttgatatctggtagttcaactctgcttcttaatttttgtttttctaaataccttggctgttcttgcatgatatgtagccatgttaattttagaattagttggccaggttccatgaaacatgttgggatttcatacgggaatgaattggacctttctgattaattttgaagagactttttcttcatatatattgagctttgccttctatgaacatatttttatttcacaatctagtcagatgtctttttgaaaagtatcatctgtgatgtacaatgttgggtttcaacaatcacacagagtcatctgtcagtcaccttagtaccatcatattcacatacagattcttgtaggaacatatgttttcaattcacttggataaatgcctggaagttctattgctgagttgtatggtaagtcagtgtttaacttcataataaactataccaaactgtctctcaaagtggctgtacaatttttcattccccttagccaggaaagataatttcgctgctctaaatcctaaccaccatttgttaatgtcagttttttttattatagctgttctaggtacacagtggtatctcattgtggttttaatttgcatttctctaatgactaatgaagttgtctggcttttcataagtttctttttggtgaactttttttgtttagttttcagaattctttttatgtcctagatataaatcatttatgagatacatgatttacaaacatattctaccagtttgtgaattatcttgtaattctcttaatgtgttttgcagaggaagagtttttaattttgattaagtccagttcatcatttttttgtttatagattatattttttgtattatatctaaaaactcatcaccaatctcaaggtcattcagattttattctaagcgttttatagttttatgtttacacataggtttatgatccatttaaggtttgtgcaacttgtgagatagatgttgagatttatttttctacatatggatatctagttgttttaacatttgtttaaaagactgtccttctccattgaatttcctttatccacttgtaaaatataattgactgtatttgtatgggtctatttctggctttgcttttctgtgccattgatctgtctgtcccaacatcaatactacactgcttgattactttaccttgatagccttgagatcaggttgtgttagtcctccagctttgttattctttttcagaattgttttagctaatctaattcctttgtctcttcttgtgaactttaaaatcggcttgtctgtatctacaaaacattttgctggcattttgattgagattacattgaacatataaattaaatttgtgggagaacatcttaaaaatattcagtcttccaattgaaaattatgtctcttgatttatttagacatcctttgatttctttcatcagtgtttttcttctttttcaacctatatgccatttatttttttttaaccttattttaatgattaagacttctagtcaatgttgaatggggagtagtgagggaagatatccttgcctttttcctgatttgcagagaaagcatttggtcttctactattaactgtcatattagaggaagggtttatttttaattttttaagttctggtgtacatgtgcaggatgtgcaggtttgttacataggtaaatgtatgccatggtggtttgctgcacctatcaacctatcacctaggaattaagcccggcatgcactgtgtagtatttcgtggtgtatatgtaccacattttctttatccattttactattgatgggcattcaggttgatttccatgtttttgctttgtgaaaagtgttgcagtgaacatatgcatgcatgtgtttttatagtagagcaatttatattcttctgggtatatacccagttatgggattgctgggtcaaatggtagttctatttcaggttctttgaggattgccacactgctttaaatgaactagtttacagtaccaccggcagtgtatgtgcattcactattttctgcaacctcaccagaatcttgttattttttgactttttaatagtagccattctgactgatacaagatggtatctcattgtggttttgatctgcatttctctaatgattagtaatattgagcatatttttatatgctttttggccatatcatatgtcttcttttgaaaagtgttcatgtcctttgctcactttatttatttatttattttagacagagtcttgctctatcgccaggctggagtgcagtggcgcgatctcggctcactgcaacctccgcctcttgggttcaagcaattctcctgcctcagcctcccaagtagctgggattacaggcatccaccaacatgcccggctaatttttgtatttttagtggagatggggtatcagcatgttggccaggatggtcttgatcttttgacctcgtgatccgcctgcctcagccccccaaagtgctgggattacaggcgtgagccactgcgtccagccttcgctcactttttaatggggctgtttattttttgcttgtaaatttaagttccttgtagattctggatattagacctttgtcagatacatagtttgcaaatattttctcccattctgtaggttgcgtgtttactctgttgataatttcttttgctgtgcagaagttctttagtttaattaggtcccatttgtcaatttttgtttttgttgcaattgcttttggtgtcttcgtcatgaaatctttgccagggcccatgtccagaatggtatttcctaggttatcttctgagggtttttataattttaggcttcacatttaaggctttaatccattttgagttgattttttatatggcataatgaaggagtccagtttcagtcttctgcatatggctagccagttttcccagcaccatttattgaatagggagttctttccccattgcttgcttttgtcagctttgtcaaaaatcagatggctgcaggtgtgtgacattatttctgggctgtctattctgttctgttgctctgtatgtctgtttttatgccagtaccatgctgttttggttactgtagccttcagctttgttctttttgcttaggattgccttgactattcaggctcttttgttccatataaaatttaaaatagctttctctaattctgtgaagaatgtcattggtagtttgataggaatagccttgaatctgtaaattgttttggcagtgtggctattttaacaatattgattcttccagcctgtgagcctggaatgtttttccatttgtttgtgtcatctcttatttccttgagcagtgttttgtattaataattctcattgtagagattcacctccctagttagttgtggtcattagtattttatttttatggcaattgtaaatgggattacattcctgatttggctgccagtttggatgttgttgctgtataaaaatgctagtgatttttgtacattgattttgtatcctgaaactttgctgaagttgtttatcaggtcaaggagcttttgtgcagagactatgggattgtctagatatggaatcatgttgtctgcaaacaggtatagtttgctttctctttccctatttggatgccttttatttctttctcttgcctggttgctctggccaggactttcaggactatgttgaataggagtggtgataaagggtatgtttaagttccttatgtattctgatattaatcccttgtcagatgggtatttgtcaaatattttctcccattctgtggattggctcttcactgtgttgattgtttcctttgctgtgtagaagatttttagcttgatgttaactccacttgtctatttttaattgtgttgcctgtgcttttgaagtctcacacaaaacatttttgcccagaccaatgtcctggagcatttcttcaatattttcctctagtcgtttcatagttttgggtcttatatttgagtcttcaatcaattttgatttgatatttgtatatggtgagagatagtggtctagttagtttcattcttctgcattatggttgttcagttttcatattgaaaagactgtcctttccccagtgtatgatcctggcatgtttgtcgaagatgagttggttccaaatgtgtagatttacatctgagttctctattctgttccattggtgcatttgtctgaatatgaattcttccatgaacatggaatatctttccattttttggtgttctcttcgattcctttcatcagtgttgtagttttctttgtattaatgtaggtctttcacttttttggttaaattaattcctaggtattttatattatttgtaactgttgtaacattttcagaatgttgtttgctatttgtgtatataaatagtactgaattttgtatattgattttatatcttgcaactttactgaattcatttattggttcaaacagttttttggtggagtctttaggtttttctaatataagatcatattgtttgcaaaccagggtaattttacttcttcctttccaatttggatgtcctttatttatttctcttgccttattactctggctaaggcttctagtattatgttgaataaaaatagtgaaagggggcattcttgtcttgttccagatctttgagggatggctttcaattattccctgtttccatatgatattagctgtggatctgtcatatatggccttaattattttgaggtatgttccctctatacctagtttgttgggggggagggacttgtcagaaagagatgttgaattttgtcaaatgccttttcagcacatatttaaattatcatatggtttttgtgttcttggttcttttaatatggtgtattacatttatcgatttgtgtatattgaactatcctgtatccctgggatgaatctcacttgatcatggtgcatgatctttttaagttgttgctgaattcattttgctaatatgttgttgaggatttttacatctgtgtttattagtgatattggcatatagttttctttttttgttgtgtccttgtcttgttttggtattgaggtaatgctggcctcctagaatgaatttggaggtgttctctcctcttcaagttacagagcagagttagaatttccaagactggggatggcagtcctgcctttcctctttgtctttgtcctgaggcatatttctccctttagacactcatgatgtttcccatgtgtggtactatcccacagctcctgagtgttctgctcagtttcttgctgttgtttgctttttggattttttcctttctttctctactacattttcttcttaaattcaatttgaataatttctattgacctgccttggagttaaccaattcttttttttttttttttttttttgaggcagaatctcgctctgtcacccagtcttgagtgcagtggtgcaatctcagctcactgcagcctccgcctcctgggttcaagcgattctcttgcctcagcccccaagtagctgggattacaggcacacaccaccatgcctggctagtttttgtatttttagtagagacatggtttctccatgttggtcaggctggtctcgaactcctgaccccaggcaatccatccacctcagcctcccatagtgctgggattacaggcatgagccactgcacccagccagccagttctttctttggctatatcaagtttacttgtgactctgttgaaggcattctttatttctgttacagtgcttttaatttctatcattgccatttggctccttcttacagttttaatatgtgtgatgaattttcctttctgatcactcatatgttctacttttttcattagagcatttaacatgttaatcattattttaaattccctcctgaaagtttcaacttcttttttacatctgattttgaaattgttgattgatttgtctcttcagacttttgttccattgacttcttggacatcttgtgattttcgttgttattaaaagctcaacattttgtgtaggagccttgaccctgcctttagtttaggccatgcctttcatgtatgcaggattgaggtgttctggtcaggagttgggttgggtttcacgtttgtgttccacttggctttaggtctccccacttagatttggatcttccctttgtacagctccccaaagacaatgtgtttcttatagctttcccacctgtatttcagcgttatctttactcaacccttgttagattggccttgaggtgaaggtgagggggcagctaaggaaggggatattctctgatgttccaattaagtttcctttctaggcatactgtaaatttgggcctcaaggtttctgatcctctctcagaatgttgggcctggcaggtattcccgtccttccttcagactaagactttcatctgttccatttctcccgtcttcagtgggcttccaccagtacactatatagctacaattttgttgcccttgcctctgaagattaaggctttggttctataggggagataggtctgaagtggatttcagcagtgatttttctttcctctctacctgtcaccattagagtggaagctttctcaggaccttccccagtcttccctgtgcaagagggtttcagccttgctatgtctggagctaccaggggcttcacactctcacgttagcccacatttagcctttagcaagctttatagatttctagctaaatatctttaccagcttcactagcatttggtggtatctgtcctgggtattcaaatgttcaccttcccacaggtgcctttttcttctgttatcattctcgttccttctgctttattttttcttcagaaaattttctaatacaaaaagcctaaaaataataaactttttgtatatgctacccagaattgacagctaacattttatcttttcaagtttattttttaattgaagtaataaaactttaaaaataaagttgaagattattttgttttccattatcagtctcattctctaccccaacaccaattggagtgttcttttaaataataaagtgctgtcactcctagagatctttcttcgttagatctggcacattggttgggaatatatagcatatgattctgaggccctctgatatctgtccactgaagaaagagaaagatgagacattctagttctgagagaggaggtcataactaggtggctgtttaataaggatacaatgcttataaaattatttttccttgttttgaaacatacaataaattatttttttggttttattacatttttttctgttctttttttcatttattattattatactttggggggaggggggagggatagcattgggagatatacctaatgctagatgacgagttagtgggtgcagcgcaccagcatggcacatgtatacactaacctgcacatatgtaactaacctgcacattgtgcacatgtaccctaaaacaataaattattaaccatagtcactcgattgtgctgctgaacactagatgttattcttcctaactgtatttttatacccattaaccatcccctcttaatccccacatccccactagtttttccatcttctggtaactaccatcattctagtctctgtctccctgacttcaaaaattggaatgttcctaacacaaagaaataataaaatgtttgaggtgatagatatcccaaataccctgatttgatcattacattttgtatgtttgtatcaaattataacatataccccataaatatgtgcaacttttctgtatccataataattaaaaataaaaaattttaaaaacaaatatgttttttttttttttcctagagttgcttagataccatagctttgctgcttacctggggatagctttgctgcttacatggggaatccaaaatttaagtttcttagtgctgattgaagctatcttataacttctgaaagcagtaatatatgattgtagaggatgaaaatctcttaagttactactatttatgaggaaactaggtattctttgaattagaaatttgttagaggaatctgtcatctcttccttctttctttcctccatgcacatttattagatgctgtgtctgtgtctgaattgctttgtaacaaatcttctcaaaatttagtggcttaaggaaatattgacttactgtttctctttattctgtgggttgacagtcggggcactttttctgctggtattgttcatgcagtgagggtcattcagtactagattagagcttggggattcaaattattctgacagacctgtgtggcagttcaggctgatagctggagtttcttgtctttttctacatggcctttcatcttccaagagttagactatgattcttcacatcatgatggcttagggtcccaaaaagaaaagagtagaacttgcaatacctcttaagccctatgcccaagaactcatacagtgatacttctgccaccttgtgttagtcaaagcaagtcacaaggccagccagattcaaaagaatggaaaaatagactcaatttcctggtgagaagtagcaaggtcacattgcaaaggagtctggacatgggaaggagttactcatttgtggcctttataataatcttccacaaatgcctgtaatttgggcactgtgcttagtactggtgatagaagataagtagcttatttcagtatcttaattttgttttatatatttgataattttatgatgcaggttcactgtgcactggtatcaatcccaggggaggactgtaaacaccttgccaatactgtgtaccagtatcaatccactggcatgagtctggtgagacagaacacacaataagtttagggaagcaactttattactcacagacaggcagcaagggacaatagacacctaaggattcatggcaagctcatcccccaaagcttaggatagctgtccaggatggatggagtctcacgtgcacgtcattcatgttgcaccgcagctgaggaactctgaaagcctgctctgccctgggttttatacctaggagcaacttgatgagctgtgctaaagcattgcaagacatcctgttctaggagctatgggaacagagcttggctttactggcaattccttcatatttcttgcatttccagcacatcattctacagttattctgagatttacaagtgagaaagcgaggaagagctgggttgccaagatcttttggggacttgccctacaataacatcatataaaatgtgttttttccctcagtgttcttcacattctcaattttaattgttcattgtataattttgagttagttattgctatttagtaaaagtggaaaatcttaaatattcttgagtgtgttggcatatagatatttgcataatctacataaagattatctgtaaagtgagatgtaaagagaaagtgtgggtgtgtgtacagtttgtaaatgattacatatttaagtcattaatttcataaatatttggatgcctctgtgccaggcattggttcatgtagcagtgaataagagagaaacattccttattctcagagaacttcaattttagtggcaagagatgtaaaacagatttatgttagatggtgatgaaagtgttttcagaaaagataaatataaaagaagaggacagagagtcatgggtctagagtgtgcactcaaaacattttatattgtctaatcatcttatgccaagaattctcaatttttcccaactgagtttgctagaaggatggatacattaccatcaataacagtagcaccttaagactatgattctctgtcagataaggcagagctgagaggcaaatgagaataggaacgggagtgggagatacaagtacagtttacccttaagcatgtgtgagttagagatactgacccctcatgttgttaaaaaatatatgtataactttggactccactaaaacttaagtagtaataacctactgttgactggatgccttactgataacagaaacagtcaattaacacatatttttcatgtcacatgtattattctgtaattcttacagtagagtaagctagataagtaatgttattaagaaagtcataaggaagagaaaatatatttttcattaaatagaagtggatcatcataaaggtttttatcctcatagtcatgttgagtaggctgaggaggaaatggaagaggagaggctggacttgctgtttcaggtggcaaggtgggagaaaatctataagtaactgtctataaaagtagatatctataaaatatctgtttcttgtaaaaatttataagaaaatctgtaagtaaacctgtgcaatgaaccttgttgttgttaattgtctgtgtttgtcttttttaaatgttctcccaagtggttctaacatgcccctggggagctatgcccatctgttgtgagaatctgtctcaagttattatttagagtttcatgcgcgtccgtgtgaagagaccaccaaacaggctttgtgtgagcaacaaggctgtttatttcacctgggtgcaggcgggctgagtccgaaaagagagtcagcgaagggagatggggtggggccgttttataagatttgggcaggtaaaggaaaattacagtcaaagggggtttgttctctggagggcaggagtgggggtcgcaaggtactcagtgggggagctttttgagccaggatgagccaggaaaaggactttcacaaggtaatgtcatcatttaaggcaaggaccggccattttcacttcttttgtggtggaatgtcatcagttaaggtggggcagggcattttcacttcttttgtgattcttcagttacttcaggccatctgggcatatacgtgcaagtcacaggggatgcgatggcttggcttgggtttgggctcagaggcctgacatagagaatgtgaccattaagtgtgcttctgtgaaatcatattaactatctgggcatttagtaacatcaaattatagccttatatttaatgaatgacatcttttatgttcaaaataactataatgtaaatctagtcaacatgtaattctaataaaaatagacatatttatgctacatttttaacatatgcctttttgtgggggaaatagaaaaacaaagatttttttttttaacctgttgatttggtagtttggtttgcaaatccaaacttactaaaactacaaaattacaattcaaattttatatcaacacacttccaaatgaggaaagtaaatatgaatttaggaacatttttattactgaggagctaataactttccagaactgataatggaaattggctatgtgaaattgcatttcttttatgaactataacaagatatacggccttatagtttcgattcacttagccaccaactgattggtcttttgactagatattcaaaatgtagttttaaattgagctgttatgaaattgaaaactctaaaaaattttcatctttgtcagattactgtaattagaaataacccagtttctacatgctatctttcatataatgtgggcctgagaaattagcaaattaaattttagtgtgggcagcaatgttaagtatttgtctgaatagctgaagctaacttttacatattcttacctggaaatagaacaggccaaagaacagtcactctggccatatacatatcaataaggcttggtagaaagtttagggaggaaagaagagaatacaaagaataacacactactaaagttctccttccctccaatctctaccttttcctctatcatgcaaaactgtccctgtgcaaacctgaattaagcaaagacacatggcttcttccagggagtttgctgagctctaggttaaagttgttttctaaccccttgagatgtgccaaatgataatggttgcagtacagccaacaagaatttcagtctggaagctggaacaactttaaaactattatgtgtgttcatccaggtttcttccttttgaataaaatatggtgacttctcttgtttgatgaggtaatctctaggagtacatttaatatttgccctttgtagaaagaataaaataaaggtactaaaattctgatcataaacatttcagaccactctgttttagtgaactgtagccccttattgcaagaacagatgttaatttgtggcatttggtatattttaatcattgagaaacaaagaaaacttttatcaggtatttcacggcactaactttttttgtctcctttgccactactttccagtgtttgcttttggcagcactctagtcctacatctagacaaccagcaagtgaagaggatttttggtttagcaaatcttttgggggtccccaaaaaggaaaacagttttgttgaaacttgtctgttattggatcctctgtttaattaactcattgaagacatgttataacaggaaaagatcagatatttattattttaattgtaaaaattaaaaagtaattaaaacagtagtcatgacaaagtttttacagagtagtcattaaccaaattctagttccttgatagactagagacaatataaacaacccccaaatttttcagagtgattaaaaaccttcaatattagtaatttacccttatgtccaaatacatcgtggtactgactttaaaacaaaatgtttgactaactcttttcgctttttataaaataaatgtgtttgaacagaaaccaagctcacggaaaatgtacttatctgggtatggtgtggagctagcaattaagagtacagaatacaaagcactggatgatacccaagttaaaagtaagttctctatctcagtacttgagtagaatgaaaagttggaggcttttacatactttagttttttaaaaatttaatgagtataatcctacatatgttcatttgaggctagagatggggtggacatattcttcattaaaatttggaattaaattttcagctgaaagaaatgtatttaatattattggttatcaaaatttctttaaaaatatgaaatcgtatgttattttgctgatacccgatgggctcccaaccatttcagcaccatgtaacaattgatagtatatgtaaggtacactgtggcaatagatgaggctgattattgctagaggtgactggcataggcatctgggtctcgcccatgtaaggaagttttgtctgaaatatttatttgaaatgaaattaggatggtagtttttttttttctatcctgaagcaggatgagagagtcctatgaattgtttagatgaagtagattcattagatttgtgatctactaaccaatatctatctgtattttatgaactaaatgcatactctagatgaagagactctgaagacttaaataaactaaacaagttctcagaacacttatggaagtcttttattacctggttcatgtcaaatttatttatgcctgattcttggtcaagagttttatgtttattctctatatgcactcagatgaggctcctgcttcaactttgttttttcatatagaggccctgccttgatcacagacttctctctggctcctcctactgaatgtgcttcagataaagatcgtattactgtaatttaaatatttttggttaaagagttactgaaaaagtatagtaaaaataatactctgattttatgtatttctctatagcttgtgtatagctctacaatgctttataatttactctcttgtagtcacgatagcaatttaaggcatttttagctttaaaaagtcagatggtcacatatgtatcatctgtattattatgcactgcattctgtcatcaaccttttacacacacttggaatatgtcttcgcctgtcaattctagttgccactccttagtgcagttctttttttctctgtatacatgtatcagacctttaactagccatctctctgatcttaggtcttcagtgcccttaatctcaccacccctcaaaacagattaatcaatctaatctccacagtactttccaaatgaacttctgatgttgaaaatctgactttgtgattccactggttaaatcctttagtggctccctataacctctctcaaaaattcagaacatagcaaacaaagcttttcacaatctgatttcttactgcctttttactgtccttcagccctctctaatttgtgtcctcttgcctgaaacactaaactacttactatttagaataattttctgttccctggatgcttttatgcatgggctccatgggaagtctttatgacctctcctacattcatcccttagcatatgctgttccttttgcctaccgctgtcttcacttctttcatttcttctaaagacttcacatctttttcttttttttcctgagatggaatcattgctctgtcacccaggctggagtgcagtggtgtgatctcagctcactgcaacctctgcctcccggattgaagcaattctcttgcttcagcctcctgagtagctgggattacacgcgcctgccaccatacctggctaatttttgtatttttagtagagacgaggtttcaccatgttggccaggctggtattgaactgaccttgtgattcacccacctcagcctcccaaagtgttgggattacaggcgtgagccaccacacctggccagactaataaatatatcagtctgtgcctctgagatggctgcctatcttgctgctctgttagagaatgctcttctcttttctatatcccatatctttctgtgccttcttttagaaaagttcatggtctgtattttttgtgtctctgttgttcttggtgtctatcctgtcatagacacctcatagtaagcagtcaataaatgtttgcccaatgaatgaatgaacaaacaagaggaaaaggatgactagatcaaagtacccagggttgcttttacttatagtcctagagattcagagtctcagaaaagtaagaaagagtaagcgtaattgctgagctctgataaactctgatagagagccaccccacacactataagaggtcacagtctttatgatcctaaagcacccttcacatattacaccaaccagactgtatagtataattatttggtatgtaagggagaagggaaatgactataaaatattatatctttattctttgagaccatgagttttggtgtctttctaaatgttccttgattatctttaaaggtgttggaaatatgtaggaactcatatttaaacttagggtttggacctcctgcctcacttaaaagctaaacccagcatttgttacaggccttttggcttatttctgattatgaaatagaacttgactattaactaatctataaagcactttattatagttgctaagtatttaatcaagcatgttaaaaaagatagctcacacttaggaatgttagcctgtacacatgcatatatatgtattaatctggtccatgaaggaaaaacaaggtaaaacgaatggaatttcatttcattgtgagttctaatttttttttttttttttagacacagtcttactctgtcacccaggctggagtgcagtggcacgatctcagtccactgcaacctccacctcccaggctcaagccactctcctgcctcccaagtagctgggactgcaggcgcacaccaccacacctggctaatttttgtatttttagtagagacaaggtttcactgtgttggtcaggctggtcttgaactcgtgagctcaagtgatttacccacctcggcctcccaaagtgctgggattacaggcatgagctgccgcacctggccaagttcttctaatttttgattacatgttcttttcccagtctgaaaatatttttgttgttttttggttttgtttccaaaatgtagctgtgactaatactactgtagaggatgagactgaaacaaatgaagttcaaggatttctctttgggaaactaaagtaagtctgaatggaaatgaaattggtattattatacccattggtttttaaggaattaatttgatatactgttttgccatatgcttcacctttcttttatgtagaaagtacaaacacacacacatacgattgtttttatttattacagaagtaacacatggctaatgtcaaaaagctacagaaagcagaaaagcacatttaaaaataatcactaatttcacaattaaagagataactcataatgttttggtgtacagtatgtttttccagtctttctgtgaatatttttatagcatcaaataaatgcatacacaacatattgttttgcacagtagaaccatagtgtgtagctgttttttccacatcttgtggatagtccatcatttattgaaacagtcccatagaacaggactttaaattctttccctactttttcatttaattttttttttgtgtaccagtttgtgtgtattgcagattttccttagcacaaatttcaggaaaatagttgataaagtatatgtgcttcttgaaatttttgattcatacttgtaaactaccctcataaaattgtactaacatggacactcaccccagaatgtgaaatgtgttcatttcccagaactttaattaataaccactcatactatttttaaaatctttttcagtttaataaatgaaatgttgtttctttttttaaaaaagtgtatttaattcactggattgaaccaattttataatttgtctccaagaaagtcaactattggcagtctattattgcaaggattaactttttttcatgtttattggccttggaatttcttcttgagtaaattgcttattcctaacttgtgctcatttgttcttgctgtgtttatctttttttactaattataacagctctttataaaaaattctgaaacctttgccacatattgaattacttactgtcgaagtttattttcatattaatcttaaagatggaagtttttttcattagatacaactgttatgtttacattgagagtgggattttatttctgaaactctggtggtatccctgggataactagaaaatttgaaatttaagactttcgatacctatggttggtaactgttaaatatgcatgtttttctccttttacccagaataaattatttgtcccataaataaagttcatttatagaatggctaaacctcaaagacatgaaacaacaaacataaggcaacaaataaattgttaaatatttattagccttgtagcattttttgatcctgttcttcatttgcactatatggtgctatcaccatacaaattatgatttcccatattcgaaagtagtacttttctttattctaacacagctgccataaaagtcaagtaaataattggtatagtacatacttgtttaggaagtttttaaatttggagagaaaaaataatataatttagtaataaagcattttaacaattcatggaatataataagcattaatgtgtttgttaaacatgaataaaataaatgaaaattataattattaagttattatttattaaaatagtttcacaaaatgctgccaagaaaaaactgcctaaattgaatttcttttgaggaaaaaaattaagtaaatcattattttttaaaataaatattgtaataatgttagctaatatttactatttttaaactcagtgttatttttactgttttttaataaattaacttggcaagctgtggtaaatattcctctttattatattggtttctttatttttagggagttctaatacatctgacattcataaagtatgagatacttaaaatcacttttcatatgataaatttgacttagtgtgcttagagaaacaggagttgataaagttctgacagaaaactaaaaactttatagaatctagaactttactgatctaatgagttacaaaaatcattgataatattggacctttagcttgaacaaatgtatagccccaaagaaaagaaaacgtttattactcaaattttctgtactacagattaccatttcatatacatatataagtaagctttcaaaaattaaagttatacccccccctttttttcctgccacgctgattgaagacaaggaatagcatggtgagtgctctatgaatactcatgaatggggatggctgtaatttcatgtacattttcccttatttacaagtgaaagtttatgatttctttatccaggcaaaattaattaaagaaatatttttattaacacctttagttcttgtttagtattacagtcatttatgaaggactctcagggtggttctcctggtgatgagtagataactatagacagtaaggataagatttttggagactatgctaatttatatggataactatgttacatttttaaagtatgttggccagtcagtatactctagtggccttaaaatgttaatacagcttacaaaatggttttattctaagtaaggtatttatttagcagctaacaatacatttttatcccattttcagctatctcaacatcttggaatttatagttcttttctcttttgaatataactttttatgggattaaattgcattttctccaaaagatcacgtggaacactgggctattttaattttaatttaattttattttatttcaacttctattttagattcaaggcatacacgtgcaggtttgttacatggatatattttgtgatgctgaggttaggggtatgaatgatcccatcacccaggtagtgagcatagtacccaacaggtagtttttcagcccttgccatcttcccactctaatagaccccagtatctattattcccatctttatgttcgtgtatacccaatgcttagttctcacttataagtgagaacacagggtatttggttttctgttcctgtgttaattcacttaggataatggcctaccgctgcattcatgttgctgcaaagggcaggattttccatggtggtatatgtatcccattgtctttttccagtttgccattgatggcacctgggttgattgcatgtctttgctattgtgaataagtgctatgatgaacatatgagtgcatatgtctttttgtcagaattatttatttttctttgggtgaatacccagtaatgagattactgggttgagtggtagtttgaagttctttgagaaatctccaaactgctttttgcagtggctgatctaatttacatttccaccaacagcatataagcattcccttttctctgcagccttgccagcatctgttactttttgactttttgataatagccattctgactggcgtgagagggtatctcgtggttttgacttgcatttctctgatgattagtgatgtcgagcattttttcatatgtttcttggctgcttatatgttttcttgtgagaagtgtctgttcatgtcttttgcctaggaaaccctaaagactccgccataaggctcctaaaactgataaacaacttctgtaagtttcaggatacaaaatctgtgtacagaaatcagtagcattactaaaagccaataatgttcaagctgagagccaaaacaagcaggcaatcccatttacaatagccacacaccaaaaaaagtatgtaggaatacatttaaccaaggaggtgaaccatctccacaagaactacaaaacactgctgaaagaaatcatagctgacacaaacaaatggaaaaacattccatgctcatggattggaagaatgaatgtcattaaaatggccatactgccaatctacagattcagtgctattcctgtcaaactaccaatgtcatttttcacagaattagaggaatctattctaaaattcatatggctattcatttttttttcttttctttgagacggagtctagctctagctctgtcacccaggctgtagtgcaggggagccatctcggctcactgcaacctctgcctcccgggttcaagcaattctcctgcctcagcctcctgagtagctgggattacaggcgtctgccaccactcccagctaatttttgtatttttagtagagatggggtttcaccatgttagccaggatggtcttgatctcctgacctcctgacctcgtgatccgcctgcctcggtctcccaaggctattcatttttaaaagggaatactcaaaattagtcttccacagtgactcagtgactgctcatttcaaagcaaaaatcctttgaggtactttatgaataatatatatgttgcctaaattatataaagaattttagcagtgaaagttattaagatgatgattaaatatgaaaattggtatagtagctcttataaacttataatctgataacttaaaaatattgaaaaaggaaatgtttgcttaattcatagtgaacttcttttagaaagaaatgccattgtacttttattatcatagcaattttgatttgttttcaaaacatgatcccacattgtagtaaacctgtaagatattgacactgtactatatatatttattcgtaactataagattaccatatttatgtatattctgtattttttatttcacttttcaaaggcttgtctattgactattgaaaatacgtgttttcaatgagacaccatctcacaccagttagaatgacaatcattaaaaaggaaacgacagatgctggaggggatgtggagaaataggaaggcttttacactgttggtgtgtgtgtagatgagttcaaccgttgtggaagacagtgtggcaattcctcaaggatctagaaccagaaataccatttgacccagcaatgcccattactgggtgtatacccaaaggattataaatcattctactataaagacacatgcacacgtatgttgattgtagcactattcacaatagcaaagacttcgaaccaacccaaatgtccatcaatgatagactggataaagaaaatgtggcacatatacaccatagaatactctgcatccataaaaaaggataagttcatgtcctttgcagggacatggatgaagctggaaactatcattctcagcaaactaacacaggaacagaaaaccaaacaccacatgttcttactcaaaagtgggactcgaacagtgagaacacatggacacagggaggggaatatcacacaccgtggcttgtcgggggtggggagctaggagagggatagcattaggagaaatacctaatgtggataacgggttgatgggtgcagcagaccaccatgacacgtgtatacctgtgtaacaaacctgcacgttctacacatgtatcccagaacttaaagtataataaaatgaaaatatgtattttgtaagttgtgctgatagtaacttttttaaattgtatttctccatttaaatctgaaatggcaccatgtcttgatttcatgagtgatagaggaaagaagattacagtttagattgtgtgtatagtaaaataccattctactacatcattatttggctctctaaaagatgcctagagatgtttaacaatgggtaaaattatcttattttagttttttataagaatcaaagatggaacttttcagaaataaactctgattgtatgaggcatttttgactttccttatagtttttattttcaattataaaagcaaggcttgcaatttataaaatgttaaacaaaaagtatgtaatatgaaaacataagtctgccctcatccttgcatcgcttacagttgacactaacaattgagagtatattcctccagattttgttttgtttcatatatttaataaaagagacctgtatatcttcctcattatttttaagttccgtgaatatagctgtatcacaatttatgattatcttaatgatgaatgattcatttatgtctaattacatggaatatgtaatttcaaaaatatgctgtttgtataatggtttgtgataggtgatgctacttaacatcacttaatattttgatgcagagaaatatattcagatcttagagataatctgacagcattccaaaaatacctgattgagagtaacaaacaaatgatgcctttgaaagtctgggaactacaaggtatagtattttgagatactttaacacagcattttggtaactgatctgttttgttaaataagcttttatatatcacatgatatagattattttatggacagtattaatgactagtgaataatataaattatgattttttgtggcaatacctatttaacagatcatccctcaagcaagctatatttttatatttgcaagacttaaaattatatgaagtgaggttattcaatgttatttcaaaagtatatactgatttataggttagtctcaagtattaaatcacatttgtggagactataactgattaaaagtcctaactcctaggtaaggagaaaatgaaacttaatcttggttttcttctttttgaaatttagatcctgttaagactattgcatgtttcattgataaatgtttaatggaaacatcaaatggaggacatgcagttttacaaagttaggaacagcttctgtactgaaaacctacaagcagatattttgtgaacaaaatttgatttggtttgaacttttaagtccttttcaatttataatttttcttctttatttgtaatgatttagtaggtcatggggacatgtcatctttctgcataatctaacttttgtcatcttttatcaacttttaaaaatataacagcttaataagctcttttgttaaataagcttttatatctcagatgatatagattattttatagacattagtgatgtaaataatgacattactataataatactattcatactaatacgttcacatactattcaatttgcccttttaaattctaccattcaatagtttttagcatatttttagaatgctgccactcttaacacagttgattttagaaaattctcatcatccccccaaaaaactaacaccctcattagcagtcactcctcatttcccaactccccagttgtaggcaaccaccaatctactttctgtttttaaaataacaactaaaaggatatttacaggccactctcactagtataacttacttataacatacaaataatattttatatttcatctggattatagtttacagagtcctttcatataaactatcttatttaagtgccagttaccacacagctaataagtgaagattttggtccaagtaaaattctttatactgtaccatatggtatctaggtaaactttatatacacttaacagaatattgaatgttacattttaaaattatagcagaatgtgcaagacacaatctattaagttttataacttctgctattctttacctacctaatacaaatgttgtatcaactaagccctgtatcattagaaaatcaatatatcaatagaaaaatcattcagcagaatgagattcaaggccattgttatgatagatttactgtaaagaatctacctctttgaactgatagaatctattctccctggacccttctggtgtacagtttcctatttaatgtctcatctagacctcatgcttagacctccttttattataccacagcccttgtgactgttctttcacttgacatcatgataacactaaactgaggtagtagtttcaaattcattctcaataaggttactgagataatctttctaaaatgaaaatctgattttggccttgtgtcaaatcagccaggctttatcacttgtacatccctgatcaaatagtggccttacattagtccccacaggaaaatgttggcacacacaaactaaaaagtttaataaagggactttttacagagacaggcatgattgagggaaaccaacaaggaatggattattcgattccagtatttgcaactagatggaaacattttctacccctaatcttgagggagcaagaggagagagtggttaccaaaacctggagagtgtgtcgagagagctgcttgacacagcagtagtaccccgagggactgtcctctgtgtatcaaggaagggatctgggtagtaactattccactccttactcttttcttgcttactgatcccatattagttacttggattggctgaatctaactagaaatctgagggcaagggagcttattgatgcagttcagataggccagccttttgggggcccggagcaggaaagagtggatgcggggggcaaacaaagtatgcagtcctcttctctgagaaagttctgtttttccaaggtaaatacttctggagagacttcgaatgtaagaaggggttgataggactagctagccaagtcatttgcatcattaaggactgatttcatgcacatccattaaaagtattaagtttaaaccccttagcatggtttgtgaagctcttgtctaagttctaatagagcttatattcctaaatccataatttcagatagtctctttctagtatcttcaattatttttagatccttttttatgtctctattttagcactttttaaaaagtataattatgttttaagcctccttcaaaatgttctctaaggggcctttgcataatttagaaaagtataagtgatggggtgtttttgaaggcctttaagcaaagagtatgcatagtcagcttagttctagttgactccctaatgtctgtgtaagatgtatttcaatggactaaaagcaagaaatctaggtagacattactgaaatagtgatagaaggcatataaatatttagaaggtgaaaaggagtcaaagataattctaggatttctagcttgagcctgagtagagagaatatataaaacatgtaagcagactttggggctgaatatgggactcagaaataatgagactagtgttgaaaggttgatttaaagtcattgtaagatatccagatggttaggttcagtggtggggtgagtatcctgtccttaagctaaaggagaaacaatctgcctcactgttgaggtaggtaatgaaagaatttagttttaaatcttttctgactcttgacaaagtaataatactaagatgaattcttctgacatgtttgaaactaaccacagttagcaacacacatttttctttttataggattgtcatatcagataaaataatactaagtttaggattttatttcagcacaaaggtaaaacaatgttgaaagagaaattgaatgtttctatttactgagttaaacacagtggagctttcttagaggtcttttcagaattggctctttaaagctctttttactcctcttcattattcttttgactttttgtcatatgtttcatttaagtatagaaaaagctttgcgagagcatttcttttcatatatctctctcgaaattatactgtaatttgtgaaaacaagaggtattaaatagtcattcataaaagtataaagcttatatttggaaataagtgataactttacatttaaaactttttaaaaatgcagatgtaacagtattaacatgtttgtatactaatacttggcaagaagaattgagtcaagtatttcaatttcatggaaatgtctataaaggtctaatattatgctagattccttaataatatttttccttccagatcttagttttcaagcagcttctcaaataatgtccgctccagtttatgatgccattaaattaatgaaagacatttcacagaacttccccataaaagccaggtatgttaaagtttataggtttcattgcagctataactctttctattaaatgagttttatgaaaatagctgatttcatttaacatgaaggtgtcaattagttctagtatatatagcttttgtgaaatcagggccttttcaatatatatatattttttgattagagcaaaatattggcttgtgcatacatgtgtgtatgcactgtaaggtagaactcttgttagaggcaaataggaaaaaaagtcctaaaaaattttctaaaatcatgcatagtaatctaaggaaaaacttgtttaagcaataaataatgaaggagtgttttttctttcccttatggaggatgataaaaagtattactctaagtaggaggtctatgcccaaagtactgccaaatcatattcttaccctttcagagtccaaatgattggtaatgtcttaattggatgaatattgtgtggagtacttttttgccaagaggatgtctcgttgaactgcttccatgaatactgatgttacattaaacatatattccatttcaataggaaatacatttgcatagcttaaagagaccggtgcatgcaatgcaagttaccacgtattatgagaatttgctatataacacaactttgatgcaattgtattctggttagggatgacagagtataaaattagcaacaagtaaaatatgagttagcttatactaaagagataaaatatgtgacaagtcgcagtgcatgggcaacaatggtgttttactgagaggaattggagagcagtctactagcttagcataccttcctaagcatagaatgattgctatgcctcttattgtcccaaacactattttgtacatttattcatcatacagattacagaatcttcaatatatgtattctttaattttgaaagtaaataaatagtacatggttggctacaagataccaaggattttttggtggtaccttgaaataaaggagtttgtttccttatttacagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttattaaatttttaattgtaatttctcacaatgctgccaaactttaggaaataatatatacttattgtgggctgtttcaaggtacacctttctacttgagttttccttaaagcagaactttgcattaacaatcttttaattttttaattctatttataaaatttgtaaaagctagtcatgtttaggaattatcaagttgaatacagtccataggaactgtattttgaacacttctgctgtctttaaattataagtgaattataaactcttcaagagtgaataggctgggtgcaatggctcgcacctataatttcagcactttgggaggtggcagtaggagggtcacttgaggccaggagttttagaccaacccgggcaacacaggaagactccatctctagaagaaaattgaaaaattagctggatgtggtggtgtgtacctgtagtcctatctaattgagaggctgaggcaggagaatcacttgagcccaggaacccgagactacagtgagttgtgatcatgccactgcagtcctgctgggtagaagagtgagactctgtctctaaaaaaatgtttttaataaacaaattgaaaaaattgaaagagtgagtgatgtaaagccatgatttcagttttttagaacatttctactctggtaggttcccaggttaactaaaaaattcttcatgtacgtatattcatgtacttatacattggtaatttcatacaaaatttctctattgggcaaaataacgcaaaacagctttttcaatgaagtgttttcaaaaaataagtcatagtaaatgatgacaatccatactgcatacagctagtacacatgaaattttgagaacctccattccacttgaaccaaatacttttgtcaaatgaaagctaaattaggccatatggaaatgtatacttttcagtcacaaaggatttggagtttttagcttcttatccaaagtattagattacattgggttatatagatcagttctaaacatttaaggaaggatcaattatattagtattcatttttccagatctctaaccagaattgctgtaaatcaacatatgagagaagaaataaaggaaaatcaaaaggtttgtttgaattccttttttaaaacatttacccaactaatatcactgtttctgactttggatcttcaatattcatacaaaaaaggaaatagtaatttgtgcttttttgattattaaaacagtctgggttcttctatttttatactgtggactatatgagcatttaatcagccaatcttttctgacataccttctacttatttcacagtatattccagaatttcttccgaggtagtatggttttcttcataggataaagaataaaggctgtgagttaattattctgtttcttgtaattagttttgcttaaaagcttgtgaagactgagtcagtgttagaccactggaacggtagaatcctatagcagatagaatacaatttatcagtggtttgataagattctgccaaatggtatcttaaattatccatagaccccaaataattctagttgtgttaatatttgtaaagtgcttacaccactgcctggctttattacataggaccggtttggctttaagtagtatcataccagactcacagggccctaaacactaggagttcatttttctcacttcttacctgtatttaaagccaaaagaggcagggtggatggtaccaaccacatttatcctcactaaagccttcttggaacattttagcagactggtttctatctcattggtgaggattttgccatgtggccaccttaggctgcgcgggaagctagaaaagctagtgtttacttttctaataacgaagcaaaggagaagtggcctgggtatggtgctaacttagccagccagcagtgcccatcatactgagacagagtgagctgtcaacaaatgtcagctgttttgatgacaactacaatgatggtaatgaagaaaaagatgcatagttcattggagaacaggtgttaggaaccacaacacatcattcctacctgggacattctttgcctcattgaccaccttacaaattcctgtgtatccttcaaaacggatttgtggtattggtccattctatgatgttcctaattgttcttaccattcttcatgcagaatggattgttttcttatgacacacaaaggagtgggtttgggagtggaggcttaatacgcaaaagaaagagaaaggagaacagctctctctctcttatgagagagaggggcacctgaatgggaattcgggctgcctacagagtgcactggattttacaaataggcttgaggaggcggtgtctgatttacatagggcccacaaattggttggagcaggtatgatgttttacataatgcatggggaaggctgaccactccaccctattatgcatatgggctttccacttggctgctgccatgttatctgcttcttactgtacatgtggactggaaagaagggaagatggagctgccgttttgaacatgcctggtcccaggtaacctgttcctactggcacaatgccagcatttacctatgcaagcttctagcttgcttgcctgtgtctgcagctcgattttacaggctgttctttgttagaaaataaaatgatttgggggcggcttttcattaaaaggaaaaccttaccgaggactcactatctgcctaaataatttcttcctaactgctatatcagaaccatgctggcaacctgagtatgccagcttactcagggccactatggccatcaccttatctacctgtcagccatttggaattggcagtgaaagagttttgaaatgagctttgactgcagagcaagaaatcttgaatttagtaaactaaataatcatgacactgcagatagtcttcttgatcacctactacttccagagaacactgaaaagagaaagacaaggatgataatgtctttcatgtaactaatctaggctaaatgggtatttggactagcagtccatgttacccactagctcatgagatgtgggagaagtaattaaagaaactgaagttccaaccttggggaagagggtggttgtgatgagaaggtaagaaaatcttggactattcattgcaattgcattgcacacggattggacacgagaaagccctggaaatgtgtttctgttacagcatctcatccatacaaaccgaaaagtacatttcctgcaaaacatgtaaacaaaatgttcaccgaaaaaagaagtaataatggtctttttttcttcttcttctcatgctgcagtttatttacaccaggtcaattgctctggtgtaaattacactttttaaggatttacttaagaaatttgaaggattttcctctgggtctgggactaaactaaaacaaaagtgtcttaagcataatttttctcacttgggggtactgcagagctcctggctttacttaaggagataaagaggatatgaccttcgagtagaggagataagaaacatttagtttaaaataaatacataaataaaagaaacatcctgcccacaaatataaaaggaaacaggaagaatctttgagatggagtcttgctctgtcacccaggctggagtgcagtggcatgatcttggctcactgcagcctctgcctcccgggttccagcaattctcctgcctcagcctccttgggtagctgggattacaggtacacgccaccacacccggctaatttttgtatttttagtagagacagggtttcgccatgttggccaggctggtcacgaactcctgacctcaggtaatctgccccgccttggcctcccaagaatcttgattccaaagcgacatccagctctgaagagcacacactgtggatgctgggctgctccatcttcccactagagggcgcaaaggctttagttaaaaaccaagccaaacccaaaccatctactttgatcagttgtttgttttaatttcagtaggttttttgggaacagatggtgtttagttacatcaataagttatttagtggtgatttctgagattttggtgcacccatcacctgaacagtgtacctggtacccaatgtgtagtctttgatctcttgccaccccccgccctttcccccgagtccccaaagtccaatgtatcattcttatgtctttgcatcctcaaagcttagctcccacatatgagtgagaacatatgatgtttggttttccattcctgagttacttcagttagaatgatagtcttcgattccatccaggttgcacaaatgccatttcattcctttttatggctgagtagtattccgtggtatgtatagggtatttgggctgattccatatttttgcaattgcatattgttctgctataaacatgcatatgcaagtatctttttcatataatgacttcccccccacccctctgggcagttacctagtagtgggattgctagatcaaatggtagatctgcttttacgaatctccacattgttttccatagtgattgtactagtttacattcccaccaacattgtaaaagtgttcccttttcaccacatccgtgccaacatctgttactttttggttttttaaattatacccattcttgtaggagtgaggtggtattgcattgtggttttgatttgcatttctctgatacttagtgatgttgagcatttttccatatgcttgttgcccacttgtatatcttcttttgagaattgtctaattcatgttcttagcccactttttgatgggatttttttttcttgctgatttgagttctgtgtagattctggatattagtcctttttcggatgtgtagattgtgaagattttctcccactctgggctgtctgctaactctgctgtcctttttaatttaaggtctttaaatacataataacaatctttccttactcataataagaagaatacagatcagaattaaactgagaaagaaagatttcaaaaagttggcagggcattctgtaagcaagtctgtatttttttttttttttttttttttgcgtaagagaccaggggaaatgagaatatatatttacctattctagtttttgcatgaagaaatactagaggatggagaagaaactttgggagaaaattttgcctataagagccagggatgaaacgggtgaagggtgccaggattggcataattcttctagtgtagctttttatatagtttttgacttgggactcaagcaaagattattcaaaaactatgactatgctcaagttgtataactgaatttgagtttggttttatttaggagacaactgctttaactccaaagtacagcaaatttcctttggaagttcataattgttgttaatttgctgtgagtggccagaatctgcttttggtgattttaaattgtcaacccaacatacgtctttgttgtttattgcaagaattgttatagtccatgacattttttatttgcttcaaaataaaatgaggatatgatcaggtggtcaggtaactttttatgattcagcagagtggaacaaataatttcaattacataattgcttaatgaaccaaatgcagatacttgaattaactaaaatgcagatattcaaataaaggattgcaccttacccaaataaaagttgatgttgcttctaattatttctaactactttgtgtgagaattatacagagttctggagacattacctatattagaacatcatctctcaaaactacatctgtaaatcatactttttaagtcttatcttgtcttattccttattctgaaaatgacaacatttctattaagatttatatctgatttgacttcaaattttaatcgtaaagaatgaaactagacccccatctctcaccatatacgaaaatcaaatcaataggggttaaagacttaaatgtgagacctgaaactgtgaaactgctagaagaaaacattggggaaatgctttaggacattggtctatgcaaagatttcttgagtaagaactgaaaagcacaggcaaccaaagcaatttggacaaatgggatcatatcaagataaaaatgttctgtacagagaaggaagcagtcaacaaagtgaagagaaaatctacagaatgggacagagtattttcagattattcaacagtcaagggattgataaccagaatatataaggagctcaaacaacagcaaaacaatgaataatctaattttaaaataggcaaaaaatttgaataggcatttctcaaaagaaggcatacagatggccaacagtgatgctcaccatcactaatcgtcagggaaatgcaaatcaaaaccacaatgagatagtgtctcacgtgttaaaatgacttttttcttttttgtaagtttgctctttttttaattttaattttactttaagttctgggatacatatgcagaacatgcgggtttgttacgtaggtacacttgtgccatggtggtttgctgcccctatcaacccattatctaggttttgagccctgcatacttaaggtatttgtcctaatgctctctctccccttgccccctaccccctggcaggccacatgtgtccatgtgttctcattgttcatctcccacttatgagtgagaacatgcagtgtttcactttctgttcctatgttagtttgctgagaatgatggcttctagcttcatccatgtccctgcaaaggacatgaactcattcttttctatgactgcatagtattccatggtgtacatgtgccacattttctttatccagtctatcattgatgagcatttgggttggttccaagtctttgctgttgtaaataatgctgcaataaacatacgtgtgcatttgtctttatggtagaatgatttataatcctttgggtatatacccactaatgggactgctgggtcaaatggtatttctggttctagattcttgaggaatcgacactgtcttctacaatggtttaactaatttaaattcccatcaatagtgtaaaagcattcctgtttctccacatcctctccagcatctgttgtttcctgactttttaatgatcaccattctaactggcatgagatggtatctcattgtggttttgatttgcatttctctagtgataatgaactttttttcttatgtttgttggctgcatagatgtcctcttttgagaagtgtctgttcatatccttcgcccactttctgatggagttgtttgttttttcttgtaaatttgtttaagttccttgtagattctggatattagacctttgtcagatgggtagattgcaaagactttctcccattctgtaggttgcctgttcactctgatgatagtttcttttgctgtgcagaagctctgtagtttgattagatcccattagtcaattttggcttttgttggaattgctttttggtattttagtcatgaagtctttgcccatgcctgtgtcctgaatgatattgcctaggttttcttctaggatttttatggttttaggttttacatgtaagtctttaatctatcttgagttagtttttgtataaggtgtaaggaaggggtccagtttctgttttctgcatatggctagccagttttcctagcaccatttattaaatagggaatcctttcctcattgcttgtttttgtcaggtttgtcgaagatcagatggttgtagatgtgtggtgttgtttctgagacctctgttttcttcctttgatctatgtatctgttttggtaccagtaccatgcggttttagttactgtagccttgtagtatagtttgaagtcagcgtgatgcctccagctatgttgtttttgctttggattgtcttggctatacgggctcttttctggttccatatgaaatttaaagtagttttttctaattctgtgaagaaagttgatggtagcttgatgggaatagcattgaatccataaattactttggacagtatggaaaatggcttttttctaaaacaaaaaaaataacagattctgggaaggatacagagaaaggggaacccttgtgcactgttggtgggaatgtacattagtaaagccacaatggaaaacagtagtatagaggttcacaaaaaaaatgaaaaatagaattaccatatgatccaggaatcccactgctggatatatacccaaaagtaaggaaattagtatatcaaagagatatctgcactgccatgtttattaaaacactattcacaatagctaaaatatggattcaagctaggtgtccattaatggatgggtggataaaggaaatttggtacatagacacaatggaatattatttagtcataaaaaagaaatcctgtcatctttagcaacaatagaggacattatgttaagtgaaataagccatacacagaaagacatactacaagttattactcatatgtgagagctaaaaacactgatctcatggaggtagagagtagaacgatggttattggaggctggggaaaatgaggaggggttggttaatgggtgcaaaaatacagtcaggaataagatctattcattagcataatagggtgattatgcttaacattaatttattgtatactttaactggaagagtggatttggaatgtcccctacattaagaaatggtaaatatttgagatgatggatatcccaattaccctgctttgatcattacacattatatgcttctatcaaaatatcacaagatctccataaatgtgtacaactattatgtacccgtgaaaattaaaaataaaatttttaagaaaaatttaaatttcagagtgtgtatcatttcaccttaggaacacccaaacatgtttataaaccattttaacattgtaaatctcaaccagtcttctgagatccaatcaattggaatttctttagcttcaggtaatagctcagctccattggttattaaagagacatattagaataaatgggttccctcttctttaaggaaaaatgagcttatatttcttcattaggatttgcatttatttctgctcaagcctaagagggctgctagtttaattgcactttaaatacaaaaatctaagttttttggactataaatatagtatgaaatccagctccaaacccatatgaaaataagctagaggccatgaattcatttgggagacttactcttcctccaccaagaaccaaggtgaggtagacaaatttctatgctgttactgcagagcattttgttttctaattcaccttttcaccataagtgtagcactttatgtgtgcataaggatatctggatgtgggtcctggatttaaatttcttgttcttctgagattggcccttaaaaacccaaatcctaggtcatctaggaagctctaaatttcctccaggcaaggtctttagtgtttatttacatctctatattcatattcctacttcctctctgtccttaggtgaatactttcttcaactcagagccgcatttaggggacatttttcatatttatttttttgagacagagtatcgctctatcatccaggatggagtgcagtggtgcgatctcagctcactgcaacctccacctcctgggatgaagcgattctcttgcctcagcctcccgagtactgggactacaggcatgcaccaccacacccagctaatttttctatttttgatagaaacagggtttcaccatgttggacaggctggtctcatactcctgacctcaagtgatccaccagcctcagcctcccaaagtgctgggataacaggtgtgagccaccgcacccagtctcattattaatatttaaatctagcattttgatacttttagtaagaaaatgtttggatctttggttcatcatgttgctagaaattgaattcttactcctcatttaagaaaggccaccttaaattacatactcaaatatacactagtttttcaggacttaaggctaactctctggggcagaggaaagagaagaatttgtaattacttatctctgataggcaaacctcttctctctgacagtgtttgagcaagcagacttgctgagttcagtctgttacctgttttctgagcattattgttcaaggccctgggcctgacataaacagtcttgagggatttagcaatttaatatggatctgcatgcttggtgtactttgtacttacaattgagctccactaaaacgaatgtatgaggtgctggagaaagcttcaatcagggtgtgtgaagtttcgatgccagattgggggaaaacagcaggaaatataaattcactaggcatctgtagattttgaagttggaatatggatttcttaattaactttgataggcacatctaaagtagctaaagacaaataaaaattttacctctgaaccttttcatatcagggtttaatcttttgccagtattctgtataaaacaagtagaaatactttaagttcttctccctcctctgtgtgtagctcatctgttgagtgataatcgtacagaaaaattcaccattgtcaagctttctctgaatctcttcaagttagttgcttcctctgcctttacagagtagttcacacaagtccctattatgtgacttatcatatgatgttgaaatacactggttgtttttcctcctaaatatatttgcctaccctgataataacagctttcatttgtgagcactttataggtgacaagacatagatgtatattacatttaaactatagcaaacatgtgagatagatataattattcccattttatagatgaggaaactgaggattatgaaagtgatttgaacttgcccaaatcttaacagctaataagtagaaagatcaggattaaaccaagcatgatcttcacactgtgatcttgacaaccgtactggatacttacactgtgatcttgactactttgctttagtgacaagaacatccccctttttacttttgttaactgttctagcgcctggagatgtttctagaacatagcaggcactcaggaaatgtttactgaatgaaagacagtgaaaaatcaaatatagctttaatggaaacttttatgaatttagagtgagctccaaatatttacacataaatcaaagttttacttttggcatatcattgcctcaagaaataggaatgtgccaactagcaaattgtatatgtacacatacacacactatatgaaatgtagataagtaattattgtaacattagaactgtaatatcatgtattgtaaaatcagaatattcaggtattgaattttatctctaatctatcttaagattccccccatcactgagatcagggctgggcaaactgctacctttaggccaaatatggtctgccacctatttttataaataaaagcttaatttttatttttatttattatttattattttatttatttttttgagatggagtttcgttcttgttgcccaggctggagtgcaatggtgcaatcttggctcactgcaacctccgcctcctggattcaagtgattctcctgcctcagcctcccaagtagctgggattacgggcatgtgccaccacgcccagctaattttttgtgtttagtagagatggggtttcaccatgttggtcagggtggtcttgaactcctgacctcaggtgatccacccacctcggcctcccaaagttctggcattacaggcgtaagccgccacgcctggcctaaaagcttaatttttacaataaacattgcaatgtccatttgtttacatagtatctaaagatacaaaggcagagatcaataattgcaacagagactgtatggcctgccaaacctaaaatatttactctctgactctttatagaaataatatggtgacccctaatataggtcactattgttctatcactggttaactattgctttgctctacttcaaggatcttcaagttagatttaaaattcagccaggcgatgctcgtctatttataaatggccttcgtgttgatatggatgtttatgacgcttttaggtaagtattaaattattgctgtaaatgaactatggtttatataaaaataaacattgtcttgaatttagtgtaagtcaaaatatgaagatcactttaaagataaatacatgtttttgattgtacaaaacagctttcttctaccaaaatgggcaagcccaaagtgtcttagaatatcagaactgggagaaacagtcaagatatttgtttggatgagggttagacctataattactttgttattctaaactgtcttttattgaagagtagattgatgatttgcagagaagttatttggaactggactgaacaaccagataccagataaggactgaagtcaacatggggtatttccccagaagacagaaattgacaagaggaatttaaaatgcttgtatttgaatgctggatgctatctggtttcttgtcaaaaaaaaaaaaaaaattcttcaaaatttttttgctcagaattttgaacaggacagaattaggaagtccttgctttatcaatggtcactcacccaaaattacagttgtgggccaaacagaagagttacttttatagagaaacataaaactacattaaaattaatatttgaaacattagatgaacttaggatacatgatactttaattcagatgttcagttttaattcaattgaatatacttttgttgaagtgaaattatttgaattgtttatttaaattcttaccagtttggaaatacgttggaaaatatattggaaagactgagaagtagttttactgaacattttttacagttttatctcaaatggggcttttctctttagttacttgaattcttggacctagtattgtaaaaataataagatagatacatataatacacatagaaagagtagagaagtttgtaaatgctagcctgtaaatttcaggggaacaaaaattatatatgtgcccagcagcagtgaaaacaggtttaaaggaagtagtgaaatggtatgtagattttagaaagttttctaaggtagtgtatgaggaaatttttatggcaggaatattttcacgtataatttaggaaggctgtaggttattaaaaaaataaaaccccccagctcctacacctggtcattagtgatttgcaggatgtgtgctacattgttattcctcattgatttgatcactgcttagtgctaccatgattctcttaaaagaggaagagacaaaatgtgagaatatttgtgtcttcagaggatgtggaataaaattaatgcaaagaggaagatgaatggaagaaaataaggaaatggaagtaaaatgtcatattacagagacattatatatagagaggttttatgcagccaatactttggaatcgtccatgtggggaaagaacaggagtaaaggatttattttgtgctcccttcctatctcctttcagtcattgcattactgggttgtggagaaccaataacatgccccatacatggcccagcccttcttgctctgatcctgagagtagcgggaggagccagagcctccatgggttaggattagatcagcattggttctataaaggcctacatctcacccccagggagactgagacagtaagaacatgtgactttgactggggagaaaggcaagtaggactgatgaagtccataagcagggtcttatatatctacattaaaacattctgttctagcccattaaagagtcccttttatatttttgcctctgaatagtcgcctcagccacagacttgatgaagagtagtttaaacatttagattccccaatttgttgtcaatggggttattgttgatgttgttgtttacagtaatactttctattatgtttaagaactttcaaattatatgtaataaaaaatttaaatttgtattcaaacacacgtgaacttcatgatttaatggagcttcctctgtattagaattttatactttatgtcttgttcgatcttacattatttttgtagtaggtttgtcaaaagagtgacctaatattttttttctcatttttggctttctcagggctgatcatatcctcactactttgataaagaatacaatagtctttgttgttttatcttttatataataataagtttttactaccactaaaattatgtaagtttactctggataactaattagaactgtttgccttatttcttaatgagtttaatatatttttcctgctattaatgaagataccaaaaaatctcatttctaatgctttaagactatcaaactttaaaacatttgtttttaatttggaaaatcaaaataaaactgttttttctttgaatatatagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatggtaagtgcttatgctattccttgttctaaaacctgtagtatacttaaggcttaacataaaatgaagtatcggcaggcctgatgataaatgtcagcattttggaacagttctcagtgaaaagagaaagtcaaactatagacccatctcctctcccacttgcagcttccttctccttcttcatagtctctgttttgtcacaagaatacctactcaatctcattcagtgtcttttccaccttcagagataacaacagaataaccacatgaacaataacaacaagacaccaaatacatggttaaaatctgaggtgtatataaaagtgctaccttaacatgatgaaagtcctgccgaaacaatttgcagcggcctccaaaggttctggtgtgtgtattacagcccaagtgatttttgtgaaaaacatttgatcatatcaccctttcttgcttaagcagagaagtggtcttcagtatggcctatgaggctgcagatggctgctgtcacctttcatttcttagactgtgaaacgttcttttcactactatcctttgtctcatgcttagaaagcactttttttttctctatccagttaactcctattcctttttcaaagttaggttgaaatagccctttctgagagaaactttccttaacaatccagatggttttttaaatctacatgttgtgttaagagaatccccagagaccaacctctaatccagtgatttgctagaaggacttgcaagacccagaagttgttatattcatggttatggcttagtagagcaaaatgatgtgaaaaaatcagcaggggtgaagtccagagtaaaccaggtataagcttccaagagttccctcctagtggagttgtgtgcttaatgtgatatatgacaatgtgggcaaagtgcttcctaccagggaagctcacttacttgagcctgagttcaagattgtgagagacgatccatcatgtagacatacagtggctctctgtacctgccatcagtggctgaatctccggactgaggaaaagcagatgtttattataactcagattgtataaactctttagacaaactgctggaactgctgcagcatggctcagggtcctaactgtgcaaaacactcttttatcaatcagaacattccaagagcttaattatcaggacccagtcaagagacagtcatgtaaacagacccttcttgggaatatccaaggtgtgagcaacccaagcctcttgagttaaccctttcatacacacacacgtatatgtgtataatgtgattcttcatacatgtatacatgtatgggtatagcacatgtattaggccatgcttaccttgctataaagaaatacctgagactgggtaattcataaaaaaaagaagtttacttgacttacagttctgcagggtttataggaagcatggtgccaacatctgtttggcttctgggagctttaattcgcagcagagggcagagagggagcaggtatctcatatggcaagaacaggagtgagagagagtgttggagggtaggtgccatacatttaagcagcctggtcttgctagaagtcacatcacaaagacaacaccaagacatgagggatctgcccccatgacccaacacgtcctatcaggccctacctccggcattggggattacaattcagcgtaagatttgggtggggacaagtatccaaattatatcagcacatatacatacattatatgtcagaactattaatccattcgtatacttagcacagttatagttttacatttatcctgtgatgcttttatatctgttttttattaggctatatataaagttcttgaaggtagaaattttttcattttttctcttaccattatgtccctggttttagtggtactcaataaatataaatattccctaaatgaataagtaactatttatctgaaaacaacaaaaaacatcatttttaatgatgaaactctggaagcattacaattacaacatgatcaatataattatccttaagatttaatattattataaaaggagtaactgttagaaatgaggaaataaaagtgttgtgtgacaagattgtataactgaaactcctcaaagaaagctataataaaaggctttaataaaatgggtttgaagtgacatgataaagatcaaaagcttttctttcaagatctatttggaagataatgatttatttacaataacataaaaatgtaaataccctaataataaccactatgaaataatatctcaatacctattgataaaaactagaatttaactgaggacgtgtaaatcagcatatccttttaaaaagttatgcctggccaggcacagtgtctcatgcctgtaatcccagcagtttgggaggccaaggtgggcggatcatgaggtcaggagattgagaccatcctggccagcatggtgaaaccccgtctctactaaatgtacaaaaattagctgggtgtggtggcacgtgtctgtagtcccagctacttgggaggctgaggcaggaaaatcgcttgaacctgagaggtggaggttgcagtgagccaggatcgccctactgcactccagcctgggcgatagagcgagactccatctcaaaaaaaaaaaaaacaaaaaagttgggggtgcgcgtgggggctgggcgtggtggctcacgcctgtaatcccagcactttgaggagcacgtggtgggcaaatcacaaggtcaggagatcaagaccatcctggccaaaatggtgaaaccctgtctctactaaaaatacaaaaattagctgggtgtggtggtacgtgcctgtagtcccagctacttgggaggctgaggcaggagaatacgttggaccttggaggcagaggttgcagtaagctgaaatggtgccactgcactcaagcctggcaacagagcaagactccatctcaaaaaaaaaaaaaaaggttatgcctgtggtgcccttataacgatacatagtttgtctagtaatttctctcctggaaactatcataaaaaaacagtgggaaatggaaaaaaagctttgtggccaaagatatgattatcactacatattttgaaaacaaagtagaaactagttatctaacagagaagcgttataaattttacattcacacaatcgagtattattgacatgaaaattatgtttataaatatgacttaagataatgattctgttaagtaaaaaatatagaattatgtcatgtaaaaatatgggcagaagatcagaaggaaatatatcaaaatttaaggcattaatgggtgatgtggtttaatgggtagttttaatttttttcatcatgttcttctgtgaattccaaacttttaaccatgggtatgtattatttacatgatcataagaaaatagttttttggttttttaaattgatacacaatattttacatatttatgagattcatgtgatattttcttatgtatgtaaggtgtgtaatgatgaaatcagtgtatttggggtatccgtcactagcagtatttatcatttctatgtgttgggaacattttaagtctttttttctagctactttgaattatgtaatatattgctgctaactatagtcaccctactttgctattgaatagtagaatttataccttctatctaactgtatagataactgtttgtacctattgactaacctctcttcatcaacccctcccaccagcatgcccttcccagcctctggtatctatcattctactctaactccatgaggtcaatatttttatttcccacttacgagtgagaacacaggatattggtctttctgtatctggcttatttcacttaacacagtgacctccagtttcctccatgttgctgcaaatgacatttcattcttttctgtggccaaataatactccattgtgaatatataccacatattctttatccattcatctgttgatagacacttaacgttgattatatatgtttgctatcgtgaatagtgctataataaacaggcaagtgcaggtatctctttgagatgttggtttcttttcctttcaaaaaatacctcataatgggattgctggattggatggtagttcagtttttagatttttgaggaatctccatagtgttttccattgtggttatactagtttacattcccagcaactatctataagagttccttttttccacatcctcaccaacacctgctattcttttatctttttaatgatagccattctaactggggtaaaatgatattccgtgtcacttttatttacatttatctaataattagtgatgttgaacattatatacttgtttgccatctgtataatttctttatttttttcattattattatacttttaagttttagggtacatgtgcacaatgtgcaggttagttacatatgtatacatgtgccatgctggtgtgctgcacccattaactcgtcatttagcattaggtatatcacctaatgctattcctcccccctccccccaccccacaacagaccccagagtgtgatgttccccttcctgtgtccatgtgttctcattgttcaattcccacctatgagtgagaacatggcggtgtttggttttttgtccttgtgatagtttactgagaatgatgatttccaatttcatccatgtccctacaaaggacatgaactcatcattttttaaggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgtcacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagcatctgttcatgtccttcacccactttttgatggggtcgtttttttcttgtaaatttgtttgagttcattgtagattctggatattagccctttgtcagatgggtaggttgcgaaaattttctcccattttgtaggttgcctgttcacactgatggtagtttcttttgctgtgcagaagctctttagtttaattagatcccatttgtcaattttggcttttgttgccattgcttttggtgttttagacatgaagtccttgcccatgcctatgtcctgaatggtttcttatgagaaattcagatattttgctcttttaaaaataagattgtttattttattgttgagttgttcaacttccttgtatattcttaatattagcccctgtagcaatagtttgcaaatattttctcccatcgaacaggcttgctcttcactctgttgattttttttcctttgctgtgcagaaggtttttcccatttgtctatttttacttctgttgtctgtgtttttgaggtcttagccataaaatctttacctattagaccaatgtccaaaagtgtttgccttatgttttcttctagtagttttatactttggggtatgtttaagtctttaatccatcttgagttgatttctgtacatggtaagtgatggtggtctagcttcattattctgcatatcgatatcagattttcccagaaccatgtattcaagagggtgtcctttcccaaatgtatgttcttggcacctttatcaaaaatcaattggctataaatacatgaatttatttctggattctctgttctcttccattggtctgtgtgtctgtctttatatcaataccatgctgttttggttactgtaactatattttcaaatcaggtggtgtgatgcatccagttttggctttggatattcaggttcttgtttggttccatacgaattttaggattttttttctatctctgaaaaatgatgatatcttaatagagattgcattgaatctatagattgctttgggcagtatcatcattttaatatttatctgaaccatgagcatgggatgtttttccatttatttctgtctttttcaattttttcttgtacagatcttttacctccttggttaaattaattcctaagtattttttgcagctactgtaaatgggattacccttttgatttcttttttggctatttcattatttgtgtatagaaacactactgatttttgtgtgctgattttatatcctgcaactttattgaatttatcagttctaagaattttctggtggagtccttggtttttctagatatacaatcatgttgtgtgcaaagagggacagtttaacttcctcttttccaatttggatgcatttgtttttcttgcctgattgctctggttaggacttccagtaccacattgaataggagtggtgaaagtgggcatccttgtcttgttgcagttcttagaactcagcttttccacagtgcgtatgatgttagctgtgtgtttgtcatttctggcctttatattatgctaaggtatattcctttggtgtctagtttgtttagagtttttaatcatgaatgaatgttgaatttaatcagattctttttctgcatctattaagaggatatggtttttttttcttctattgatgtgatgtatcacatttattgatttgtgtatgttgaactatccttgcatctctggggtaaatcccacttgatcatggtgtattatatttttgatatgcttttggatttggcttactagtattttgttgagaatttgtgcatctgtgttcatcagtgatatggtttggctgtgtccccacccaaatttcatcttgaattcccacgtgttgtgggagggacccagtgggaggtaattgaatcatgggggcaggtctttccatgctgttctcatgatagtgaataagtcttatgagatctgatggctctataagggagagtttccctgagcaagctctctttttgcttgctgccatccatataagatgtgacttgttcctccatgcctcccaccgtgattgtgaggcctccccagtcatatggaactgtaagtcctttgaaccctttttcctgtttaaattacccggtctcgggtatgcctttatcagcagcatgaaaacagactaatacaatcaggaatattggcctgtggttttcctttattgttgtgtcctcgtctggttttggtatccgggtaatgctggtttcatagaatgtgagttaggaagaattctctcctcttcatttttttgggaataatttgaggagaatttgtgttcttttttgaaagtttggtagaattaggtagtaaagccatctagtcctggactcttctttgttgggagactttttattactgattgaatcttattactcattattggtttgttcaggttttctgtttcttcctaattcagtcttggtgtgttgtatatgtccaggaatttatccatttcctccaaggtttccagtttgttagtgtatagttttctataatagtctctgatgatcttttttgtttatatgatatcagtgtgcttcttcatttctgacttttttggaggtcttctctgtcatggttagtctatcaagtggtttatcttttcaaaaaacaaacttttcattttgttgatcctttgtattttttctttagtatcaatttcatttagttctgctctgatcttatttatttttttctgctaattttgggtttgttcttgcttttctatttccttgagatgcatcattaaattgtttatttgaatctttctcctttttgatataagagcttactgctacacacttctttattggcactgcttttgctatatcccacaggttttagtatgttgtgtttacatgttcatttgtttcaagacattttttatttcctccttcatttcttccttgacccagtaattcaggagcatgttgtttaatttccatgtgtttgtattgcttccaaagtttctcttgttattgatttgtagttttattccattgtggtgtgagaaaatacttgatatgatttcaatttctaaaaatttattgagacttgtttttgtgtcccaacatatggtgtatcctggagaatattccatctgctggtaagaagaatgtgtattttgtagctattggatgaaatattgggtaaatttctaaagtctatttcatcaaatgtacattttaaatccagtgttcttttcaattttccatctaggtattgctgagagtagggtgttgaaggttccagctattattgttttggagtctctctctctctttagctgtaataatgtttgctttatatgtgtaggtactccagtgtttgggtgcatatatgtttaggagtgttttaacttcttgaagaatttatccctttattattatataatgactatctttgtccttttaactgtttttgacctaaagttttatctgataaaagtatagctattcctgcttgcttttggtttccatttgcatggattatctttttccattcctttacttccagtttatatatctctttacaagtgagatgagtttctttaaggcagtgtatggatgggtcttgttttttaatccattcagccagtctgtatcttctaagtgtaaagtttaattcatttacattcaaggttattattgatatgtgaggacttatttctgtcattttattagttgatttctgtttattttgtgtgttctctgtttctctctctctctctttaacaattgtgtcttgttggttttctgtattggtaacatttgaatcttttctctgacttcagtggtttgttctaccagtggtatttatgtttcaggatggtagataccattctttcacttctgggtataggactcccttaagcatttcttgcagggctggtctagtggtgaagaattccctcagcttttgcttgtctgggaaagactttatttttccttcatttatgaaggataactttgctgggtatagtatcctcaactggcaggcattttcttacaggactttaaatatatcatgccattttctcctggcctgtaaagtttctgtggagaaatctgctgttaatctgatgggtgttcccactagatgcttttcacttgctgtttatagaaatctctctttctctttaaattttgacagtttgactataatttgccatgggcaaaaccttttggaattgtatctatttgggaatctctgtgcctcctgtatttggatatctaaatctcattagacttgggaagtctttatctgttatttcattaaataggttttctaatactttttttttaatcttctgggacagcaaaattcaaatatttggtcactttatggtgtctcatatgtcacataggctttgcttattcttttttgtatgtatttttatttgactgggatatttcaaaagtcttgtcttaaaattctgagattcttgattctacttgatttagtccactgctgaagcttttcaatacattttacatgtcattcaatgaattttctatttggttctggtaaatttctcacttatttcctgaattgtttttctgatatttttggattgttttaaagtattctcttatagctcactgagcttaatttcaatattttgaattgtttttctgggatttcataaatgtcttttagattgggatctgttgctggagaattattgtgttcctttggagattgcttatgttcctgtgtccttacgttgacatctgtgcatctggtgtaacagttacttattccattttttaaaaatttccattgttaggggaagactttttcctgaccatttatggtgttagttgcatagtacactttttggcattgattctcaatgtgtgcagtagggtaatctctgtatgatttcttcatctgtaaacagcatcagtggtgtctctgtttgctaggtggcttgtagcacagttgctagtggaggctgtgatgaagttttgctgaaatgtgggacaccagttgggccagacttagggccctatgggtggcgatggtgggttgagccttggcccccagggtggtgtacactagcaccagtgttagcaggtgcagggaggttgattcttgggcctctagatgacttgcttgggtgctgggaatgacagtggtaggtaggttcttgagcacctgagcagtggttgtggcacgggcaatggcagtaagtggcgggacaattctctaggacctaagggtccatgccagtgttggcagtagctgtgatgggctgggtcagccattgcccaggccctgaggtgatggtagtggcaggttgggtgggcatgacactgggaggtgtgctcagatgccaatggtaatggattgtgctgggtgatccccacgtccctggacagcatgcttaggtactgggggtgatagaaccaggcaagatggttcttaggccccatgttggtacattcaggctctggctatggttggtgggcagcaggggagcgggatgatccaccggccataggtggatgctcaggtagaggcagcagcagcagctgtgctgctgttctgctactggagagggtgaagtcactttcaacaggagcaattggaggcaggtggctggggcatgctttgctcatcctatgtccccccaccccaaaacacacacacacagtttgcagcaaatggaatttgtcctcaggtgcatggaaatgtgtgattgtccctctgctggggaggcagtgtgactgccagtggttctgccttggccctagcagggaatgtcagtgggaccccagagatatggagatgcgggggctgttaggccccagggcaggacacagtctgtgggagctgggctctcaaaatgatgccatactgcagtggcttaggactcaggggtttgtgggactgggcatgagctccctctctggatcagtggcattgtgcaatctccaggtagctccctctgttagtctcagaagcccataagggtgaaggggcttttccatggttaggttggtaggagtccgtagtggaaacgtggactgctgagggtctctcacttacactttccttgcattagggaacctctctaggcttccagccaatcccagcctagcagtctgccttatttccctctcctttcttgctttcgggtactcctgtcacttctctggtgaattccagtgtgctcccttagacgacctattcgaagtgtgattatctgcttactatattggttcctttccatggaagaggcaagtagcagatacatctattcagccatcttgaagccccttcttaaaaaaaaaaaaaaaaaagatcttaaggggaaaaatcctctctgaaatttttgctaattgttttatataaaaatgtaagggattctctctgaagcatctcagttattatagttagttttgccttacttgaaaaaccttcctgctcataaactacctgcctttggccaggcgtggaggcttacgcctgtaatcctagcactttgggaggcctaggcgggtggatcacgaggtcgagagatggagaccatccaggctaacacggtgaaaccccgtctctactaaaagtacaaaaaattagccgggcgtggtggcgggcgtctgtagtcccagctactcgggaggctgaggcaggagaatggcatgaacctaggaggcggagcttgcagtgagccaagatcgtgccactgcattccagcctgggcgacagagcaagactctgtcttaaaaaaaaaaaaaattctgccttctcagagccaaaggactatagcagcccgaaagaaacgccatattccctgaacatcagaaacttcagattcaggataaataacaaattactaagtagttatcatttgtgttttctagaacacgaagtgacttgttatatagatgtttgttactgttttctaccactctttagaccgtattctttcattggctagattttacttttactttgtctttaatctcaatagcagatgtcttttctaaaaatgttatgtcagaaaaaggaatgaccttgtaagtaatcttaatacttgtatctgatatttaagaatttgtgctttttagcttttgtagaaaagaatgctgagagagagtcacacagaaaattagtgcagtaattgtcaaggctcttctagacatagtaaacagacctataaagaaaccttcctattctctttgtaaaataatatcctagcttgcttctaaggttggcagtgaaggacagtcactctgtgtgtggaggagcagttggacttttaagcccttatgctgctcccattgtccccacactctgcaaagccccatttccctgagttgtctctcagattctggcaagctttcagatatcagtctcagacggtgtgcctcccttctctgccaccctgctgctttcagcagactatctcttcataagcactgataagactgctaatttgtcaagactaccacaggccccaaaccccaggaattccagtccataaggagtatagctggttttggaacccaccctccataaaggttgtgttcccacgagattgtcacaaagtagtttttattcaggttagatatacatggcataaaatttgctcttttaaccattcagtggcattaagtacattcacagtgttgtacaaccatcaccaccatttattttcagaactttttcattatcccgaacgaagctctgttcacattaaacattaaatccccatacccttcttcctgaagactctggtaagctctatctactttctgtctttattaatttgcctattgatatttcatataagtggaattatacaatattcttttgtgtctggctaatttcacttagcataatattttcagggttcatccatgttgtagcatgtatcagaattttgttcctttttaagactgaataatatttcattgaatgtatataccacagtttgtttatccattcatctgttggacatttacactgctgctaacttttggctattgtgaataatgctgtgctatgaactttgatgtacaagtacctgtgtgaatctctgctttcagttcttgtgggtatatacctagaagtagaattgctgaatcatatggtatttctgtgtctaacttttttgacaaactgccaaactgtttttcacagctgttacatcatttgtcattaccactgtcagttcacaagtgttcccatttctccacatcctcaccaattcttgttattttctggttttggcatgttttgctttgtggcaattgccatcctaatgagtgtgaactggtatctcattgtggttctcattacatttccttaatgactagtgatgttgagcattgattcataatacctgttggccatttgtatatcttctctagaggaatatctattcaagtcctttgcccattttaaattgggttctttgttttttgttgagttgtaggagtcctttatatattctggatattaattccttatcagatatatgatttgcaaatatttattcccattctgtaggttgccttttgactgttagtagtgtcctttgatgtacaacaaaattttaatttttatgaattccacctttttttggttacctttgcttggcacccttgtcagatatcagttgatcataaatgcagatttatttctgggctgtctagtctattccactgatctgtatgtctgtccttattctagtaccacattgttttgattactgtagctttatagtcagttttgaaatcaagaggtgtgagttctccaactttatacttctttatcaagattgttttagcttgtcgttaaattttatttcctgctctgctttgtgattgccttttactaacaacagtggcttaaatttattgagcagagtgccagatactatgttcagcatttaaaatgaattatctcattttatttgcacagcgaccctattaggtattgatagcatccccattatacagatgaagaaactgagacactaaaaggttatttgaactcatgcttgtaactgtgacatcatattacttagttacatttactgcatctgtttaaacatttcctaaagttcaaaagaaatatcactttatagactttatcttaaaatgaagaagtatgcacaaaaaatgaacaataatatgcagcagccctgtttgagcgctttgaaaactgaaaacttagggaggcttgaccctctaaccaaaccctctactgcccatgtgtacctggttgagggaaagagtgtggggctaaactctgagcacatttctcctggccgtgtcttgtgtgtgcccttcctgataagaggaagggttacatccttttataatttgtcctgcagagagggaacacctttattcatttcgtatactcagaagtattactgttttgcaactaacagaaaagaaccttatgagtagcaacagcctacacccaggtaccacctgatttgcataaatatcctatctagattcttaagcttgcatttcccactctcactaggtttctgttttgtttcattttttacctttttggcctattgcaacttttctggaaactaatctacctatttaccaggtgcacgtaacttgtaaaaaaatgatttgcagctgtatcatagcctggtggacacagactttaggccgcctgagatctattcttgtaattcatcctgtttcaagattcataattaaaaataggaacatagtattttgactttttaaaagatttgttgaatctacaaataccaatcatggttattatgatagcagtttgtcctacctgaaggattagtgctacactgagtaaacaaaccaaagtagttcacatttcttaagtaattcagtgatttgttctttatgccctctactttcttgtaagacatcgggcatagacaactgttacacattacaagttgagtgtcccttatccaaaatgcttgggaccagaagggtttcagatttcagttttttggattttagaatatttgcatatatgtgttgatgaagtgtcaaattctgtaaaatatttgaagagattcatttggagccaaatatgagtgaccagtggcctgtgacacagcccttaggagatcctgagaacatgtgcccgaggtggtcaaactacaacttggttttatacattttagggagacataagacatcaattgatatatgtaagatgtacattggtttggtacatctggaaaggcaggaaatctggaagcaggtgccttccaggttataggcagattcaaagattttctagttggtagttggctgagttgttatctggaatcaatagaaaggaatgtctgttttaagataagcagtagtggagaccaaggttttatcatgcagatgaagccttcaggtggcagcttcagaaagaatagattgtaaatgtttctaatcagacttaaagcatctgttctatcagtcttaagatctgctttaatgttaatgctgctcagctgtgtctgaattccaaaaggaaggagggaataatgaggcctgtctgactcccccttcccatcatggcctgagctagtttttcaggttaactttggaatgcccttgccaaaaggaggagtccattcagattgttgtggggcatagaattttatttttggtttacatacataatgagatatcttggaaaagggacccaagtctaaacatgaaagttatttatgtttcatgtataccttatgcccatagactgaaggtaattttagacaatatttttttaaattgtgtgtatgaaactaagtttgtgtacttgagccatcagaaaacaaaggtatcaggtgtggaattttctacttggagcatcatgtgagcactgaaaaagttgcagattttggaacgttttggattttcagattagggatgctcaacctgtagtatatttgacttatctctgaaacatttccttttgagcatgcttagggactctcacaaacactaaaagttctttttaactatagtaactattttcttttagatgataaaataatcagcacatggcctctggcagccttcccttcaaactgacctctttattctttaaacactacccccttctgacagggtgtctcatagatcatcttgattcttttttctccaaatgtggaacggcctattcaccaagttttttttttgtagaaaatagtgctaatgaccaaaatctgggcattagatgtgcacttcatattgtttcatataaaatattcagagtagaaaagagtgaagacagagcaagaaaaaattttcttcttttaaaagggcatatatttatgttggtagttctaattaacctctacctttatttcatctctttaaaccagtttcctccttttccattatatgatcttactcaataatgtgttcaaattacaattttggtcctcccttctgcactcccgccaaagttaaaaggctcttcttcttttgtaactcttggcactagtgccctggtattgcattcaaagtatgcaggttctgactgtccccttgtcagcatcatttgtccttcagctctctgaaaagaaaaagacattgcaaaatttttcttacggaatactaaagtatataatgcactcatagatttccataaacttagacgtagcatgaagggaacaaagacagtttcaaggttttctggatttaaccaaaactctccttttgctttgcactttgatggtaacaatgtcatttatcttttattacagccagctttggtgttgaaatttcacatataatgtgttcattcactgttgtagcagtcaactttttaaaagccaatttaaaatgacagaaaatatgcccaaagtaatgttaagaatcataatcataatagatctttaaaatttaaaaaacttaaagtataataatttctttaggtacatattgtcgtaacattgtctcattcagtaagagtcactccataaaagacatcaagacatttggatcatagcatattttcattatagtttttatatagttgtcttacattcttgatcaatctctagaggttttcttttccacatgagtatggagaatttagttaatttaactgccaagagtagccttggtgacaataatacaattttagggtgaattaaaacatgtcagtctcctaatctcataagctatgattttcatattatcttcatagaagggaaaaaacccacaaactcactttttcctcgtgacttggtaaataggtttcaataagatcatagatgcaaaatatcattggccttccatatccaagggttccacatgcctggattcaactaaccatggaatgaaaatactcaaaaaaagaaaaacaataaaaaaatacaaattttaaaacaatataacaactatttacatagcatttacattgtattaggcattacgtgtaatctagagatgatttaaggtatatggaaggatgtgagtaggttctatgcaaatactatgccattttatgttagagacttgcatattcttagattttggtatcctcggggagtcctggaacctatccccctacagatactagggggtgggtatatcttttgccaaaatcttatcagtatcagaatgaccacagataatgctttcatcttggaccctagcaaagcctggggccgtcgtatctttttttgttaatttctttttttcttcttttttttttcctgtggtttttcagagatagccctcatcaagtgctagagcactacttcttaaactatccatagtaagagaataacattttttccttaacctgttgccaatcaatatgttgtcctactcctatgactaatatgtatctttttttttttgagacagtctcgctctattgcccaggctggagtgcagtggtgcaatctcagcttaccacaacctctgcctcctgggttcaagcgattctcctgcctcagcctcctgagtagttggcactacaggcgtgtatcaccatgcctggctaatttttgtatttttggtagagatggggtttcactatgttggccaagctggtctcgaactcctgacctcatgatccacccacctcaggctcccaaagtgctgtaatatgtattttgtactacatgtggcacaccacaggagtttgatgaaccccaagctggcttataccatgttcagtgaaatgagactgatacatgctcaaatgtcatggccatgtcaaattactgcaagttgttgaacacttaatttctgtacttataggttattaacagtcttcagaccacaagtttagttgcactgtagttgagagtctcattttgtctgtctaggcacacttgcttttagtcaggaaaagtggcactgcttgaaggctctgtatgattctgagctccattgggaatgggagttctgattgccctttccaaagagctgccaaattctcaccctcagctgcctttgggtcaagataaggcctgtttcccctttggggctagactcctctgcacctatatcttcctttctcttttcttcctcagactgagtaagctcattgacttaccttcaaattcattaattctttcttctaactgctcaaatatgctgttgagctcctctcattaattttttatttcaattattatacttttgaattccaaaatttttatttggttctttttgtaatttttatctgtttattgatttgtcttcatgccttcctttatttagacatcgtttcttttagctattggaacatataccctaaattcctctgttttattcatccatctgtgtgtgtctcttaattctgtcaccttttctctgaagccactgcctctgacttagttcagtccacaataaactcatacctggattatctgaattactgtagaaacctaatttcttcaagtattatttgctccagactttctctcctttcctcttggatttttagttacctatatgctagatctttttcatatattcctaatctctctcacactttgtttggtttgtttattcttttctttgtagtttagttactataacagttgatctgttgtcacgtttactaatccctgtctcttctgcgtacagtctgcaattaaacccacccaataagttcttagagttcttaattataaatattatattttaaaaaccttaaatatctctttgattctttttaaacagattttagttctgtcaaaatttttctttttagaaatttttgtgctttttaaaaaatatattgatagttattttaaagtccttgtctaagtaatctttggggttttttattgtctttttttttttttcctgtttcatttcaatatttggtccttttctctttgcatgacttttttttttttttgtgagagccagaaattgatgaaaagctgtagaagcaaagagctaaggtttgttctggtagcctcagtgccagatgctcacttgcttctgttgaagcttgtttttaggctttgtgaaggctctactatttttgtgtcttacttctaggatctggccttactgggtctcaaatgaaagtctacagtgtatatagtactatatagtacttggactttggtctctgtcttctcagtactattttatagctgtggtttcaacctctccgtttctctttccttctggcttttgtagaggtgttaccatgtatatgtgcaggataggagtcagcaaatgacttgagaggaatttgtatggagatttttctggtttcctgcagtttccttctctcctaccctctcaccctgcatcctgccctcaaatctcagcactttggcagcccgtactttgacttctgctttccaactcagtatttctccaggacgcaatctggggacccagggatgaagtttaggtgaatgtggagcttgctgcttatgcctcctgctttcaaggaccataatgcctcacttcttgattggtggttgcttccccgaccacatgcctctaaacagcagtttatatgttttctccagcttgtatagtggattagaacttgatttctaagatgttgattttataatttaatttttataagccattttattttccttatatccaagcctttaaattgagaggggaggtggagagggcttcatttactgctgataattaaaataaatattcatctctcttaagtggtttatggagagtaattttcatacaattttacgttgggatatgaaaaacaaacacaagtgaaaggaattgtttttgagagaaggcttaatgtaaaaggctacacaagtataaaattgttgcacataatgtattccttaatttagagaatattaaactagctcctctatttaatcagaaatatagaaaattctatgtatatttttatttatcacgatatagtaaaaatctggctttgaaaatgatttcagtgttaatatagctttcacaagtgtctgcgttcttttctagtggattaatgacttagaaaatgatgatttgtatattacatggcctacaagttgccagaaacttctgaagccagtatttcctggaagtgtaccttccataaggcgcaattttcataatttggtgagttttatattttgattatacatatatatcttataaagatatcagcattctttctggattatccttctgtcaatgaataggcatctgagttgtaaggaagttaagtatttgcctgaagcagcaagcttaggtggcatggctgactgggtatcaacaactagccatgtcactgtattagtccgttctcatgctgctaataaagacatacctgagactgggtaatttataaaggaaagaggtataattgactccccagcatggctggggaggcctcaggaaacttacagtcatggcagaaggggaagcaaacgtgcttcttcacatagtggcaggaaggagaagtatgagcaaaaggggaaagccccttataaaaccatcagatgtcctgagaagtcactatcacaagaatagcatagaggcaactgcctccatgatttaattacctcctactgggtccctcctacggcacatggggattatgagaactacaattgaagatgagatttgagtgggcacacagccaaaccatattagtcacatgttctgcctcttactctttagcccttatgtcattttataataaccatattaatgttacttttacattttttcaaaagaatttatgacagaactttttcttctttattaaaaagaactaatgattaaagtgtagtaattttagggaaagatacataaataccactttatcatctatgcatataattttattagcccaataatatctaaacattaatattggaactttgaaagttggagaaaatacctacggctgttttttcacataggaaatgaataagatattttttgcagcagtcttgataaagcagttatgttaatgctatttttttttggtcaaaattcaatctctatttccttttgaaaaaatttatcatagaaaatctaatgaacatttagaataaggtatttcaattcaggcaaaataaaatatactgggcttccaaaaagaagatgagtagcctgatgttaaattccatgtataattatgtttggatgtgcagcttttagaaatccttcataaattgtgaaatcctttatatgtgtgtgtgtgtgtgtgtgtgtgtgtgtgtgtgtattccttagaattgctagaatttctttaaaaattacacattgaatttcatactttcagtcacaaaaattagtctaaacttgaatttcatgaagattctaaggtgttgaaatagtgatatatactatctttcttttaggttctgtttattgatccggcccaagaatataccttggattttataaaacttgctgatgttttctattctcacgaagttcctcttaggtaattgtcattttatagcattaaactgtcaactaaaggaaattcaatgttattcatattgtgttacacagagtattaatagggcattcaaagcgatggttagctctagtgcctgacataacacagctgcacgttgtgaagtattatatacctttatgttagactctgtttatcaaatctgtctggtaatgttgtttattacctttctgagagaataatctgatcactctggaaacttatagaaaggtccagcttcatatgcttgtaatcccagcactttgggtttgggaggccgaatcaggcagatcacgaggtcaggggttcaagaccagcctggccaatatgatgaaaccccgtctctactaaaaattcaaaaattagcaaggcgtggtggtgcgcacctatagtcccagctacctggaggctgaggcaggagaatcacttgaacctgggaggcggaggtttcagtgagcctggattgtgccactgcactccagcctgggtgacagagcgagactcttgtctcaaaaaaaaaaaaaaataaaaagagtatatttaccctttttgtacaaaagaacatggccatttgataatgttagcactagagggagagagagtgatattttataggaatccagtagctatgtggattttggtgaataggcattacattcaaacttttgaagtgataaaattctccttttctctgtctattaatacattctctccatctagatattgtagtctaataacgtttctaaataatggtttattgtgattcaagaggtaattataacagtccttgttcatcttctttttccagaattggttttgtgttcattcttaatacagatgatgaagttgatggagcaaatgatgctggagttgctctctggcgagctttcaactatattgcagaagaatttgatatatcagaagcatttatttctatagtacacgtgagtttatgcactaaatgtgatttgtttagaaggtaaaattcttgcattactatattatgatttctttagaatgtataatttttgcattacatttattgtaacatttcaaagtttataaactgtcatggagattaatacagatgatgaatttgttttctgtaactcccttctgaagtacatattatcctcacattataaattaggcaactgaggttctaccaagatatttgaatttactaaggtttactcagccaataaagtaatttaaattttatatgtaactttagaggaaaacatattaatagaaaatgattatttaagaaaaaattcttgaactaggctttgattaaagagatcattgcaggctgggcacagtggctcatgcctataatcccagcattttaggaggccaaggcaggaggatcgcttgagaccagcagctcgagaccagcataggcaacacagtgagaccctgtctctaccaaaaaaaaaataaaaaattccaggtgcagcggcacatgcctgtagtcatagttactcaggagactgatgtgggaggatcatttgggcccagaaggttgaggctgcaatgagccaagatcgagccactgcactccagcccaggcaatggagagagcctgtctcatggaaaaacaaaaaatcattgcagagttaaatattctgaatgacatagcatataaacacttcctagagactttcaaagaagggggaagtcatttattgacagcaaactgtgtgaaagaggtaaggttgatacagaatctgacaaagagatcatataacagatgatagaaattggtaagaacctgattaaggaagaacaagagatagtaagattatttcgtaattgaggttttgaaattctgttatggatcattgtggaaatatatatgtattaaagagctatattgttgttattaagaaaagtcaagtcatagcttataaaataacttataaaataagtcatagcttataaaatagaagttttttttcatttttatattcattgggctttagcttgtcaatcaatattatatcaaggaatgactcttcttccaactgagaaaggaatttccaaagtagtgcaaatttcctaccctacttctgtaactcccaggaaaatcattaaataccttattaattcactgagctagagtatagaaactacacttcagtgatttggcaggggtacagtttgctctataaaatagtgccatggaatatgcatcaatattatgtctcagcttatttgttttactaacttactggtgtaagagtttataagggacatagtcaatttgagttacatcttttattaagattcaagattcagccattttattgtaaaggatcattatgatattcaaaacttagaaacctgaagatattcagaaattatctttacctaagttatcttaattatcaatattgaatctctgttttgtaagtgttttttatcagacattaatttacatgtgatggcattaatctacagtgttcagcacaatactgttaatatataatctcctggaaaaacaaattatacttgaaaccacagggtttaatacaaagcagcataaaagtaagtattaaatttgtggcacagcctgcaagttgtgctaaacaattagaaggagagggagaaggagaaataatttgaacaaggcatagtttttaggaaaatacatgaattataaaatcttttaaaagtgtttgcctgttttcagtgagctaattaccttatctcaattaagtaatttgaagctatttagcactataaagagagaagaatataagaccaaaataataataaaatatatggaagttattgaaatgtgataacaaatagcaaatattaaagttaatccaaccatatctgtgaccatattaagtgtgaggaaattaaactttagcatactagcagaaaagatataaaaagacagaaagttatacacaaggtgactatcacaaatgaaatctaaggtagccataaaatattaggggaaataaactttaagaaaaagtactaaagttgtatgtagcttcaaaatatacaatacaaaatttgatagcaagggagataaatggacagtttcactataatagtagtaggttatttcaacattttttaataggtgaagcagattaaaaatcagtaaaaatatataagattttaacaatacacttaagattaattttaaaggcaaatataatatccaacaatcagagaatgagatgattttgcattcaaaacagaagaggaaaatatgtcttttagttagaaaaggagttaaaagaactagttaaccattcagaaatgagtaactgatttttaaaaagtagatggaaagtaataagaatatacattaatgaactaggaaataatacaattatgggatcaagaatataaaagttgatattctgaaaaaacaaataaaattgacaaactatcatagaggttaggttccagatgagcacaccaggtataaacttccagactcttaaggcctgggctcagagatgggtacatcattactttcagtttattccgttgtattctgtttatcaaagagtcacagattcagattcatatacccacttctcaatggaaggagtgttgaagaatttggagaccatgttttaaaactagcacagcaaattctaccaaatattcaaatgtttgaagaaataataatttcagtctttaaaatatcttttagagaatagaaaaagaggaaatattacctaaattagtctatgaatctaatataatctgatgtcaaagcctgacaagaagagaaaaggaaaaattataggctgttctttgttgagaatatgtatgccaaagtcctaaataaaatattaacaaaagaaatccagcaggtatataaaaagtaaattatcatgacaaggtgagattatctaatgaataaaagaaagtatttgcaaattcaaagaatctctaaatataattcaccatgttaatatattattcaagaatatgcacaagaaacatttgaaaaaattcaaagcttttttatgattaaaaaactcataaagaaacaaaatgtttagcgaactattatgtaagggaattttgttaattgatgacagcacatcttagcagtaaaatgatagaaagcattgtttttaaaaatggaaaaagataaggtacccactgtcaacacttcaagtataatcctcaagttccagtcaatgcaataagataagtaaaggaaatactcatttaaaatatttaaaagaaacaaatttttatttaaaattccagacttgcctacagaggagactcaaaagaatccattgattgtgagatttgacacaggaggttagtaaagtaactggatatgagatcagtatactaatatcagttgcttttctctcttctaacaacaaatatttattaattattttcatcagttttattaaatgcctactacataccacaccctgttttaggtgcttggataaattaataacatatatagccaacaatccttatcctcatgagagtactttctgtaatgactcctacatttacaatgacaagagcaagcaaataaaagatacttaggaaacctgggggctggggggaaggtcagttttgtggagaaaatttggaattatagccatgaaagtttacctaaatgaatgaaaagctctaccatgtttatcaatagaaatatttcacttcataattatattgttttctgcaagtgatttctaaattcattgcatttccgaccaaagtggaattttggggatttttgtgaaatgtgatgttttattttaaaatttatatggaagaatgaagactcaaaatgggtgagactttgaaggataaagtgatgggacttgtcataccaggtaataagatgtataaagtttgtggtattggttcagggaaagacatatctatcaaaagaacgtgggggtcccaaaacttaagaatacagaagtgacattacagtaaatgggagtggacttacaacaactgtggttcaacagtggctataccaatgcaagtaaataagactttacaccttgtgtaaaaatcatttgagttagcttaaaaatgtaagtgtggaaaacaaaactttaaaacatttagaagttaggacctcaaggtaagggtttcctagataaaacttaaaaagctctaagtctgcaggaaaatactgataatttcagctaaattacaaatgaaaaccagtgcccattaaaatatgtcattaaaaaatagggaaaaatgttataagcaggagaagtatttacaatacatatggccaataaaatatttatattccatgagatgtaaacattttctacaattcaaaaagaaaaataccaatgacccaagaggagaaatgcataaaataacttttaaaatagaagatgcattaatggtaaataaaaatatactgaaattattggtggtaaatatttattaccattaatggtaactaaacaagataattatcttacaaatttgaaaaatgcaaataaagactacgaccacaagattattttataccctgtaatttggcaggaattaagaaagctgaaggtatcatttgttaatgagaatgtagagcaatggaatgcctttacatttacattgctaccctgcctgtaggaatctaaactggcagagccacactgaaaaacaatctgataataattcactatttgaagttaaatttccacatttcctacagacaacacacacacacacacacacacacacacacacacacacacacacaccccctcaccctaagagaagctcttgtacctgcaccttaggaggctattgttagcagaatcattcagaatagcaacaaactatgataaatatacacatatatacatatcagtagcaaaatagataagtagaatttggcatattagaatgaaatatcatatgcaagagcatagatgtattagaaacataatgaagtcatagaagactaacaccataccatatacttcttaaagctcagaagcaaacaaaactaagtatgggaatacgtattcgcataaaactctagaattcaaaaaggaaagggaatgataaatgcaaattcaaaacaatgcttgcatctcctgaagcacaaggaaatgggattgggagagaagttgtacttcatggcattggtgatgttccatttcttatgttacgtggtttattcataagaattgtttattttgttatttatgcctcataatgtgtatgttatgtgtattcctctttgcttaccaagttacaaaataatttttaaaatttaaaaatgtgtaagaggattgagttgatatgtctgagtaacttatgtgaggcattctgactaccttattttatgagtatctaatattttcaggtgactagttagtaaaatgactaatctgaatgacttttcctttatcttttgctttattcagagtctcatttttgtgatctccatttatgttttacaaaagatggaacttttcactttttttgagttatgatcacattatgttctactttgataggaggagaaaagttgcccctaaattgaaaaactcgtaaaatgaaactcttcagtctaattacatacctgtgctgctgcttaaaggaatagggtacaaagtttacagtgataaagggagagcaaagaatactaatttcttactgtgaggaatataacatggggatcattttagccacaatatgaagattatgtttggcaataatgacataagtaaattgggaccaaaagcaatattcttcagtgatatatcaaatgctgcttaatagtgtttgtacttactacttgttccttctgcttataagtttctttccccagaatgtcttaatgctagctgagtgttcatacttatgtctcagcttagtcgtctactcaagagatgccatctctcttggtgcaaaacctaaaacagcacctgggtcatagaggatctctaagtacttattaaagaaagaaatgagaaaagataaaaagaataacagcttacattctacaagtgtgtttagaatatttgagactggggaagagtagaggtgcagagaaagtttagtcaaaatacttactagtaaggcctggcatggtggctcatgcctgtagtctcaactatttgggaggccgaggcaggtagattgcttgagcccaggtgtttgagaccagcctgagcaacatggcaagaccctgtctttacaaaaaatacaaaaaaatttatccagatgtggtggcaagttcctgtaagccaagcccttcgggaggccgcaggaggtggattgcttgagcccaggaattcgataccagcctaagcaacatggcaagaccccatctttacaaaaaataccaaaaaatctagccaggtgtggtggcaagttcctgtagtcccagctacccagggggctaggtgggaggattgcttgagctgggaggttgaagctgcagtgagccatgatcacaccactgcattccagcctagtcaatggtaagaccctgtctcaaaaaaaaaaaaaaaaaagaaaaagaaaaaaattacagaaaagcaataaaaaatgaaagcatttctgaaatgtcatattagaatatattatacatacattaaaaaaggtaatcattattttattaagaataatggtgtctggtttcatcaaaatagagtaaaacataaatttgttatgatatttttgaaaactatagaatattttaaaaccatctttattaaaagatgatatatggttaaaattatttttatgtggtatgtgtgtatgtgtagttagtatattttgaacttacaaaataaaaatctatctgcatgctaaggaaaaaaaagaaaactaattgctataagaagaaaattaattataatatctaaattttcacagatgtaccaaaaagtgaagaaggatcaaaatatactcactgtggacaatgtgaagagtgttctccaaaatacatttcctcatgctaatatttgggatattttgggaattcattctaaatatgatgaagaaagaaaggtaagttgggacattatgttaagtggagtaggccaggcacagaaagacaaacaccacatgatctctactcatgtagaatctttaaaaaaagtcagactcacagaaacagagtaaaatgggggttaccagaggctggggatggcagaattggggagatattggtcaaaggatacaaaatttcagttagactagagaaataagttcaagagatctattgtacatggtggtgactgtagttaatgacatattttatacttgaaattactaagtacattttaaggattctcaccacaaaatatgagaagtatatgaggtaatgcatatgataattagctttattagctattccacaatgtatattaatatcaaaatgtcatatatcataaacatatatattttttacttgtcattttttaaaaggtgaacaattagagactcaacccagaagattcggaaagagccaaaaaaaaaaaaaaaaaggcaacaactcaaagaaattttcagagaaagagaaatagtacaaagaaattccaaaaattaatgtataggagccttcattagaagggactcaccaaatacgcaacacattgaatgaaagaggaatgctctggggtatggggataaggaatacttttctgaagaagtgatatttaagcagaatcctgaagcaggaggaaaagttagacaaaagaaaacaagggggttgtaagagattaacattccagtcagaaaaatattgtgttctgagatgtaaaggaattgagagaagctgatgttgctactgtgtagattgaaagcatatgttgttcctgtgttatagggtacagtcgaggagataaggctggagaggcaagcaaggggtctgaatatacagggtcttgtgaacaacatttaatgcactcatgtcagtagaagctcttggcaacagtgaaaaacctgaaaggcattaagtagtgaagtgacagtgacatgcatttttttttctaaagagcattctccattgttgagaatggattgttggtggggaggagtaggtgtggtgatatgtattaggaaacataaggtgagagatgtgagatggactagtaggcttttggaagaagtggaggcagagaaaatggacatatttgaattatttaggaagtaccatccaggtgctgctggattggataaggtagaggggagatgagaaattgtcaagggtaactcccagggttcagctgaacaactaactggtagtgttgatgccattgccaagaaggaaaggagtggaggagtttatccttgttaaactataagctttaggagagagtttgcatatcatttacatgcattcataaacctaagacatagtaggtgcccactaaacgtacagatagtatagtacagtggttaagagttcagactcttggtcagacagatctgggtgcaaattccatttccaaaacattgtagctgtgtaacataagaagtgatttaatctctctgtatctgttttatcatctgtaaaattgatgtaatagtagtacttggcttcctagagtatttgtgagaatgttggctataataatgataatacttagtattggatagcaaatgagttatttagtcactttttaactcataagctaaaattcaaatgttgaggaccttcatgatctggcctctgcctacacccctctctaactccgtatctgacagctgtcccccatatttcacaccctgtaaacactgctgtattagtccattttcacgctgctgataaagacatacctgagactgggcaatttagaaaagaaagtggtttaatggacttacagttccacgtggctggggaaacctcacaatcatggcagaaggtgaaaggcatgtctcacatgatggcagacaagagaagagaacttgtgcagggaaattcccccttataaaaccagcagatctcatgagacatattcactgtcacgagaatagcatgggaaagatctgccctcatgatttcattacctcccactgggtccccccacaacatgtgggaaatgtgggagctaaaatttaagataagaattgggtggggacacagccaaaccatatcaactgtgaatttaccattgcataagtataccacactcttactttccttgctatattctcctcacttggactgtctttctctattttatctctctggcaaatttttattaagcctttaagatttttagtatgactccctaaaagaagacctgtatgatcccttcctctccatactccagcttgattaggtgcttctcctgggccccatagagtcttctacatgcctgtgttttgtctgtctgtatgtgaaccccttgagaaaagactttcagctctataatcacagtatctagcctaatgcaggtggcaggattgaataagtgtttattgaacatataaatacagggataaataagtctctgatgccgataaatgtttggatttttattaagttaatgtcatactctataccaagaatcagcaagtccacccactgcttgtttttgtaaatattttggggacacagccatacttgtttattcatatgtcgtctatgactgcttttgtgctgtaacgagagtggagtcactatgtcagaaactgagtggctcacaaagcctaaaatatttactctctggccctttacataaaaagttttttgactccttgtaggtaaattactttcctttaggcaatgtttggaaaggacagataaagttagcaaaatggatgttttttcctatggcatataaaaatgtggcggtgttccattttcttatgtttattattcaaacaatcatattttgtttaacactctgatattttttaactgaataggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttggtaggtaagcatttataagaaaatacatgatgaatatttataaatgatgtttttattaaaaacttattttaatgacagaagttgatttggtaaaaaatttccattctgatcatttcatagtgatttttaaaatgatacttttagcagcttaagccacgccaccctgcctgtgcagagactgtggtgcagtggggccctttatactccatgcccaggcagatcttcaggaatctggaacacccactgtcctcgattaggagtttaggctaccccgctccctctgcagagaacttggagccaaggaggtttcccagctccatgcctaggcacacctctagacacctggtggttgcccactgtattctccctcagtgttggtgcttgtgcctgccgttggggtacctgtaggcaggcctgctcagcctggccctgcccatcttgcccaccatgtctgagcagggaggccagaccactgtgcacaccacagatcagcccattgcctgagacaacagagagattatcccagtaacaaggatcaagtatataccctgccatgttggcctcagctggcttttactcataagggctatctactagcttgtaggtcaaaccacacagcccaaagtaaaatcagctgatagaaatgcataggctatagaagcatcacttaaggaatttcaaaatataattgaaagctttatcaatagactggaccaagcaggagaaagaatttcagagcttgaaaaccagtcttttgacctaacccagtcagacaaaaataacaaaaaagaatttaggtcaggcatggtggtttatacctgtaatcccacctctttgggaggtcaattcaagaggatcacttgagctgatgagtttgagaccagcctgggcaacacagtgagacctctgctctacaaaaaaacttaaaacttagccaggtgtggtgatgagtgcctctagtcccagctgctcgaaaggctgaggcaagaggatcacttgagcctaggagatggaggctgcagtaagtcatgatcatgccactgcactctagcctggatgacagagcgagaccctgtctgaaaagaagaatttttaaaaatgaacaaagtgttcaagaaatacgggattatgttaaaggaaccaaacctacaaattattggcattcctgagagaaaaggagaaaaagtaaacaaccaggaaaacatatttgagggaataattcaagaaaatttccctcatcttgctagtgaagtagacgttcagttacaagaaattcagagaacactgtgagatactatacaaggtcagcatcaccaaggcttatagtcaccaaactgtccaaggtcagtgctgaagtaaaaatcttaaaggcaactagagaaaaaaggcagatcacatacgaagggaaccccatcaaactaacaacagtggtctattttcagcattcctaaagaaaagaaattccaaccaagaattttgtatcctgtcaaactaagcttcataagtgaatgagaagtaaaatctttcccagacaagcaagcactaaaggaattcattagcactaaacgggccttacaagagctctttaagggaatggaagaatggtacaaaaacacacttaagtacatagcccacagaccctataaagcatccacatcatagaaactgaaaagcagacagctaagaacttcacataggatcaaaacctcgtgtaccaatattaaccttgaatataaatggcctaagtgcctcacttaaaaggcacagagtggcaattggataaaaaacaagacccatctgtctgctgtctacaggagacgggctcaaagtaaagggtttgagaattatcatgcaaacaaaacaaaacaaaaccaggagttgctattcttagataaaacaaacttgaaaccaacaatagataattataaagtgttcaacaagaagacttaagtgtcccaaatatatatgcaccaacactggagcacccagattcgtaaaacaaatacttccacacctatgaaaaatcttaaggcagctgcgcaataatagtgggagacttcaactcacccactgttattgaactaacccagtcagacaaaaataaaaaagaatttaggccagaaatggtggttcatgcctgtaatcccaccactttggaaggtcaatccaagaggatcgcttgagctgaggagtttgagaccagcctgggcaacacagtgaaacctctccacaaaaaacttaaaacttagccaggcgtcatggtgggtgcctgtagtcccagctactcaaaaggctgaggaaggaggaagacagcagacagatgagtcttgttttttatccaacttgccactctgtgctttttaagtgaggcgtgtaggccatttatattcaaggttaatattggtacatgaggttttgagcctgtcatgaagttcttagctggctccttgccatttctatcgtgtgttagacactgacagtgttagacagattatcgaggcagaaaactaacaaattctggacttaaatggacactgatcagttagacctaatagacatctacagaacattccacccatcagccacagaatatttattcttttcagctgcacacagagcatactccaagatcaagcacatgcttggccataaagtaagtctcaataaattttttaaagtcagaatcataccagtcatactcatggaccacagtagaataaaaatagaaatcagaactcagaacatctctcaaaactacataattacatggaaattaaataacttgcttttgaaatcacttttgggtaaactgaaattaaggcagcaataataaaaattcaaataaatgaaaacaaacaacatacgaagatctctggcatgcagcaaaagcagttttcagagttatagtgctaaccacctatctcaaaaatttagaactatcaccaggcgcggtggctcacgcctgtaatcccagcactttgggaggccgaggtgggcagatcacgaggtcaggagatcgagaccatcctggctaacacagtgaaaccccatctctactaaaagtacaaaaaaaaattagctgggcctggtggctggtgcctgtagtcccagctactctgggggctgaggcaggagaatggcatgaacccgggaggcggagcttgcagtgagccgagatacagccactgcactccagcctaggtgacagagcaagacttcgtctcaaaacaaaaaacaaaaacaaaaaaatttagaactatctcaaaataatgacttaacatcacaccaagaggaattaggaaaaacaagaatgaactaacctcaaagctagcagaagaaaagaaataactaaaatcagagcagaattgtacaaaattgagacccaaaaatttatacaatgaatcagtgaaaccaaaagttagctcttggaaaggacaagatcgatagaccactagctagattaacagaaaaaggagaaacgatctaaataagcacaatcagaagcaacaaaggtgacattacaactgatcccatagaaatacagaagatcctcagaagacctctatgcatacaaactggaaaatctagaggatatggataaattcctggtctcccaagattgaatcaggaagaaattgacaccctgagcagactgatactgagttccataattgaatcagtaataaaaaacctaccaaccagtaaaagccctggaccagatggattcataactgaattctgccagatgtataaagaagaactgttaccaatcctactgaaactattccaaaaaaccaaggaggagtgattaatgcctccctaactcattctgcaaaacctgtgttatcctgataccaaaacctggcaaacatgcaatgaaaaaactacaggctagtaccattgatgaacatagatggaaaaatcctcaacaaaatactagcaaactgaatccagcagcatatcaaaaaattaattcaccgtaatcaaataggcttcactcctgagaaaggttggttcaacattaacaaatcagtaaatgtcattcaccacatacacagaatttaaaacaaaaaatgtgatcattttgatagatgctgaaaaattattcaataaaatcaaacatcccttcatgataaaaaccctcaacaaactgcattgaaggaacatacctcaaaataataaacgccatctatgacaaacccacaaccaacatcatactgaacagtgaaaagctggaaacattccccttgaggactggaacaggaaaaggatgcccagtctcactattcctattcatcatagtactggaagtcttagagcaatcaggcaagagcaataaataaaaggcatccaaatagtaaaagaagtccagtatctctcttcactgatgatatgattctacacctagaaaaccctaaagactccaccggacaactcctagaactgataaattacttaagtaaagtttcaggattcaaaattaatgcacagcaatcagtagcatttctatagaccaataacattcaagctgagagccaaatcaagaatgcagtcccatttacaatagccatacacacacacacacacacacacacacacacacacacacacaaataaaatacctaggaatacagctaactaaggagatgaaagatctctacaaggataattactaaacactgctgaaagtgatcatatattatgcaaacaaatgggtaaacattccatgctcacggattggaagactaaatattgttaacatggccatactgcccaacacaatctacagatttaatgctattcatatcaaactgccaatgtcattattcacagaattggaaaatactattctaaaattaatatggaaccagaaaagagcccaaatagccaaggcaattccaagaaaaagaacaaatctgaaggcatcatattgagaggtgacaatgtgctggtggcccttgctcactctcagcacctccttgccctcggcgtccgctctggccatgctcgaggagcccttcagcctgccactgcactgtgggggcccctctctgggctgtccgaggccggagccggctccctctgcttgcggggaggtgtggagggagaggcgcgggcgggaaccagggctccgcgccacgttcatgggccagcgcgagttccgggtgggcgtgggctcagcaggccctgcactcaggccggcgggcgctgccggcccgggcagtgaggggcgtagcacccgggccagcagctacagagggtgcgctgggccagcactgtgctcgaattctcgctgcctcatctgcctccccctgggtcagggcttgggacccgcagcccgccatgcctgagatgcagaaaactgaaactggaccccttccttacaccttatacaaaaattaactcaagatgaattagagacttaaatgtaaaacctaaaattataaaaaccctataagaaaatctaagcaatacaattcaggacatagacacaagcaatgatttcatgacaaaaatgccaagagcaattgcaacaaaagcaaaaattgacaaatgagatctatttaaactaaagagtttctgcacaacaaaaactatcaccagagtgaacacacaacctacagaatgggagataacttctgcaatgtatccatctgacaaaggtctaacatgcaaagtctataaggaacttctacaaattacaagaaaaaacaaacgaccccattaaaaagtgggcaaagcacatgaatagnnnnnnnnnnnnnnnnnnnnaaaagaacatctaaacatccgacaatcagttgctcccatcctacgacagacacattctcgtgccatgctcatcacacaccacttaactagcactatctctccatgcacaggacatcacccatcaatttacttgagcacctctttgattttagaccgcgacacctacctctcttctcggaatatgagaacaggccagacggaaccagctccgcccactcaatgagccaggcgataccggacggcgtggttcagaaatcctcaactcaagcgcgcgcatccggccctgcagtgatggcatacactgcgtccactagttacagagtgtggctgtgacaacattgtgtttaattctacgctgcctcatctgactccccttgggtcagggcttgagaccagcagcccgccatgctgagcctcctctccacccctaccacaccccaccatgccccggcaccgtggggtcttgcgcagcccgagcctccccgacgagtgctgccccctgctccgtggcgcccagtcccattgaccgctcaagggctgaggagtgccggtgcaaggtgcgggagtggcgggcagctccccctgcggcccaggtgtgggatccactaggtgaagcccctgggctccagagtctagtggggacttggagaacctttatgtgtagctgagggattgtgaatacaccaatcagcactctgtgtctagctcaagatttgtaaacacaccaatcagtaccctgtgtctagctggaggtttgtaaatgcaccaatcagtgctgtgtctagctcatctagtggggacttggagaacttttgtggctagctcagggattgtaaacacaccaatcagcaccctgtcaaaacggaccaatcagctctctgtaaaacagaccaatcagctctctgtagaatggaccaatcagcaagatgtgggtggggccagataagggaataaaagcaggctgcccaagccagccgtggcaacccgcttgggtccctttccatgctgtgggaggtttgttcttttgctctttgcagtaaatctttctgctgctcagtctttgggtccgtgctgcctttgagagctgtaacactcaccataaaagtctgcaccttcactcctgaagccagcgagaccaccaacccaccagaaggagaaaaccccgaacacatctgaacatcagaaggaacaaactctggacactccatctttaagaactgtaacactcaccgcgagggtccacagctttattcttgaagtcagtgtgatcaagaacccaccaattccggacacagtattacccaacttcacagtacactatgaggctacagtaaccagagcagcatggtactggtacaaaaatagacacatagactaatggaacagagtagagaacccagaaataaagccacacacctacaaacattttagctttgaaaagttgatgaaaattagtgggaaaagggtcctcgattcaataaatggtcctaggatagttggctagccatatgcaaacaaaactggacccctacttttcaccacgttcaaaacttaagatggattaaacagttaagtataagacttaaaactataagaattctagaagaaaacctaggaaacaccgttctggacatcagtcttgggaaagaatttatggctaagatctcaaaagcaattgcatcaaaaacaaaaatttgacgagtgggacctaattaattaaagagtacaacaaaagaaactcgcaacagagtaaacagacagcctacagaatatacagaaaatattcacaaactgtatatccgacaaaattctaatatccataagtagcaaataaatcaagcaaagaataaataaccccattaaaaagtaggcaaatgacattaacaggtacttctcaaaagaagacacgcaggcggccaacaagcatataaagaaatgttcaacactactaatccttagagaagtgcaaatcaaaaccaaaaggagacaccatctcgtaccatttagaatggctgttattaagtgaacaaacaacagatgctggtgaggctgaggaggaaggggaacgcatatacactgttagtggggatgtaaattagttcagcccctttggaaagcagtttgtagatgtttcaaagaacttaaaacagaactaccattcaacccagcaatcccattactgggtacatctccagaggaaaataaatcgttctaccaaaaagacacatgtatgttcactgcagcactattcataatagcaaagatgtagaatcagcctaggtgtccatcagtggtggattggttaaagaaaatgtggtgcatatatacaccatggaatactacgcacccattaaaaatgaaatcgtcccctttggagcaacatggactcagctggaggccaagcaaactaacacagaaacaggaaaccaaacactgcatgttctctcttatgagtgggagctaaacattcggtactcatagacataaagatggcagcaagagacactggggatttctagaggggagagggaaggaaaaagtcagggaagggttggaaaactatctggtactatgctaactacctgggtaatgggatcagtcataaccccaacttcagcattacatgatacacctgtgttgtaaccaatctgcatgtgtaccctcgaatctaaaataaaagctgaaattctttaaaaatatatttaattaaatttatcttaggcataattgcatctaaaattgcttaattggaaaaagttgtaatttttacaaggaaatgtattctccctccccctctccctcatctccctctgatgccaagccgaggctggactgtactgcctccatcttggctcactgcaacctccctgcctgattctcctgcctcagcctgcctagtgcctgggattgcaggcgcgcgccgccacgcctgactggttttcgtattttttggtggagacggggtttcgctgtgttggccgggctggtctccagctcctgacctcgagtgatctgccagccccggcctcccgaggtgccgggattgcagatggagtctcgctcacttagtgctcaatgttgcccaggctggagtgcagtggcatgatctcggctcactacaacctccacctcccagccgcctgccttgccctcccaaagtgccgagattgcagcctctgcccggccgccaccccgtctaggaagtgaggagcatctctgcctggccacacatcatctgggatgtgaggagcccctctgcccagccgcccagtctgggaagtgaggaacacctcttcccggccgtcatcccgtctaggaagtgaggagcgtctctgcccggctacccaccttctgggatgtggggagcgcctttgccccgctgccccgtctgggctgtgaagagcacctctgccccgccgcgaccccgtctgggaactgaggagtgtctctgccccgccaccaccccgtctgagaggtgaggagcgtctctgaccggctgccccgtctgagaagtgaggagcccctccgcccagcagccgccccatctgggaagtgaggagcccctccgcccggcagccgccccgtccgggaagtgaggagcgtctccgcccggcagccgtcctgtccgggaggtggggggcagccctcgccaggccagccgtcccgtcggggaggtggggggcagcccctgcccggccagccgccccgtccaggaggtagggggcagcccctgcccggccagctgccccgtccgggaggtggggggcgcctctgcccggccgccaccccgtctggcaggtgtacccaacagctcatttagcacgtgtccatcatctccatgtcggttttgtcgaatagaaaagggggaaatgtggggaaaagaaagagagatcagattgttactgtgtctgtgtagaaagaagtgggcataggagactccattttgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagaccctgcaaggcagcatgttcgttaagagtcatcaccactcccgaatctcaagtacccagggacacaaacactgcggaaggcggcagggccctctgcctaggaaaaccagagacctttgttcacaagtttatctgctgaccttccctccactattgtcctgtgaccccgccaaatccccctctccgagaaacacccaagaatgatcaataaatactaaaaaaatttaaaaaaacaacaaaaaagcaaacaaacaaacaaacaaaaaaattcagtgagttaattaatgagaattgtcctgctcacaataggtgctcaagaaatggttactaccatgattctggttgtgaagtgaaattgccaacacctgagacagagctcattaaatgtttaccaaactgaagaataaaaaaaaaaaaaaaaaagaaagaaaatgtattgtaataattctaaattgcttatttatttttgattaagtaatctttgtgttatctgcatactttttgaaacatggatataaattgcctgtattatctaaataacatttttgtttttttagggcacattaaatgatcgcacgaatgcaattgattttctaatggataggaataatgttgtaccccgtataaatactttgattttgcgtactaaccagcagtacctcaatttaatatctacatcaggtaaaataatcctatactgttctacaaatgtttattgagttgtgaattctttatttatatttaacgtttaatttgaaatttttcagtaactgctgatgttgaagatttctctactttctttttcttggattcacaagataagagtgctgtaattgcaaagaacatgtattatttaacccaagacggtaataagcatattttatttacctgaattcttaaagtgatagaaacttgtaatgttcataaggcagttgtataataaattttaatatgttgctatttttgagtagaggcctagatttcaattttagagtttgtaaattttttagtatttaacgtgtgctgagaaaacaatgccttctattctaactttgtttatcttatttttgccttttttaaacaaactattttcacctttttaagaaaagaataaaatcttttcagtactatgtaaactatcttataatgtatacagaaaagtacaattaccagatcagagaagataataattcttctgcattctgattaaataacatgcagatattttgcttaaggtaggggttacaaccagaagagaggagaccaagatagtaacacacttgggaaaaaggatttagccaaactgagaagtctgcagtgggaccgtagatttgttagggtacaattaactattcagatagatgaatataattcgaatttggtggtttttgttttgctttgctttgttttgtttggcctgctttgctctagaaataaaaacaagagccaatgagtaaaagattaaagaaggctgattttggtctcagtagggaagtggtaattttctaacagtgagagttcattaaacagatggaatgaactatgttgtaaggggcaaacttttatataggagagagatttaaagcaaaggccacacaaccagttcttgtaaatgctgtagattaaatccgagtttctaccagatggctcctggattactgtctaacagattccatgattttatgttcataaaggagtctggctacatattgctgttttctatatctactaataagcttgattgttacggttttacatatatttgggacataaattttttttttttaaacaaatgtagctagaaggcagatttgcttaccaacactgggagttttatataagcttatataatgagttactcttctaaccggaagctttatataagcttgtataatgaattacccttgtagcatttttatatgtaattttatatgtatttatttttgtatgtatatatatgtacttgcatgtatacattcacacataacattttaaaaatctttgcttttcagaaatattattttaattttttttaatgtgttaactgcacatgttcccctgcttttgttttattttttaaaaaaaaagttaatttgagtaaactgtttgaaactttcagatgagagtataatttctgcagtcactctctggattattgcagattttgataagccttctgggagaaaacttctttttaatgcattaaagcacatggtgagtacctagatattcttactaacaattttaatttatttcaatttaaggaaagcaatatgaagaacatacattaaatattttcccctccatgttaatgtttcagttaagtagacgaaggaattcagatttagtcttcatgtaaaacaggtaactttgctcaggaaaagaaaaacctacctgttttctatgactcgtgacatatattctctggtagtccttgtgatcagacatacacataccacatattgattacaaatagggtattaaacaaagtaagtaactctagaccctaccaccacttcagtgacccgaaatccactatttaccaacaatagctagtaatagcaatttttggtcacataattaagcagcattttctttccctgattatttaagaaaaactaagtaaatttatctcactgaagaatattttaagccttaagtcaacattaaatttcttgttattgattataaaccagtatacttcaagaggatatatttctgtatataaaagtagtctttcataactgtctgtatttctaagttaatatataagtttatctagataaaaaatacttaagaaacataaaccaaaatattttatgaaattgtttttatattagctaagtataaatttattgctgtataacaaattaccacttggtggtaaacagtgaacatttatcttaacagtttctgaggttcaagaatttaggagcaatttacctgagtgattctatcttagattctcttataaggctatatttaagattttggttatagttgcagtgatccgaaggcttcactggagcaggaggacaagcttctaagatgactcacttacatgccactgcaggagtcctcagtgtttcactggcttttagcagagtgcttcattccattgccacatagacctgtttttggtgttacttaagtgccctcacaacgtggcagcttcctttttccagaacaagggtaaagagataaagactgagccacaatgtcatttataatctagcctcaaaagttacacacagtgttttctgtttgttgagcaaataacttctattcagtatgaaaggtgctttacagggcatgaataccagagatggggatcgttggggccatcttggagactagctaccacgttaagaataaataatacttcttaaattaagcatttttatttcatattacaccatgtcagaatgcatttaggctttactcagtagcctgcagaccggaaaatttcaaaaaaaaaaaaaaaaaaaaaaaaaaaaaaagctgtttgggatctattacatctattgggagaaattaacttttgcctgctgtttcttctcaagcggttctgggtgtgtatattctttcagaggctcacaaactccctttccccagttgtttcaatgtgtctagcagataactttctcttgatttagttgcttcttctataactttcagaagtgctatcttttaataattgtttattccttataggatggatgattattttcattgtcccaaagattttcaaaacccaagtatcattagaaccacaaactaaaaacactgtaatatatgaagtgcaataatcatgatgacaagaaataattttggatcccaaaatgctatctgttggaaatataaaaattgaaaaaagataatcattgtctaatcaaatcatcatttcattgtagtttttctttcacccaagtattttacattttttctggttatttatcacatgttccttatagaaaatcggaagtacataaaatcaaagactaacaaggaagaaaaagtaatcacccataaaacctattttaatgtttaggtgtatttcctttctgggttttttatatttatttttacatggttgaaattatcacttacagttttatcaaaattattttcttataatgttaaacaatgttgtgtcaacaagaattcaaatggatacataataaactgtctacatggaaatatttagtaacattgaaaattcaggtggttttgtttttttgctactgttggtattaatgcagtcataaataattttgaatgtgtagcttatcttatttttttattacctctgagaatagtttattaaaaatgactttgtctccactaaaaatacaaaatttgctggacgtgatggcacatgcctgtaatcccagctactggcgaggctgaggcaggagaatcccttgaacccgggaggcggaggttgcagtgagccaagatcacaccattgcacttcagcctggttgacagagtgagactccatctcaaaaaaaaaaaaaaaaaagaatatgctgagccaggcatggtggctcgtgcctgtaatcccagctaatcacgtggctgagatgggaagtttgcatgaggccaggagttcaagcccagtctgggcaacataacaagactctgtctctaaaaaaaatttttttaaaaacaattagccaggtgtggtgatgcacgcctgtagtcccagttatttgagaggctgaggtgggaggatcacttgagcccaggagtttgagactacagtgagctatgatcacaccattgcactctagcctgggtaatagagtgagaccccattaattagtcagtgaagaaaagaacgtactgaatataagggttgttaacatttttagactcccgataatttttaacaaatgactttccaaatggctgttaattttcatagtttttgagaggatctgtcacatcacagtgttgaaagtcttgatttttgttatacctaattctttctgccaatttaaaaacaaagagagtttctttttttaaatttttttgttttgttttgttttattttgttttgttttttgagacggggtctcgctctgtcattgaggctggagtacaatggtgtgatctcggctcaccacagcacccaactcctgggctcaagcaatcctcccacctcagcctcctgggcagcttgggactgcaggtgcatgccatcacacccagcaaatttttgtatttttttgtagagacgggttttgccatgtcatccaggctggtgtcacactcctgagttcaagtgatccactcgcctcagcttcccaaagtgctgagattacaggcgtgagccactgtgcctggccaaagatggcttcttatttgtatttatttgataagtagttatagggaaaatttttctttcaatatgactttatttatttttagctttgattccaggggtacatgtggagatttgttacatgggcatattgtgtgatgctgaggctggagcttctaatgattctgttctccaagtagcaaacatagtacctgataggtagtttttcaactctcgtggcccccctttctcccttcccatccccttttgtagtccccagtgtctactcccatatttgtgtccctgagtatccattgtttagctcccacataagtgagaacacgcagcatttgattttctggttttgtgttaattcacttaaaataatggcctccagccgagccaatgttgctgcgaaggacatgatctcattctatcaatcaatgtgtagattgatttcaatttgcacatattgtgtagtattccatggtgtatatgagtcacattttctttattcagtccaccattggtgggcacctaggttgattccatgtctttgccattgtgaatagtactgtgataaacatgagtgcaggtgtcttttttggtagaatgatttatttttctttggatatatacccagcaatggagttgttgggtcaaatggtagttctgtttttagttctctgagaaatgtccaaactgctttttacagtggctgaagtaattttcattcccactgtgtttaggcattccctttttctctgcaaccttgcgagcatctgttatttttttgactttttaataataccaattctgactggtatgagatggtatctcattgtggttttgatttgcatctctctgatgagtagtgatactgagcattttttcatgtttgttggctgcttgtatgtcttcttagaagtgcccattcctttgctcactctgtaatggggttgtttttgtcctcttgatttgtttatggaagatttttctgtgtttactagccagttaatgtttcttttttgaataaatatttttctgtaacttcgtgtagtgttcttgggggaaaaaaaattcacagtgtgaatctctacccactattctgtccttccaagtgggagaggcatgctaacactgcttcctatccactatctggaaaacagcaacaacaacaacaaaaatactgtcaccacctttttttttttttttcaactttaagagttatgtgtaggatatgcaggtttgttacacagataaacgtatgctatggtggtttgctacacagttcatcccattgcctagatactaagccctgcatcccttagctattcttcctgatgctctccctccccacaccccctacccccaacagaccacagtgtgtgttgtttatgccattttgtccatgtggtctcatcattcagctcccacttaaaagtgagaatatgtggtgtttggttttctgttcctgtgttagtttgctgaggataatggcttccaactccttctgtgtccctgcaaaggatgtgatttcattccattttatggctgcatagtattccatggtgtatatgtatcacattttctttatccagtctatcattgatgggcatttaggttgattccgtgtctttactattgtcaatggtgctgcaatgaacatacacgttcctgtatccttataatatttaacagaatgatttatattcctttgtgtatatgccaagtaatgggattgctgggtcaaatggtaattttgttttcagttctttgagaaatctccgaactgcttttcacagtggctgacctaatttttattcccactgtgtttaagcattctcttttttctgcaaccttgccagcatctgttcttttacgactttttagtaatggccattctgactggcgtgagatgttatctcattgtggttttgatttgcatttctttaatgatcagtgatgtggagcttttttccccatattttttggccacatgtatatcttcttttgagaagagtctgtttatgtactttgtccactttgtcgtttgtttttttcttgtaaatttaagttccttgtagactctggatattagaccttggtcagatggatagattggagaaatttttttcccatttcatagattatgtgttctctctgatgatagtttcttttgctgtgcagaagctctttagtttaattattaatatatcccatttgccaatttttgcttttattgcaattgcttttggcatttttgtcatgaaatccttgcccatgtctacatcctgaatagtattgcctagattttcttctagagttttaatagtttcgggttttacatttaagtttttagtttatcttaagttaatatttgtataaggaaggggtccagtttcagttttctgcatatggctagccagcacttccagcactatttattaaatagggaaccctttccccattgctggcttttgtcaggtttgtcgaagatcagatggttgtaggtgtgtgatcttatttctgagttctctgttctgttccattggtctatgtgtctcttcttgtaccagtacaatgccatcttggttactgtagccttgtatattttgaagttgggtagcatgatacctccagctttgttcttttttcttaggattggcttgactattcgggctcttttttggttccatatgaattttaaaatcactttttctaaatatgtgaagaatgtcaatgttagtttaatgggaatagctttgaatctataaattacttagggcagtatggccattttcatgatgttcgttcttcctgtccatgagcatggaatgtttttccatttgtttgtgtcctctccgatttcctttgagcagtggtttgtaattctccttgaagagattctatacttcccttgttagctatattcctaggtattttattcattttgtagcaattgtgaatgggatggctctctgcctacttgttgttggtgtataggaatgctagagatttttgcacattgattttgtatcctgagactttgctaaagttgcttatcagcttaagaagcttttgggctgagatgatggggttttctagatataagatcatgttatctgcaaacaaatgtaatttgacttctctcttcctatttgaataccctttatttctttcttgcgcctgattaccctggccagaactttcaatactgtgttgaataggagtggtgagagagggcatccttgtcttgcgccagttttcaaggggaaatgcttccagcttttgcccattcagtatgatattggctgtgagtttgtcatatatggcttttattattttgaggtatgttcctttaatacctggtttattgagattttaacatgaagggatgtctcattttatcaaaggcttttcttgattgattgagataatcatgtggttttgtccttagttctgtttatgtgatgaatcacatttattgatttgtgtctgttgaaccaacgtcgcatcctggggatgaagccaacttgatctgatggataagcttttttatgtgctgctgaatttggtttgctagtagtttattgaggatttttgcattgatgttcatcaatggtattgacatgaagttttccttttttgttgtatttctgccaggttttggcatcaggatgatgctggcctcatagaatgagtaagggaggaatccctcttcagttttgtggaatagtttcagtagaaatgataccagctcttcattgtacctctggtagaattcagctgtgaatccatctggtcctaggctttttttggttggtaggctacttattgctgcctcagtttcagaacttgttgttggttctgatgccccatatcattgctgattgtgtttattggattcttctctcttttcttctttatcagtgtagctagtggtctattttactactttttttctaaaaacaggtcctggattggttgattttttttgaagagtttttcgtttgtctaactccttcagttcagctctgatcgtggtttcttgtcttctgctagctttggggtttgtttgctcttggctctcatgttcttttaattgagatgttaggttgttaacttgagatctttctagcgttttgatgtgggcatttagtgctataaatttttttattaacactgctttagttgcatccagagattctggtacattgtctctttgttctcattagtttcaaagtaattcttgatttctgccttaatttcattatttactcaagagtcattcaggagcaggttgttcaattttcatgtagttgtgtggttttgagtgaatttcttaatcttcagttctaatttgtgttgtggtctgaaagactgttacgatttcacttattttgcatttgctgaggaacgttttacttccaattatgtgatcgattttagagtaagtgccatgtggcaatgagaagaatgtatattctgttgggttttggtggagatttctgtaaatatctatcaagtccacttgatccagagctgagttcaggtcgtgaatatttttgttaattttctgtctcgatgatctgtctaatactgttaatggcgtgttaaggtctctcactattattgtgtgggagtctaagtctctttgtaggtctcttaagaatttgctttatgaatctgggtgcttctgtattgggtgcctatatatttaggatagttatttcttcttgaaccctttacaattatgtaacattcttttttgacctttgttggtttaaagtcagaaactaggattgcaaccccagctttttttctgttatccatttgcttgtaaattttcctccatctctttattttgagcctatgtgtgtctttccatgtgagatggatctcttgaagacagcgtgttgatgggtctccactctttatccagcttgccattctttgtcttttaattggggcatttaacccatttgcatttaaggttagtattgttatgtgtgaatttgatactgtcatcatgatgctagctggttattttgcagacatgtttatgtggttgattcatagtgtcactggtctgtgtacttcagtgtgtatttgtcatggctgccgacggtttttcttttccatacttaatgcttccttcagaagctcttgcaaggcaggcctggtggtgatgaattccctcagcatttgtttctccttcacttatgaagcttagtttggccagatatgaaattctggaaattcttttttttgggaattctttaagaaatgaattggaaattattttctttaagaatgttgaatattggctccaatctcttctggcttggagggtttcagctgagaggtctgctgttagtctgatgggcttccctttgtggatgacctagcctttctgtctggctgccccctaacatttcttctttcatttcaaccttggagaatctgatgattatatgtcttgtggttgatcttttcatggagtatcttactggggttctccacatttcctgaatttaaatgttgtcttttcctgctagattggggaagttctcctggatgaatatcctcaagtatgtttttcaacttggttctgttctccctgtttctttcaggtaccccatcagtcacagctccttttacataatcctatagttctcggaggttttgtttgttccttttcattcttttttgtttaatgtgtctacctgccttatttcagcaagatagttttcaagttctgaaattttttcctctgcttggtctgttcggttattgatacttgtggttgcattgtgaagttcttatgttgtgtttttcagctccatcaggtcatttatattcctctctaaactgattgttctcgtttacagctcctgtaatgttttatcatagtgcttcgtttctttgcattgggttagaacatgctcctttagcttagcgaagttccttattacccaccttttgaagcctacttccatcacttcagccatcttggcctcggcccagttctgtctgcttaggggagaggtgttgcagtcatttggaggagaagagacactctggccttttgaattttcagcatttttgctttgattttttctcatctttgtgggcttatctacctgtgatttttgagattgctgacctttgaatggggtttttctggagtcctttttgttgacgatgattttgttgctttctgtttgtttttaacggtcaagctgctcttctgtagggctgctgcagtttgctgagggttcactccagaccctagttgcttctgtttttcctgtacccagaggtatcaccagtgaaggctgtgaaacaacaaagatggcagccagatccttctggaagctctgtcctaggggggtacagacctattgccagcccaaacacacctatagcaggtggctggagacccttgttgtgagatcttatgcagataggaagaatgggatcagggacctgcttaaagaggcagtctggctgcttgttggtggagcaggtgtgctgtgttggggtggatcatttctcacccagactgtttggactctccagagccggctgagtggaacagctgagtcaaccgaactgcagagatggtagccgcttctcccactgggaactctgtctcaggaagagatcaaagctctgtctttataatcctggctggtgtggctgaagcctctgcagggaggtcctccccagtgaggaggaatggattggggtcctgcttaaagaagcagtctggccatgatcggatagagcagctatgctctgttggtgggggaaccttccttgtctggactgtttggactctccaaagctggcaggctggaacagctgagtcgaccaatctgcagagatggtggccaccctcccccggaagccctgtcccagggagagatcggagctctgtccttataaccctgactggagtggctaaagcttccacagggataagtgtattttttgcatctaaataagtatgtccttttcatatataatctatttattattcatttactgtctaagtatttgagtgactatgttttcccttctggggatatattagtttacaatattaagatcttttctcttgtgcaggttaaattttagcaggggtagcgtgcatagggagacagacaataagtgatagacatatgtaaattgagttacatgtcaagaagctgagaaatgctatggaaaaagaaaaagaactgggtaagggaaaatcaggagcagagagtcaggttgcagacagattacaattttaaataaagttggcaggatacgcctcattgagaagatgacatttcagcaatgacctgaaggaattgagggaattaacaattcaaatactgagggaaaatatattcccaccagagtgtctagctgatgcagaggttctaatgcaagaacatactttatgtaagaagacagcaaagtgtatggctagaacacagcaaggagaagagatgagataacagaagaatgaggtgccagataatatcaggcttctaagtgttaggattttaatcattgacccatagaagcattttgtagatcaatattttgcatgtcactttacattttgacatcatttaaattagtgtgtgatgttcttgacagttaaaaaatgtctatatcagaactatcagtcttttaaaatttcttcataatttttatacttaagagttttgcagggggttttttgttcttttgtttttgtttttttgaaagagtctcactcagtcgcccaggctggagtgcggtgatgcagtctcggctcactgcatcctccacctcctagtaggttcaagtgattctcctgcctcagcctcgcatgtggttgggattacaggcgtgcatcaccacgcccagctaatttttttttttttttttttttttttttttttttttttagtagagatggagtttcaccataatggccagagtggtctcgaactcctcacctcaggtgatccacctgcctcagcctcccaaagtgctgggattataggcaggagccactgagcccacccacttagagttttaattctattaattatcctttctatatatcaaacatactgaagtcaaaacaaaatagtaacttttcacttgtccaaggaaattgacaaatctttaattctctccttttgtagcttgctttcttctgcctttgtaaatttaagtggatgccagtagttttaagaaactttacagtagttgtaaggaatattttaacactttgaatatatcatctcattgccttcttttttttttttattatactttaagttctagggtacatgtgcacaacatgcaggtttgatacataggtatatatgtgccatgatggtttgctgtacctatcaactcatcatttacattaggtatgtctcctaatgctatccctccctcaggcccccatccctcaacaggccctggtgggtgatgttcccttccctgtgtccaaggccctgtgtccaattgatctcattgttcaattcccacctatgagtgagaacatgtggtatttggttttccgtccttatagtttcctgaaaatgatggtttccagcttcatccatgtcccggcaaaggacatgaactcatccttttttatggctgcatagtattccatggtgtatacgtgccacattttcttaatccagtctatcattgatggacatttgggttggttccaagtctttgctattgtcaatagtgccacaataaacatacatgtgcatgtgtctttatagtagcatgatttataatcctttgggtatataagcagtaatgggattgctgggtcaaatattaattctagtttagatccttgaggaatcaccacactgtcttccacaaaggttgaactaatttacactcacaccaacagtgtaaaagcgttcctatttctccacatcctctccagcatctgttgtttcctgactttttaaatgattgctattctaactggtgtgagatggtatctcattgtggttttgatttgcacttctctgatgaccagtgatgagcatttttccatgtgtctgttggttgtgtagatgtcttcttttgagaagtgtctattcatatcctttgcccactttttgatggggttgtttgtttttttcttataagtttgtttgagttctttgtagaattctggaatattagccctttgtcagatgggtagattgcaaaaattttctcccattctgtaagttgcctgttcactctgatgatagtttcttttgctgtggagaagctctttagtttaattagatcccatttgtcaattttggcttttgttgccattgcttttggtgttttagtcatgaagtccttgaccatgcctatgtcctaaatggtattgcctaggttttcttctaggggttttgtggttttaggtctaacatttaggtctctaatccatcttgaattaatttttgtataaggtgtaaggaaaggatccaatttcagctttctacatatggctagccagttttcccagcaccatttattaaatagggaatcctttccccatttcttgtttttgtcagatttgtcaaagatcagatggttgtagatgtgtggtattatttctgagggctctgttctgttccattggtctatacctctgttttggtaccagtaccatgctgttttggttactgtagccttgtagtatagtttgaagtcaggtagcgtgatgcctccagctttgttcttttggcttaggattgtcttggcaatgcaggctgttttttggttccatatgaactttaaagtagttttttccaattctgtgaagaaagtcattggtagcttgatggggatggcactgaatctatgaattaccttgggcagtgcggccattttcatgatattgagtcttcctatccatgagcatggaatattcttccatttgtttgtgtcctcttttatttctttgagcagtggtttgtagttctctttgaagaggtccttcacatcccttgtaagttggattactaggtattttattctctttgtagcaattctgaatgggagttcactcatgatttggctctctctttgtctgttaatggtgtataggaatgcttgtgatttttgcacattgattttgtatccagagactttgctgaagttgcttatcagctaaaggatattttgggttcagacgatggggttttctaaatatacaatcatgtcatctgcaaacagggacaatttgactttctcattttctaattgaacaccctttatttctttctcttgcctgactgccctggccagaacttccaacactatgttgaataggagtggtgagagagagcatccctgtcttgtgcccgttttcaaagggaatgcttccagtttttgcccattcagtatgatattggctgtgggtttgtcataaatagctcttattattttgagatatgttccatcaatacctagtttattgagagtttttagcatgaagggctgttgaattttgttaaaggccttttctgcatctattgagataatcatgtggtttttgttgttgattctgtttatgtgatggattacatttattgatttgcatatgttgaaccagtcttgcatcccagggatgaagcccacttgatcatggtggataagctttttgatgtgctgctggatttggtttgccagtattttattgaggatttttgcattgatgttcatcagggatattggtctaaaattctcttttttttgttgtgtttctgccaggctttggtgtcaggatgatattggcctcataagttgagttagggaggattctctctttttctattgattggaatagtttcagagggaatggtaccagctcctctttgtacctcttgtagaattcggctgtgaatccatctggtcctggactttttttagttggtaggctattaattattgcctcaatttcagagcctgttatttgtctattcagagattcagcttcttcctggtttagtcttgggagggtgtatgtgtccaggaatttatccatttcttctagattttctagtttatttgcgtagaggtgtttatagtattctctgatggtagtttgtatttctgtgggatcagtggtgatatcccatttatcattttttattgtgtctatttgattcttctttcttttcttctttattagtcttgctagcagtctatcaattttgttcttttcaaaaaaccagctcctggattcattgattttttgaagggttttttatgtctctatctccttcagttctgctctgatcttagttatttcttgcgttctgctagcttttgaatgtgtttgctcttgcttctctagttctttcagttgtgatgttagggtgttgattttagatctttcctgctttctcttataggcatttagtagtataaatttccctctacacactgctttaaatgtgtcccaaagattctggtacgttgtgtctttgttttcgttggtttcaaagaacatctttatttctgccttcattcgttatttatccagtagtcattcaggatcaagttgttcagttttcatgtagttgagtggttttgagtgagtttcttaatcctgagttctaatttgattgcactgtgatctgagagacagtttgttgtgatttgtgttcttttatatttgctgaagagtggtttacttccagttatgtagtcgattttagaataggtgcaatgcggtgctccaaagaatgtatattctgttgatttggggtggagagttctgtagatgtctgttaggtctgcttggtgcagagctgagttcaggtcctggatatccttgttaacatttgtcttgttgatctgtctaatattgacagtggggtgttaaagtctcccattattattgtgtgggagtctaagtctctttgtaggtctctgaggacttgctttatgaatctgggtgctcctgtattgggtgcatatatatttgggatagttagctattcttgttcaattcatccgtttaccattatgtactggccttttttgtctcttttaatctttgttggtttaaagtctgttttatcagagactaggattgcaacccctgctcttttttctttccatttgcttggtagatcttcctccatccctttatttgagcctatgtgtgtctctgcacatgagatgggtctcctgaagacagcacactgatgggtcttgactctttatccaatttccagtctctgtcttttaattggggcttttagcccatttaaatttcaggttaatattgttatgtgtaaatttgatcccgttattatgatgtttgctggttattttgcctgttaattgatgcagtttcttcatagcaccaatggtctttacagtttggcatgtttttgcagtggctggtactggttgttcctttccatgtttagtgcttccttcaggagctcttgtaaggcaggcctcgtggtgacagaatctctcagcatttgcttgtctgtaaaggattttatttctccttcacttatgaagattagtttggctggatattaaattctgggctgaaaattctttcctttaagaatgttgaatattgtcccccactctcttctggcttgtagggtttctgctgagaggtccgttgttagtctgatgggcttccctttgtcgataactcgacctttctctctggttgcccttaacagtttttttttttttttttttttagtgggcaggaatcttttttattattattattattattattattattattatacttcaagttttagggtacatgtgcacattgtgccggttagttacatatgtatacatgtgccatgctggtgcgctgcacccactaactcgtcatctagcattaggtatatctcccgatgctatccctcccccctccccccaccccacaacagtccccagtatgtgatattccccttcctgtgtccacgtgatctcattgttcaattcccacctatgagtgagaatatgcggtgtttgtttttttgttcttgcgatagtttactgagaatgatgatttccagtttcatccatgtccctacaaaggacatgaactcatcattttttatggctgcatagtattccatggtgtatacgtgccacattttcttaatccagtctatcattgttggacatttgggttggttccaagtctttgctattgtgaataatgccgcaataaacatacgtgtgcgtgtgtctttatagcagcatgattcatagtcctttgggtatatacccagtaatgggatggctgggtcaaatgacaagcaatggggaaaggattccctatttaataaatggtgctgggaaaactggctagccatatgtagaaagctgaaactggatcccttccttacaccttatacaaaaatcaattcaaggtggattaaagacttaaacgttagacctaaaaccataaaaaccctacaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaactagttcaaccattgtggaagtcagtgtggcgattcctcagggatctagaactggaaatgcccttaacagtttttccttcatttcaactttggtgaatctcacgattatgtgtcttggggttgttcttcttgaggagtatttttgtgatgttctctgtatttcctgaatttgaacattggcctgccttgctaggttggggaagttctcctggatgatatcctgaatagtgttttccaacatggttccattctccccatcactttcaggtacaccagtcatacgtagatttggtcttttcacatagttccatatttcttggaggctttgtttgtttctttttagtcttttttctctaagcttgtcttctcactttatttcattaatttgatcttcaatcactgataccctttcttccacttgattgaatctgctattgaagcttgtgcatgtgtcacgaagttctcatgccatggttttcagctccatcacgtcatttaaggtcttctctacactgtttattatggttagccatttgtcttatcttttttctaggtttttagcttccttgagatgggttcgaatatccttctttagctcagagaagtttgttattaccaaccttctgaagcctacttctgtcaactcatcaaagtcattctctgtccagctttgttctgttgctggcgaggagctgcgatcctttggaggagaagaggccctttgatttttagaattttcagcttttctgttgtactttctccccatctttgtggtgttatctacctttggtctttgatgttggtgacctacagatgtggttttggtgtagatgacctttttgttgatgttgatgctattcctttctgtttgttagttttccttctaacaggtccctcagctgcaagtctgttggagtttcctggagttatgctgcaaatcctttttgcctgggtatcaccagcggaggctgcagaacagcaaatattgctgcctgatccttctctttgtcccagaggggcagctgcctatatgaggtgtctgtcggcccctgttgggaggtgtctcccagttaggctacatggggacccacttgaggaggcagtctgtccattctcagagctcaaacaccatgcttggagaagcattgctctcttcagagctgtcagacaaggacgtttaagtctgcagaagttgtctgctgccttttgttctgctaagccctgcccacacaggtggagtttagaggcagtaggcctcgctgagctgcggtgggctgcccctagttcgagcttcccagccgctttgtttacgtactcaagcctcagcaatggtggacgcccctcccccagccaggctgccagcttgcagttcaatctcagacagctgcgctagcagtgagcaaggctccgtgggtgtgggacctgccgtgtcgggcacgggagagaatcaccttgtctgctggttgctaagaccttgggaaaatcacagtatttgggcagaagtgtcccatttttccaggtagtctgtcacaccttcccttggctaggaaagggaaattcccccaccccttgtgctttccaggtgaggcgatgccctgcctgggctgcacccactttccaaccagtcccattgagatgaaccaggtacctgagctggaaatgcaggaatcacccatctgctgcatcggtcacactgggagctgcagactggagctgttcctattcggccatcttggaacgcccccatctgattgccttctggcttctgttgtttctgataagaagttagcctttattgttactgagattcttttgtatacagtgaaaaaagcatttctcttcttttcaagattttagcttttgcttttaacattttgactggtgtgtctggctgtggatatctttacatttatccttattggagtacattgagcttcttaaatttgtaaactatgttattaatcaaaattgggaatttttcagtagtttttaaaagtatcttctatgtttctttttccttgtcttcctgggtcttctataatgcatatgttggcatgcttaatggtgtcccacgtttctctgagaaactgttcatttttttcagtctttttacattctgttctccagattgtataatctttattgatttatcttccagttgccattccaagttgtttacacagaaaatacatacatagccacatataaattattagaattaattatatagtttaaggttgtttaataccagtcaatgtccaataattaattatatttctaagagctgcaacaaacgagaaatgcagtttaaataaatataccgtttacaatagtatgaaaaatatcaaacactggaaatttttgtggaaattgtcaagcagattcaaaaactcatccagaaattcaaagtaccaagagtagctaaaataatcttaaagcataaaaagtgataattgctttactggatatcaagatctttgataaaactacgtaattgaaaacagtttggtatcagcacaaggatagaaaaatagagcaatggaagaagaatagagaacccagaagtagagccatgcatatattaacacttgatttataacaaagttggctttatggaacagtaagggtaatctttgacacttcccccttttcacgtcatacacaaaaattgattccagatggattatagagctaaacataaaaggcaaaacaataaatcttcttaaagataatgtatactttaaagttcatatggaaccaaaaaagagcccgcatcaccaagtcaatcctaagccaaaagaacaaagctggaggcatcacactatctgacttcaaactatactacaaggctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattgaagatggattaaagacttaaacgttagacctaaaaccataaaaaggggatcctctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactctggggactgttgtggggtgggggggaggggggagggatagcattaggagatatacctaatgctagatgacgagttaatgggtgcagtgcaccagcatggcacatgtatacatatgtaactaacctgcacaatgtgcacatgtaccctaaaacttaaagtttaataataaaaaaaagataatatagattatcttttttactttagagtagagaaaggtttctaaaatgagacccaaaacacagtagccatcaggtataataccaataaatggaactactttaaaattaaggactgcttcccattataacacatcatcagtacactacaaaacaagccatagaatgggagaagcatatctctacacatataaccaaaaaaagcccttaagtcttagaaatccaactcctccaagtcaggggccaaaaaagataatccaaaaaatactggaagcagattgaacaggcaagtcataaaagaagccaaagaacatatcaaaggatgtttagtattgttaatgataagagaaaagaaaattaaaaccctgatgagatatctttacatatgtacgagaatgatttaaattaaaatctgacaatacaaagtgtttcttaggctgtgaggtaatggaactgtttgttatctgttgctagtatgtatattactttgaaaaactatttagcatcttctgaagtggaagatatgtatatcctatttttagagctctaaactggaagaaactcagatgtccagcaacagtagaatagataaaagactgtatattcatatgatggaattctgtacagtactaaaaattgactacagctacagaaaacagtattgataaatctcacattattgagtggggaaagaacacaaaataatactgcatgactccatttatatgaaatttaaaattgattaaatgtttagcagtgcaagtttaggggataaactataaagaagagcaaagttgttattaccataaatgacaagagagtggttgtctttagaaaagtgggagggtgtggtaattgacagagatctgcggaatctttttggagttgctggcagtgccagtgaccaggatagtaggtttatgggttaattcactgagctctacattttgttttgtgtattttttatttgtgttatttcacatacaaaaagcttaaatataatgttacattacaaatgaatcattatgcaaatatctgaaggaattagagttagtaaaatgattgttaggctttttcagtggtatatcacatttagtacagtaaacatgggagggctttgatagtgaaagatggtgcatgatacagtgaacaaactggatgggaaagaaaatatattcacctgtaaaatgatatgtatgatactggtctttttaatctataaatatgtttgcagaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggtcagtagctatttgaaatattaaatatgtatgtattgcatattttaaaagtgtgagtgtatttggagatattgttactgaaaaacaatggtagatttaaacaaatgaagataataaacattccttttcaaatgggaaaagataaacattaaatgatatgactctgcacagaggcatttaataaatcagatttcatatgtttcattaactacttcatgattcttaaagttgatggcattctagttaggatatgtacttaagtgaagaattgggggttaaagcgttacgtaaatctcaggtatttcactgaaggggtccattatggggggggtttcaacgatgatcctcttgaagaaacaatcattattcattcaaaaaatacatattgatcgtttatgagacaatggagataaacttgtgaacaagcagatagagtccctgtccctgttctttgtggagcttacattgtaggaggaaagacagacaaaatatttataagtggttttgattgatttgcttccaaaagtcaggtcattagctaaggattagagtggcagtatgtatttttaaagggtcgaggacaaaaagaggaaatgttgaatattttactattattctgagagtgagaaagtaaattaaatacattagtgaaggaagatttctggtcattgctgagggtccacttgagattaatgacaataaattcaaagtgagatcagccttggtcgtatatttttctccaactgtattttactgttttcatccagttgcagactcagcagagttgtgtttaaccaaggctggggtttggaccagtgaatatgactgagagggagcattcaagggagctaaacatggagaagttttggttatagtaaagtaccctgagatagaacttggttaaaaggaaattacgccatgggaaggatgatagacagtgaataaatggtagagtctgtggactgaaagtttgagtaatggttgatctagggatggtgatggtcatgtggttgtggtcagaaaggggatgattgaaatggggattttggaggtaaagatcagggcctacatggtccaacaccacagccactggctacatatggccattttatacttaaataagattttaaattcagttcctcagtcatagtagccacattttgaaagccgcataaccatatgaagccatggctgccatattggacaatgcaggaaaacattttcatcatcatgaaagcatctgggaacttgttagaaattcagaatttaaggcctggattctactgaagtatattctgcattttaataagataccaggtgattggtatgtacattaaagtttgagaagtactgagagagagaaatgtaccttagtatgaaggtgcaatgagcatgtatgtggtttattttctgtgaatgtccatatatttttttactttgaccaagcattacttttattatttccatatttaaatatattattactaaactggtcttctgggattagtataatggggagaaaggagtatttccattttaaacactttttaaattgatagtaccaaataagaggtactgagttcagaatttaataaatatttaatttcattttcttcatatcaaattttatttaaattgatgttccctagtaatttactagtctggtagtttccctgaaattctcaaagaatgaatagcaaactgtatcaacttgtaacaagatttaagcatgttataaatgacttgtcaaaacagaattctttttttaaaaatgttctttcaaagaaaattataccaaataatgattttgaaagtattatttaaaattttatactaatattagttttttaaacaaaatgatttaatatatttactgttctcatattagtttcatcagtcttaacttttgctttaggggatggataagaatgcttttgagaaaaaatataatactgttggagtgaatatttttcgaactcaccagttgttctgtcaagatgtacttaaattacgtcctggagaaatgggtattgtcagcaatgggagagtaagtagaaaaagctattgctctcttttctcagtgacactgcagtgcactggtctgccttttttctgtcacaattcccctgatgtgactgacacacacagaggacggtgttcatgagctgaagacaccagacacaactcagcataaataaaatggggtcatgacacacttcccattccttcattctttcccccatttaatgagaatgatgatgtgggtaaggaagaatgttctttatgtgtcttgcttttattttgttctaatgtaagtattagaaggaacaacttaatgcacatcttcaaaacattgtcattagaaccactgttgtagtaggtgtagcaagtaggttatgacatctttcttcttgttcctacagttgtgtatgttaaatggcattagatactattttcagttttgaagtatcaagtagtataaattgccatgtagtatttattaataaaatatttacaaggctgtaggaagaaaatctcttactctccaaccaccctaataaaacttaatagcttattgtttttcctttcagcccttttttctaccatacatagatagccatttttggttttttagaatacatccttataatcctactatatataattttacatcatgatttttctgttaatataaatgtttttctgattgcagtctttgtagacacatacaaaataagtggatgatatctatatactaatatttttaatatgatagtcttatttcatacaaattgtttaagtaaaaaactgaatctggtgcttaggtttattaagaaatcaacaaatgcagtgtttttcacgtatctgtggcttgaattttcaaattatatatccctcaatcatcttcaaagttctaatgcactcttaatgttttgtttttcacttacttttgaattctgttcacctgcatattagattcaggttcatctatgtacagtgctattttacacatgtcaaaagctgccatttattgtaaaaagtattggtgaattttggtagtgagatatgtagagctctgtaaatggcattgctttttcactttaaaagttactttgggaggaaatacagcttttaaaaacagttctaaagcttttggctgtctttgaccatgtcaagcattttaagggataaagagggaaacaatggcacctgttttatctagtgccttaccttttagttatatactagggaaaagctatcctatgtcttgtcattttgatataattcatatagtgttattgacattaatgataacaaatactagatacagttatgttcaacttatttctcataaacataaaactatgttttgtcctgactttccttaaaattgataaaaatattaagatattaatcttacacctactgtgaaccaaacattcttctagattctgaaggcacagcagtaaacaactacgttttcatggggctaatattttgatggatagagagagacaacaaacagcacccttactgataaggcatctatcttaagtatgtttatgctgctataaaaatatgccacagactggctaatttataaagaacataaatttatttcttatacttctggatgcttggaaatgtaaggctgacgtgctgccatggatgtctggtgagggctgctctctgcttccaggatggctccttgttgctctgtttttacatggtggaaagtagaagggcaacagagtgctcccttcagtcttgaactcttttattataaggatacaaattccattcatgagggcagagccctcgtggcttaatcatctcccaaaggccacacctctcagtgctatcgcactggccactaagtttcaacacatgggttttgagggacacgttttgtcttaatctgttttgtgctgctgtaacaaaatacctgagactatataatctcagaaatctattaaagaacagaaatttattctctcatacttctggaggctgggaagtccaagatcaaggcactggcatctgatgggagctttcttgctgcatcctcatacggcagaaggcagtggggcaaaaaggggatgagtgctatgttcctacatggcaggagagagcaaacccactcctgaaagcctttttatagtggcattagtccattttgaggcacagccctcatgacctaaacacctcccattaggccccagctcccaacactgttgcattggggattcagttttaacataaattttggagaggacaaagacattcaaaccatagcacattcatagcagtgtcatatgggcaaagaaccaaagaaggtgaaggaggaagccatgtcaaatatctggaagaggattgttctagacagagtacagtgaatgcaaaggacgtgaggtgagttcatgtctgtgaatcctgtgaatcatgtctgctattctaagaatagcaggtaggaagagagcaggcaggagagaagccagagaagtagctgggggccagatcatattgggttttataggaagtttaaggactcccactttactctgaatgagttgggaagtgcatagttctgggcaggagattggcatcatctagcttatgttttatttggatcactagaggctgttacattgggaatatacaatagggggtcagggagccagttgggagataatgcagtagtccagatgagagatgatggtggcttggaccagaatggttctagtggtggtagtaagaagtggatatgggatgtattttatgtgaagaatggacaggaattgtccagggactttggtgtgagatgtgagagaactaagttactggcagaatggagttactgtggatcaaggtgaggaaggctgcaggatgagtgaggttgtcaggagcagtataagaagaaggaaagagaattcagtttggacctccaaaaagacttgttaagaaggtgattgaatatgagtgtagtacagaggaaggattggggctggagatagatattaagtcaaattatgttgattttttctgttgactaatggaaaaatgtaatttcaattatccttttatttgtataactgtggttttaatagaaaagtatattggaaaataagtctgtggtttatgagcgataatgtaatacttagcttatcactctgaaagtaatgctgttaagcataataatcacagcaatgtggcagatgttataaaaatttggaatcagatagtttaatgcttgaaataagtatgatattttagtataaatcttcattctgagcctgttcaaatgtttccattagaattggaacatatgaaaagttaaaattgtttataaatgatcaacaactagggtacaatgatgatcacacagtttcttaaaaacactgaataatttaaaattgacatatttaatattaatgccacaaataatgccattgttataataatatttatttgtattacactacatattcacagtttgctgaaagacatggggtagcagggagtagggaacaaaagcagggtcttttttttgttttatagtcagatctggattcaaattccagttgcaccattaattacattacactgtgagacctgatttcttcatttggacaatgagaatgataataatctgtcttacaggattgttggggtgattaaatatgctcctatatttaaagcacatagaaggaacccaaacacagagtaaattttcagtaaatattaactgctattttctctcaatatttgaagggcatcatgaaaaataatgggcatttgtagacttaatttgtgttacactagctaaaagttagcataaaatcaaaactagttgatcaaacttctgtgagtagagagacatttttagctcagtatgtggatgaaaatctgacagagttttctgcaattttcatgacctgtcaaatgaagtaatgcatttctgttacagcaattattctatgtaactgaaaaatcacatttctcaaatgttatgaagaagatttaagcaacataattttcaagtttattgttcttttacccaacttggacattatgtgattttatgctatttaagttactttattccacaaattttcagctttaaatagaaccaagacacagaaacattaggtttctcctgtttgatgctgtgcttaatgtaagcaaaatacagccagttttctggtaaatttaatcagtaaagatagccaatgtagttaaccccttaagacaatacttttaagattttatttccttattctaatgttactaacaaaactgcccctgtcgctagaggtagtatagataagattcaactgttttccaagactgctgattcattgttcagaaatgtaacattgaatgtgctttcaaagttgctttaaaaattatatcacgtcttaagacaatgaaatgtttatatgagtacttttagtattatagtgcccatttttgtgtttttaagagcccgtgttttatatttaaggtgaaacatgatatttatttagttgagatgccaaaatcccagttagtcacctttgatatgagaaaatgggatagaaagattcaagaactatgcttcagtaatttttagaaaagatgaactgtaggagcaggtgaaggggaagtgagaaaatctggctacagccattacattctggtctttttaccaagaaaaaaataatctggttgacgtgttttctgattatcattaaatataattgttttgtacataggattatgtcagtctacagtagggttttgtgtacgtggtgttagaatgattgttatgtactaatttcctcagaaagtgctcatggtagtagagtcagtagtggttgtgatgggagagccattctgagaaattaggtatgtggcaatttggcagcttctaactttgtagttactggtttaaagttaatataggtgaccttgctaggctcctaaccatttatacagtatcagttaaaagaagactggttggtattattatagtaagtatgtgatttttatgtgatttttctcttgggttttgctattttatggctttcttataaagtaattcatgtctatatagtgtagagtacaatttatagatgaaggtgaaagaaaattgaaattaaaagatttttaaaaatatagaccattgctttcaaaattgaattcagattgaaatggtatttggaagcatcatgatttatgtttcaaatcacgatttatgatttatgtttcaaatcatgatttatgatttatgtttcaaagtaaaactttctaatggaaataatttgctaattttttatattgtcactttgattttggtgtttatacaaatgttatttgtaatatcaaagtgagaaagtatatcttgtttcctagcgtatttagtaaatggcaggattaatagctaccatatctttaatctctaattcatttttgcttaataaagaaatatctatttgatgaggaaatgtttttcctaaactgatatcttctagaagatatatgataatataactgtttttattttaagttcttaggacctttagatgaagatttttatgcagaagatttttacttgttggaaaagataacatttagtaatttaggagagaaaattaaaggcattgttgaaaatatgggaatcaacgcaaataagtgagtatataagttctaagagcaattcattttgggtttggtattttgagtctaatgtttttaagattagaaaatgtttcaaatatatagacaagtaaaggtataataaaagacatatataaagaatataagcaaataataaaaggcatccatttactcaccatcacaaaactgtagatgttaatgttttctttgccttggctctgtctttctccttgtttcttacccatccaccccagtctcctccctccccaagaggtaaccattttcctatagattgtatgcatggttcccatatttgtctttttgcttcatgtgtaaatatccattattggtgtttattgtgttgaaggctgtgactgttttagagaaatgctattatacgtaggtctccctttgcagtctactttggtagatttaaccatgttcagatatataaaacctttcttgaagcattaattgtaacatgaaatatggaactctttccaaaaaactcatacactgtttgtcttgtttatctagcatgagtgactttattatgaaagttgatgcccttatgtcctctgtgcctaagcgtgcatctcgatatgatgtcacatttcttagggagaatcacaggtaagaatgtattcgtatttgtttgtgatttttctgttaatgcatgcaattatttccatttgttttcataacatggtaaaatttaaggtagaattaaaagttatttattagggaataaatgtatttgacagtattaggaagataaattccagttagttatatattctagtaaataaagggtaatatatatggagagagagtgtacgaaatttcaagtaagttaaacatgttataatttgtcatatttttaatatctttcatacttaagatcatttgtaatttttgcagtatctcaagatagtcataaataatattatctttatattttcaatgtgtaaagtgactgaagagttctgattaatcaaatgtagggtggcctctgtcacaaagctaaacacacatgcatgcgcgagagttcaaaggagtgaagagagggtccaggcaaagctgaactgttgtaggcccggctgctgcctcaggccagcaaggtgaatcagcagatcagcagcaagtgtgtgagctgcaaaattgctgctgctgcctctctgttctctagatctcctgagaatctctgttgttgcccgcccaagcaagaaacattctggaaaatatgatttagcctggtcaagttgacacattataaagctgctgcgtggaccaagggtccaaggatttactctgtcaggctcctgtggtaggatggaaataaaaggctgtttaatcactatcatatgtgatttctatgcccatattctctatgagagtgcctcgttaattgtaaaagtagctaaactgctttttaaaaaaatactactgaagattccctgagctcactcaagtgtcttacagttatcacctttagtaattttctctagaaataccattttttgtctgtcaaagagcattctttcctatcaagggagataataatataaatacggttaaatttatatgtaaatttctacattaaagtcacactctgttattgaattttagaaaatgtcagtgaacctttggaaattgataattaggataatacagtatgccacagtgatgggcaaatacttcaggtcactttacatttgaatttatgaattatcagtattacttccatagttatatctgtatatttcatgagcatatgcatttacttctaaaatcacataaaaatatttattcacagctttttagagagatgtgtgtgtatacatgtatatatatatttaaacacagtattatatctttgccattctgcttctatgtctatagggagtcattttataattaaatatgttaaaacacttgttataaatccgttatttctgtattgatatgtttgatcttaattccaacttttaaaatttaaattggcttataagaaaatttaaatttgacagggtaacttaaattagaaggtttgcaaaaggagaaagagtaggagtatattgaaatctggaataaagtgaaaaatgagaaaaaacaattatattttttccccagccctgaaagatctctatattagcctattcccttccatttagactctgtggatttgacattcttctaacatcttagacaaaggcaaaaatagcaatcctaactactcaccccatcatcccaggaacttacaacattgaatgtaagttgtgtgagaaactatgaggtcttgaaggaagccttgcaggctgcggcaataatgaccctcctgtcatgagcataccatgaatttggctctaagttttccagtttatacagttcccaagttcatgagaggaaaacaaactagatgttcagatgaagtgtaattattcttagaagagggaagacagaggaatttctcccgggagcctttataaagaggatgctatataatgaacagtgttttcaatattcttaaaatagattacttgacctattttatagataggttaacagtatcataacaaaattcaactcagagttttctattgcaacggcctgtttgaaatgtgttcaatatatctgtaagagttgattaactgtgtatacctaagcagttcttcacccttttttttctgacatggactttaataattaattaactgtcactgtgcttgacagtattcttctggctaatgacatgaagtgtatcaatagttttttggcaattgagtacaaatctgttaccttaaataggtggtagttagcatcttgttgttaatattgcatgagaaataggatgttctgttctattcttgggttagtcagtgtactatctactagtgggctcaggattctactcagaactgtcttgtacatgtataatcagatggtggggactatggaattctgcttcatacaacttcatagaattagcagtctgggagaaaaaagcagcagtaaacaggtgcatgctgaaaccataattacatctcatacagcatacataaaatgaccagttttgagtggtgttacaaagtagggtagtaatttgtaaagtgttcaccaaggtaactacaggaagcaacaattgtcaagagtcactttaatagcagaacgtctgatttgtggctcttaggtctagcaataattatccattaaggtctgttgtctgactatgcccctcttattttaagataattaaatcgtcaactgcctagaaaataaaatgtcttgcagttttctatttagatgacccatatttgaagtaagtgtttatattagctttttaaaaattgctgagcaattaatcccctcactgcagaagccttttcctaccaaagaaactaatattcctgtaactacacatgtacctcttgatttggtaacctttttcctttgtaatatgtaaaatgtataattaattcatcctacatctgagaaaaatatttcctacatgattatagtgttaaaacagtaattcagtaacatattctctgcttttaatcaaatatacatgattaacttttaattatattaaatgtagaattgactgtctccctctggcctgttctgtacttttaatcattttctcatttccctttaaaaaactagtccatcttctaatttagaacttttatcggtgaaagataaaaacggataggacagagggaatgaggtgaggagaggaagactgggatcaaaataaagtatgattaatttggatatttttgttcctgaacttacctgttatagtatattgattttttgaaatactaaatttaataaagtatgaatagttaattttattctcaaatctaaagaaatatattccactaacacaaaagcatcttagctttattttttaaattgtacaatccatgagaatgttgagggcctaaaattatcagagtttttacactaatgggatcattctttgaaaggcttttaaaaaatcatttcattcataaaaccttacttcattttctctcattcttttcagttttgtaatttgttgaaaacagattttcagatttgcaagcattgtgtgaaataaccagtattttacaattttagtgagaaagaaaacaatttataagaattatatagctaagatcatgattagttgtttgtataaacttaacacgtcatctttcatcttattttctattttcttagtgttataaagacgaatcctcaagagaatgatatgttcttcaatgtcattgctattgttgatccattaacaagagaagcacagaaaatggcacagttgttggttgtaagataatataaattagactaaatgtttttgtttttaaattcataattttttcaagtctgttttcaaatataatcagctgtttatgctcttgatccttcaccattttaatagagtgtcatatttcaatgtagaaaatgaaatgatggagctgtgcacagggtgttgttatgactgtgctgaggttaggtgttgctgtgaactgcattgtattccccacaaaattcatatttcaacacatgaaataggtctcagtgaactttaagccctaactcccaatgtgactctctctggagatagggctttaaggggatcattaaggttaaatgaggttatatgggtgagaccctgatccaataggattggtggccttaaaagatgaacagagggagacttcacaaagaagaggttatttgagcacacagtgacatgttagccccgtgcaaactagaaagagagctctctccagaaaccaaatcagctggcatcttgatcttggaattcccagcctccagaactatgagaaaataaatttctattgtttaaaccactccatctgtggtgttttgttatattagcctgagaagactaatacaggtgtctttcatatgttgtgaagtgtggcttttggagaagctgaagcttaagcttaattggataaaacttaaagtgtaataaataataaataatgttagccaaacaagtgaagccgaggaaaggggaaacatggagtttgtattctataggtttggccgctataacaaaggccaaaataacactactttcaagactgaagtttctttctttcatctcctggtctaagtgtaggctgccttggggttgctaaggcagctacacagtgtgagggactcaggcactgcctgtgtcattgttgagctgtcacgaagcacctaagatcaccagtcaggccctaacatcatctctgcacttctgccaggaggaaggggagaataagagcacagccccaaagttagatgtatgctgtcctatcacttctcactgaccagaatgtccgcaggctggctacactgaatgacaagggaggctggaaactatgcccacaagtcctgcattaacctggaaattctttccctgtgaaagaggaaaatgaatgcgaagagacagatatcagtctccaaaaggacttatgtggcttaccattttacttagaatgtcaaacattcaaattagaatgcagccttcagtagttaaatttgaataagctagtcccattagaaggctgtatgtttttctactgatatcgaaaattttacaaactatttgtcctttggtagtcaacttcacttttgaaacaggcaaaagtaattagatattgagtctggtgaaaatgtaagtgatcaagccatatgattcgctgtatatcaaaatttcaaaatgcaattttttttagaatttagtgcgcactgccaaatctcattggaaaatgagattttattagtggagacaaataattttggaaagactttgtcattctagctgttcagtttatgaaacgagtaggacaaaccatagctgatttacctacttgttcttttagcattggttataccttcaaatttatatgtcttgagatacactattcagattattctttagaaagcaatcatatctgaaaggagtggagctagtatgatgctttttagtatgcaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtctctaaaaaaataaaaaataaattagtcaaacatgatgctgcatacttctagtcatagttactactcaggaggctgaggtgggagaattggttgagcccaggaatttgaagttaacagtgacctatgatcacaccactgcagtctagccttggcaacagagcaggactatgtctcttaaaaaaaaaaaaggaattatacagagatataaaatatggaattgcattccagtttccatcattggtaataatagcatactttatttcttactttataaaaggataatttattggaagaaatggatagtttctcatctaacacttgagaaaaacagtggttcagtgacctccagagtagcagatatgatgagtgatagaataagaattgaaagtcaaatctcttaaatccttagtctttatgttctaatttctcatcaagcctgtatcctttctattacatatatctgttttgttacttctccctttacctatatcatttgttatctaacagctttagaatcttcactgacatgttgcctatgtggagatggggactatcaaaattagtaattcttcctctacttcttactatccagggaaatgaaaagaaagtatttattcgtaggtagccaagaacttccaaatcccaaaagaatcaggacaccaccaacgttgttgtaaggtcaccactttgtatttgcagatcaaggttctagtaattattttccttgttcttcaatactaaggaaatttagatactatgaaaaaaagtcactttaggcaaagggcaagcagcataaccctgggacattgaaatcaactgtttggattaaaatcttgcctgtgctgtgagtttctgtgtgaccttaatctctctgtacctaaactgcaaaagtactatttcagcagggcgttgtaaggatcaagtgagataatgaacataaagttttaatatagtacctggtacatagtaaatacataataaatattagctattaatattatttaatatcaaacatgggaatttctttccaataggtacttggcaagattatcaacatgaagataaagttgttcatgaactgtaggggcaggctttcagaagcccctttagaaaggtgagtctgagtgaacaaaatttcattttgaaaaatttgtaaatgctgagaagaaaaaaacaatcattgttactggacctggttttttcttttcttcacaagatgcttcaaagaaataagtcagaaagtcagactatttactaaccttaactgacttaaaattgatgtcaaaattaaaataacctaactcagcaaagtgatctgacctaattacagaatttacatggatttatatttattcataggtatttttggaaatgtgatttaggaatacctatttagatatacatcaatgggaaataaggtggaattaaaccatttttggtttagcagaattaccaaaatgatctttattatatcatcacatttactatttgggggcattaggataaaattagcttagaataacctgccagagatataaaaaagtgttgtttataattatatacaaatattcctcattaacactcttctgttgaaataacattctctctcaagaggggacaaaaatataccctttctcttctttgtggatcagaatcactgtcattcattatgagccattcttattgatgggaatattcagttctccttcatgtgtcattgggcagaaaacagggtatgtaccattgcactagtatagctttttaagactttttaatgtgctcatctctgtattatttaatgatgtaattctaaacaaaaaatgtatgcatacacacacaagacaggtagcattctgttcattccttgtttacttttcaaattgtatttgttacaactgacatactatagatgttgccttgagcagaacttttttttatttttatttttattttttttggagacaggttctcactcccattgtccaggctggggcaccatcacagttcactgtagcctcgacttctcaggctcaggtgattttcccacctcagcctcctgagtaactgggactacaggtacgtgccaccacgcacagtttttttgttttgttttgttttgtatttttgtagagacggggtcttgccatgttctccaggctggttttgaactcctggcctcaagagatacacctgccttgctctctcaaagtgctgggattataggcatgagccactgtgcccagccagagcaggcattttaaacctaagtatttttaatagttggaaagcaataaaatggaaaatgtgggaaatttaagtgaaagtttaggacttattcattgtccctcaagactcttgtccatatatctcattgagtttttatgcttctcatttatcttttgtattttaaattttatcacatgcctttttacatctgaacaaaaactttaaattttttagctactaattgaaaggtttgttagttccataagtacagaatttttattcacaggagtaggggtcctctctgtaaaacatcacattatgtaataaagaataggattactgaacatataagcaagcataatctactgggagggaaagaattgacttttctaaatgaaataatgtactagagtatacagttatttttttaactagtagttcaacagaatcttattaactcagtagcatatatcaagcaacctagcatacacatttattcccagccctttccttttagtaaatttattcttctcagagatgagacaggttaagggcaggaatcccctcagcttcttactcttaactgctatacttcctcagccttcctgtattgtagggaaggaatgaggcatctttcttcttttttagttaaacattcccactctgttttgatctcatgctttcctgtttgttctggatccttgctatatcacatattctctcttgtggatctttaatctctatactagcttttttcattcagtccttaaagttattcaatttttttaaaagttgctcccttaactttctctcctctagagtcttttttttccctcttcttcattccttcttaactaaatttcttcaaagaatggtcagactctgtcttcatatctcattcactgtaccttccactgcagtttctctttaactttctctttgccactgaaattgtatttaccaaatcacaaagaaattgctactcactacattcagagaatactttttctttgatatttccactgcagcaagaatttgttttgaacatttacttcatgactgtattctctcctgtttctcctctttttattttctttgtctatctgcataacatggctcccagtgatcaccactgcctgggactcacactctgaaagttctcctggagtgagagctagacctagtgatttggctctcataaaacaaaatatggctaaagtgatggaatttcccttctgcaattaggttatgaaagactgtgacttttgtcttgctgacattctctctctgtggctcttctgtgtgcttctcttttgaagcatattggagatgcctttttgggaagtaactgcaagcagtctgcagacaactaccagcaaggaactgcggtcctcattcagacagcccttggggaactagaagaacctggaagtagatcctacccttgttgagccttgagagaactacagcacagctgacaccttgactgcagtctcaaaatagtaaaagccactagccttgatagcataacataataattctgtgcacaatattgaaggatgaggttaaaatacagcaaaactgaagttaagtctaaaagtgctattaagcagttgctttcaacttaatcctatttgtttttagttgagcttttaaaagtggtactagaatttcagcttgaatttcatttgtttcctaccatttctcttcatattattagtggtggtaaaagttaataaaatagctgaaaaatagaccatggtcagatttgaaggaggatgcatacaaatcataatacaataacagatcataaactcctagaacctgcataagtcaggtatatcttaaagggattctaatcatgttcattaaggaatagttaacaatggtagataatatacatagacttagatagtagtgtcaacaaataatgattgtctatttctcataagcattaacttttctgcagtataatgcatcttagtctttttgattgtagacttctggtcagatcattaagcaattttcaattttgaaaatattttaaaagaaaaatctcagttttggtcacattatgtatttttatgttttattaacagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatgtaagttattgtgtatagtcatataaagagagagaaacaggataaattcttatcagctattacaattgtagcaagtgagcaatcatactatgaatgtttaccagaatattcttttttatgattctaggtcctgatccaatctttcctttgatttttaagtttttctaatttccaaactcagcttctctagtcttccaagttcctaggtgtctttacattttttctttctttctttttgcctgagactactagcttgcaaagacatttctctaagatgagcagtgtcaaaaatatagagaggaacacctggcaacttagtacaacaccattaagtacttattttgctcttcaagtttagtttttaactcagcaaatttcacccaaaattgttttgttggttgttggtttttttttttttttttttttggcctcacagctcatagccagagaaagtagtcctaactaaattagggtagaaagtaggaaacaaaatttgcggtatactacaggccaggtatacctgcttctcatcacccccggtatgacccttgtctagtgagtagtcagacttctcttcctcagctgttgtaattcacagcacagaaagaaagtattaaactgagtcttttaaacgttgaatctagaatgagaaaaggaattcagaaaccacaaaaaagggaagcgttttggaagaatttaagatacgtgtggtagtctgttttcacactgctataaagaactgtctgagactggctaatttaaatggaaaagaggcttaattaactcacagtttcgcatggctagggaggcctccagaagcaatcatggcatcacggtggaaggggaagccaggcacatctcacatgacagcaggagtgtgaggggagtgccacacactttaacaccatcagacctcatgagtattcactaccatgagaacagcaagggggaaatctgcccccatgatccaatcacctcccaccaggcccctcccctgacgtggggattacaattagacatgagatttgggtgggtacacagagccaaaccatatcacttggtatccagaaaatgaggaaaaaatacttccttctccttattgtccttacttccttctccttattgtcctccctctgacctatttccagctctttgtgtctgatacctcctgtagaatatagccattgccttgactgaagcataaacatttacctgtaataatttggttaagattgtttataatgtttatttctcatgcttcttatgcattatcttttgcctaaagattttccttctaggaaagtttattttgatcggctcgtatgtggattctgtgggatcctaaatcacttttctgtaacatactccccatcactcccaactggacccacctcaaaaaagaacctaaaactcagtcataaccatcttctaatatcagtccttcaaatttagagaaaaggcagcaaactaatagcattaatgagaaaaacttaacaaatgaatcttataagaagtgaaaaaaaaaatcgctgttttttccatgatcagtcagatctcttaatagagtctggaattcttcatgaagagagtgcggcaatatactcaataaggtaacttttaaacatgctatccaaaactgtgaagtgtttgtagtgggagaaattagtacagcttaagaaagattttaaattgaatctgctggtgaaaatttcagcagctattcaacagctgatggagattaactaaaacttttttttgtagtgagtgtcaaatctaatagcgtctttttagaagttgttcggatgaacactagctctaactctgaagttagaagactaggatgaaggaaaatttcctgtgtcttcatagtttaggtgaataaacaaaaggagattataaattctagcatctgtaaaagttaactacccctcaggctcatctttttcattgtgtgctatacaaacttaaaatattctgcaaccatcctggaaaaataacaaaggcatttggtatagtagaaaggatttttagataaaggggaaaagtacatacactctggcaaaaatgagataacaatgagagatttaccaccatatactaacttgtacaaatattcctggttacacctaattcccaaacactgtacaaacacctggaagaaacttgatctgggaaaattctcccttggcaggactttgttcacatgattgtcactacattgacattattgcacaaccagcattaatttcataattaaaggtgacaaaaatgattaagaaagctaggccggcattggtggctcacgcctgtaatcccagcactttggcaggccaacgtgggtggatcatgaggtcaggagtttgaggccagcctgaccaacatggtgaaacctccatctctactaaaaatagaaaaattagccgggcatggtgacacgtgcctgtaataccagctactcaggaggctgaggcaggagaattgcttgaatccgggaggtagaggttgcagtgagccaagactgtgccatggcactccatcctgggtgacggagcgagattctgtctaaaaaaaaaaaaaagctaaaagtgagacagttacttttacctggagttcagatgtgttgctcttctcagtgcttattgttagaactgcatcaaaagactctctaattatatttcatcacagcatatatatgaaagatgtcaaaatacctggaataacaatggtggttacaccattttcacactgttccaggtattgccataaaaggcaagagaagatgcaataaataaaagattgctaacaggaataggatgtggctctgttaaagtgaattcacagaaaaatgcattaatccctctgaaacataaataattttgatatcagttttatttattgatatattcattacaaatataattgtgaaagaatttctgtttgattgccagaggtatgctatagatcctaaataatactatattatgaattagatgaacactgttcatcttaggctcagtttattctctcagtgcataatatatgaaatttatgtctcaaaccatcaaacacttacaaaatttgggaaaaggtcacatttgcagcgaagagttctgtctcttctgcaaaacttagaaatttaaacaaaaccttaacaaacttgaaaatttatatatcagaagacttgtactttagaagtctcccttaatccacaagggatttgttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgccattctcctgtcccagccccccgagtagctaggactgcaggcgcccgctgccacgcccggctgattctttgtatttttagtagagacggggtttcaccgtcttagccaggatggtcttgatctcctgaccttgtgatccacccacctcggcctcccaaagtgctgggattacaggcgtgagccactgcactcggccatgttttgtttttttatatacatacctacctatgataagagttaattcataaattaattaagcacagtagagattaaccttagtaactaataataaatagaacaattataaaagtaggtcatcatcttctactcttgtgctttggggtcactaagtgacataagggttccttgaacacaagcactgtcatgcgagattttattacaatactcagaacagtgcacagtttaaaacttatgaattgtttatttctggaattttccacttatttttggaccatggttgactgaggataacaaactgtacaaagagaaaccacagataaaggaagactacactaccttatgtgcctcaaaccaccaaattatctaaaactaattcctttaactttttcttggatttttgcccagagtcctgaatagtttcttaaagttcagattgcactaaagtctttaagttcagccttcacctgccttgagataagatgcaagaaaaagatgtactatcatttatccatctccactatcagatagcttgtcagagtttagattacagatcaagatatgtgttatagctttgctattaataacttgggaaaatgtgtctgcagttacacaaaatcacattcaatagcaacaaaaatactagattaacatatttacagacaattgttaacaaacccaaatgttgatctttataattaaacttagccttttcttaaaggaagacacttagctattcagccacagaagaacagtacaattaatatcctattagaaaaattaatatgttccatggacacagggaaaggaacatcacacacccggggcctgtcacggggccagagggctaggggaagggatagcattaggagaaatacctaatgtagatggcaggttgatgggtacagcaaaccaccacggcatgtgtgtacctatgtaacaaacctgctcattctgcacatgtaccccagaatttaaagtataataaaaaaaaattaatacattctcaaggttatatttgaaaggtattaaatttatgtctggtatcaacaattaatatttaaaacagaaaataaaaatataaagggaagatggaaacataagcatcaaaaaagatcactaactttcatatttttgctaaaaatgagctttgtggccaggcacagtggctcacacctataatctaagcactttgggaggccaagatgggcggatcacttgaagtcaggagtttgaggccagcctggcccacatggtgaaaccccgtctctactaaaagtacaaaaaattagctcagagtggtggcctatgcctgtaatcctagctactcgggagactgaggtgggagaatcgcttaagcccgggaggcggatgttgcagtgagccgagatcgtgccactgtactccagcctgggcaacagagtgagaccctgtctcaaacaaacaaacaaataaataaataaatgagctttgaaaataggaactaatttaacttaaatcacctctatgaaaacttaaaatattcactagaaagaactctttggaaaaggaattggctatgtttgtatgttgtggtttgaataagtcaacagaattgaagtctgttatataaatatataggaacaagagaaattttcacattaatataaattaagaagatactgttattcacaaactgggtaagtgtatttagactcttccctagtatctaattcataataaaataattaagctttactttacagtcactttggtgtattgcttccttgtctgtaaagtgagggtgttgaactacatgatctctacaatctttttctaatttttaacattctcatattattctgagactatcccatgaaaatctttccagtcaagtaaattgctataaagactctggatataggttaataaattatataaagtttatcgctagaatagtaattcaacaactaattcagaattcaactaaagttttttaaataaatactgtcttcaaagaagttacttattttttgttcttaaaaccagtaaaataacaagaatcaagaaagaaatgctgtaaacaaatgttgtaattatttctgagataattgcagtcaaggaaaacaactatacaatacagaatgtatccaaatagtctatatcctaaacacactaaacaatagtgttgaaaacctaatatggtgaaataagattagatataggtaacattgctgtctttaatctcaacagaattctgtctgtgaaaatcactgtttgatttattttcatgtttagttatgctgttcatatgaagtagagaaaaagctttatcttgaaaatatttattataacatttgcaatagagaaaaatccagaaacaactggaatgtccagccatttaaaatgatatttatagagacagagacatgttcttagaaaaccatgtttaatgaaaaggcaggttactttcttacaaaaaaaatttatgaagacaagaaatagaaatcagtgtgttgatgtttatatcagtgtttattctgttgaggtgcgttctgttttttcttctttccactttggaagtggaaaacgaatttttattttttaaaattaactttaaaaatatattgatcaatttataattagttgattatagacattaatttttttaattacaagaaagccaatagatagtaagttagctttcttgccaagtctgaagtgggagcttcaggacaacagcaaactgaagcagattctttaaggaatttcccatctaaatctcatgttcacgtctttcctgcttggttatattggtgcatataccatgaggttcaggtaaagctgatgtcatgaaaaagaaaaagtttatcataagctttttgtcttgaagaaatcagttcaactcatgaattcactcatgtgtaaaataaagacttaaagttagccaccaaaatacattggccaatattaaaataatcacatttatttatttcaaaattttgtattatgagttttacataacaccaaaaacaatgacatacttcctccacagactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgtaagtattatttaattgatggtgtttaatttgatgttttggtgaattctctgttttcctaagagtaaaatgaaataatctttattctgctgttgctgaacagtttgcagaaaacaaaattgaatctttgaataagataaataaaaaatggggaaaatcatactttaataatttttgacaggttattgtaaaatctctttacttggaattgatttatagaatttattcattctacagttaataaatactttcttagatcattcgtgtattcatgagcaattcgatggtttttagtcatattactcaatgattatttttttctcatcttaaaaggggtattttcaattaaaagcaaacccaggtgcttggatactgaggttacaccaaggaaaatctgaagatatttatcaaatagttgggtgagttatgcaggctgcttttaaatttttacacataaatacgtttttagtgtaatacaaccaagagaatcaaaacaacaattaaaatgttaagattggcctggcgcagtggctcaagcctgtaatcccaacactttggtaggccgaggcaggcagatcacaaggccaggagttcaagacctgcctggccaacatggcaaaaccccatctgtactaaaaatacaaaaatttgccagacatggtggcgcacacctgtaacttcagctattcaggagactgaggcccaagaattgcttgaatcttcgggaggcggaggttgcagtgagcagactgcaccactgcactccagcccaggacagagagcaagactctgtctcaaaaaaaaaaaaaaaaaaaaaaaaaaagatgactgagttaggtctgaacatcagcaagagggcaaaacaggacattccggtgctcatacccatgcagaaacatcaatttgaacaactatccactccacacatgaaactaccttaataaaaactaaggaacgaggtaagctgttacagcactgcagtgtagcacagaaataagaaagacacattgaagagtgtaggataatttacattacatgcattactccttcctcaacctgatacagcacagctggagagatacccccttgggggaagtagagggaagtgagcagcagactttgccttggaccccaaaaccatgctcaccccagtaaaacccaaagccaggtaggcctcacagccccaacttaatgctggtaccagaagactgagctgccagatcctgtagccccaagctccaaatctgcctggtagattcagtttccaagcctgtccaaccaccaggcctaccccaccaccaggcctaccccagaagccccaggctattgcccagcctcaatgccaggccagcccccacaaattcaggctcttagacttttccctgtaccagcataattgatattttgatcatttaatgacaatatggtatacattatatcttatataacaacaccgttatccctgggttatattcaatttggaattgtttttttgcacaaaaattttacctgttcttcagtgagccatagtagaaagcaggagttatcacacttttttggtaaggagccaaagtaagtatttaatgttcatttgagagcacatgtggtctttgtcaaaattattttttttaacaattattttaaagtgtaaaaatcatttttagcttagggctattaaaaaaatagaccataaacctgatttggtttactggccatagtttgccaactcttgataaagtcttttttatacccttaataaatatctctagatttcattgctttcaataaatacttactgagcaccttttattataccacacgttgtgctcaacaaagataatataggagtaggggttactgtatctttttttcaccactctttcccctttatactgtgcctagctcatagtgtcagttaatagatgtgcttgatggcttatgcacacagagccagggatgcttagttctgtggtagaggtgggtaggaggaagtcagcattgacattagagatgatatagtacctcaagaaaattgaagaattaataggaagttattagtcataccacagacggaacattccaggaagagggtagacatgcacatctcccatctaaaactcttagggccatatgtgttttagaatttagaagtttttcgtttggaaagttaatacagtacacatatcatatattatgacgtatatcccagcaggatctgagaaagccctttattaaacatcatttgtattgcagaatgcgttaatattcacactaaaagggtttatgtaaatgactgaaaaagagaatgaaaagacaatccacagactgggagaaaatctttgcaaagcatatatctgacaaagaatttatatacagaatatataaagactatcagaactcaatattagaacaaataaccagattaagaaaatgtgcaaaagacttgaacagacactctaccaaagaagatatatggataagtacagaatgtatttaacattgttagtcattaagaaaatctacattaaaaccacgagatatgccacatatctattaaaatgactaactttataaaaagaatgacgatatcaagtgttggtgaggatatggagtaacaggagctgtttttcacttccattgggtatctagaatggtacaaccacttttgaacaattggacagttcctagaaacgttaaatttacacttaggctaggcatggtagttcacacatgtaatcctagcactttgggaggccaaggtgggaggactgcttgagcccaggagtttgagaccagcctgggcaatatagcaagacctacctctatgtaaaatcaaaaaagtaggcaggcacagtagctcacacctgtagtcctagttacttgggaggctgaggtgggaggatcagttgaccccacgaggtggcaactgcagtgagccatggtcatgccactgcactccaggctgggcaacagagtgagaccctgtctcaaaataagaaggaggaggagaaggaaggggatggggaggaaggggagaaaaggggagaagaagaatttgctttctgtggtttcagtcgcccatggttaaccacagtccaaaaatattaagtgggaaattccagaaataaacaaatcctacattttaaattatgcactgctgagtagtgtgatgacctctcacaccatcctgctctgttccacctggaaaatcattcctttgtcaggtgtctgcccatgagtcacttagtagcattctcagttatgagatcaactgtcatgggatcacagtgcttatattcaggtaaccctcgttttacttaataatgaccacaaaaggcaagagtattgtgcctaactttaaattaaaccttatcatagacatgtatgtataggaaaaacatacatttagggttcggtactatccatggtttcatacatccactggatgtcttcgaacctataccctgtggataagtgggggttgctgtactactgcatgtctccttttataagttacaaaacactagataatacaagctatagtgacagaaatcacttggtgaggtggaataagcagacaaaaataaggacaagtattggagataagcggttgaacaatgctgttttgagaacccccagccaaattgagttccagtactggagtggctagtgaccttgccctaatgaagaatgaaaggcagctggatgtgaatgtttactgtgtgcctttcatgggatacttcgtttacctggtggatggtctaattcatagttgtctgaccccagacccagtttccctcacacaggaaacttgtttatgctgacagatgtccgtgtggctcttgtctgacccatgtccagtttatgtttgcctgatcatcgcggtgacactgggaacccaacattgtgttctccccagcatcctcgagaaaacctggtctgggatagtccctggctcttccaatggggggtgcaaatttaatacaccaccacaaaaagaaataagttcaaagatttatcacttacagatcctggacaggaagggctccatctctaggtcacatcaggcaagaatgaagaggagtcaggcagagagaaagagagagcatgcatgcaactagcagtatatataagggaatagagcatgggtcacttttggtctgtttgaagggaaggcaggacaacagaagcccagtttgctaggcaggaagggtacctctaagttcttatctttggctaccagctggacccatttgggtatgttctaatgcctatgcagcaacctatgctaccttgctgtgtcattcccattacaaatagacagttcctaccctcccaaaactcattccagtagaaaagatagtcaagaaaatgagtgactattatatgttctaagtgctataaaagagtgctatggtagtgtagaaaatgagcaaaataggctgtaacatttatattgacccttataaaagccatggtttcaagatataattttaagaagcattcatgctttgtttcagctttttaaattttgtgcaaactgctttgccaggaattcagcatttctatatctgccactaccgtttcatcattatgttttgcaaagggaaagccctgtatatgaattgtgaggcaaatcccttctgtaccaccaactatccgtatgatcttgtataagtttctttgctatttgtagtctttatttcctcattacaaaagggaataatcctacctcccttgtggggttttgctaaggactaaatgggaaaatcattgtagaatattgagtaaatgcccatttcctctccacttatcccttcttttacaaatacagttatacaatagcacatgtattatgtaaaactaaaactatacatgatttagattctattttatcttctttactattattttctatcatacacagttcataaagatgttcttgatgttatatttgaagtaccactaacatattagtgaaaattgttttttctcattcacagacaacttttggcagtagaaataacttacaaacttgtttgtattacttataaacaataaaaccatatacttagtcataatttaattctacatatgattaatgtcactagctatccaaaatgcaaaaaagatacatgttactgtgtaataaaaagtctaacgaggtcaatataaaatataacaaaaactgatattgtttatcctaatttatgttttaattgtaattgatattacctttataattaggaaaaatattcctgaaacctgctaaaaatctaagctaaaataatattgatatgagtttctaagttcagattttaaagccatggctaaattatttgattttttaaaatttggctttccacttctgaggcataatgcccacaatgtgtactttctgtgtctgtcaatctttttgtagtcattaactgcagattatttgtgtgtactcagtattggctgttacttaccttgaatacaaaaagtctcaaaattattctcctttatttctttgtagttctaccaaaattagacaaatgctgctcagattttcctaattaattgtagagaatattagatactttatttatgcacctttaatgccaaattattgtgctagacttctcatttgaaatctttagaaaaatcttttctgccaaagtaacacttgtaatcaattttagtttggtacctttgagactgaactgtttctcccatgttttttataggaggaaggacagagatgtcaaacaaggctttccattctttctccgcaggtactcgagttggtccaccgtaactttgctggctctgcagtagttaaaactcactctctgcggactcttaaaagttctctattgctgtacttcactctcctttagttccctggttatgttggtgtggtctcctcatacctcctggttgccatattggcaggacacatgactacccagtggtaacaacaaaaccaaatcgctctccttcttggctgcatctgatctgtggaaatacctagacatcagttgcccaacaaactctagttcagagcagttgcagaggcagtaagcactctcctgactcctcgattagagcaacaaaacagtcctcaaatacccaatcctgctccatgtacacttctaactttcccagacatgagtcctctgtgcatcccaacttcagaatatgtgttgcaaagtgtcttctccttaaagtgtctaccttactgagtttagaatgagaaggcaatactcttccccttccgtcctcacagggtgtagtggtggagactcacaatctgacaacagctctctgtaaggaaactcttctgccttcatctcacacaatcccttttctgaacatttttatatgctttatctctctgaggggcaatctgcatattgtgagggtattgagaatggatgactatgcatactcacttcggtgtctggtagctatctcattggtgtttcagtggaagcattctagcatccttttacccctacccccaatattctgtttagttctttactttcatattaccattagttaaatataaattttaatgaattcactattgatcacagtttttatatgtcttttaattttcacattcattttttgtttagatggtgtcttaggccattttttgctgctgtaacagaatacctgtgactgagcaaatttattggttcatagttctggaaggttggaaagattgagggacagcatctggcagaagccttcttgctgcattgccctatggcagaaggcagaaggacaagagagagcaagagagggccaaacttgcccttttgtggtagcaccacttccactcaatgagggtggagcctcatcacctataatcacctattaagggtcccacctcttaatactgccacaatggcaatacaatttcaacatgagttttggaggggagggacattcaaatcgtagcagatggctgacttcccatattatcatagaagtatttaacacaagcaattggatgcttttacatcgtattgggaaggactggcggagcaagctctccaggagggctggatcctaggaatgcttgagaacaaagccaaggaactgaccaaccagaaagagctgctactttcccgtcatcagaagtgagagaaagctagaagctgctgccagcaacacatcaactggcctttggtacccagaaagctaagcagttacacactggaacactgaagtagaaaacctcaatgtctccatgacggtgcttgacaaaagaagctaggcaggcatcagcacattgccccgctcacttctaagttccaaataacatgcaaatgtatctatctgtttagcagaatctaattatcaaccaaaaccttagctgcaaaagagttgagtaacaacaacaacaaaaatgggtgtatctttctaactactgcagtgtatgctaaaggtgggatgttgcctgccatatcataatatacaccaccttaccacaaataagttttttcagagacattagtggtgtaccctcaaatgtttaaaactttgaggtggtcctcaaaggtttaaaaatttcttttgcagttccgtatgaattataactttcctaagtattgaataacagcattataattttattcagaatgcttgaaacaaggcttcatcattgtttcttaccagttagtgttttggatgaaaaatatgaagccaatctgatttacatttcttctctgaaaatataaattgttttttagaatttcaggagacacatgtataagtgctttttttaattaatcatgctttctgacacacagtgaattctttcattttgaagtaaatggcatttactgagattcagtattctcttgaatctcattgagaatatgaattatttgaatgcttcccttttttctgcattaatgccttatcaatgaagtccatttcctctgactgcttagcttgttcccttcatttaagctgcacattttcctcatgtatccagaggtttcaggtgcttagcattgttggtaaaggtctgatagtacagtggtgaagagccagactatctagactcaatttggatctaggataataattgtactttcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactcataggtggaaattgaacaatgagtaacacatggacacaggaaggggaacatcacacactggggcctgttgtggggtgaggggaggggggagggatagcattaggagatatacctaatgttaaatgaagagttaatgggtgcagcacaccaacatggcacatgtatacatatgtaacaaacctgcacattgtgcacatgtaccctaaaacttaaagtataataaataaaaaaaaaacagtgcctgaagtaaaatgagagctcgtcaccattactacctctgctacctgatggaagtggaaagagatttgctttagaatttgtctaggtctagctgtagtgctctgctagctggcttttatactctgggtctcagtggacagggaattaaatggctaaagttgtcaatgcccttaagtagtgttttgtgactataagcagctgaaagtttttaagaaatttgacaatgtttctaccatacaggttagatcctttttgttttgttttgttttgttttgttttgtgacagggtctctcttgcccagacggaagtgcaatagcacaatcacggctcacaggtcactggagcctcaatctgccagtttcaagcaatcgtcctacttcagcctcctgactagctgggaccacagcgctggccaccacatccagctaatttaaaaaaaaattttttgcagagacgaggtctcactgttgcccaggctggtctcaaactcctagactcaagcgattctcccaccccagcctcccaaagtgctggggtcacaggtgtaagccatcacacctggcttctttctgttttctagtggtgattgttggacagagttctgcctgctacattggtttaaccacctcagctcaggaattgggagtaagagaaagtcaaagacgtgtcagtcatgatagtgctagactccccaggtgttcattttggaaaaatgttaaaagtatgtattatatataacaactcaaaagtaactatactaatttgacatctgattgcttccccttcaacaaaattcaactttattgtaaatatgatagaactttttagtccatagtgagaatagtttgaaaaaataattacggagcacagttgccatatttgtttaagcaattttgaaaatgggagaaaaaaactgcattatacataatacaaaatggaaacattcaggtgatgcagatggacatcatagacacattttcagtctcattattttaacaatgtacttcaaattttggcatttgaaaatggctggtggatattaaaaagttggtatagtgtagaactcctttgaaatataaacaactttgaagtgtaaaaaattgtaattatcactacaatatatcagggatgtgaaagattttagttgtgtgatagccttggtatataacagcaaagataagccataatttgaactttcagagtgattgggtagtattgaatttaatgagttacttttgtacaattttaatgtgtactgagttaaaatttattggataattttgaaaattacagcatattatagtatatcttaattgactatagaaacagaaaaacatgatatatgcactagtgttattggacttacgtttattgcaaaatgagtttattctgttatgccatcataattgtatgtctattcttaaattaattatggacacatttttctacttttaggcatgaaggaactgactctcaagcagacctagaagatatcattgttgtattaaacagcttcaaaagcaagatactcaaagtaaaagtatgtgggggcagaactttttataggctttgttcttaatattaagaattatcttctttgttttttaattaattgatttattttacaattaactttacaattttacaacctaaaatgttatatttgaactccagcagtaaaaaaagaagaggattaagttcacaaaggaaaacagaacttgaagatagaagagaaggatttttttttacattatgataactgtaaatatatctactaaatctatctgtagccaaataacattacaaattggactctagagatgagatcaagaacatgcactgaaaaattagctctaaaaagagaaggtgctgttttttaaattgggagagaaagggagtttttaatgatagcagattctttttggaccaaccctcctgcttaaaactagtgaaaatattagataaaaatttaaaaaaattttaaaagcaatgaggaacggagaataataagataataaggataataaggaaacccaaaaccaaaattaaagggaaaatgcgagcctagtgaaataagcaagcacagaaacttctcttgacccaaggaagctactattgtcctgggaacatttttctgtcctgtcacacttttaactgccatttttatttaatttgatgggttaggggacaaaaattagaacccaggacccacataaaataatctattagaagaccctctacaataaactagctctattttcaggctaaggatgaaacataaaaaattattcctcatagtcttttagcccaaatttgtgtcagccaagtaggccagggaatcctgaaccttgaattggtactaatattcttccagatggataggatatagcggtatctggaagagacatccataaatctctggaataagattacaatagcctaagctgcaaatcaaatttttctagtatgaaggccaactcatagtcaaagttaaccaaatacacaaaaccagcagaaacagaaaactgatacacaaagacccaagatattaaaattattagaatagcctctgaaatagctgtactttttttaaagaaattaaagatgagtttaaaaataattgctgggaacatgaaactgtaaaacatgcatatcagatttttttaaagtagaactttggaaactgagtaatacaataccaaaattaatagtagatagctttaacatgccttcagagaaaattagcaagttgggggagataggccagaaaaagtataccaaatgcaatagagacaggaaaaaaagaaaatatagaagagagcattaacacacacacacacacacacgctagtgtgaaagtctaagattaccagcagtggatttaaaactggctttgccactcactagctgtgtgaccttggacggattacttaatctctttctgtctcatttcctcatctgtaaaatggggttaacaatagaatataccttacaggactgttatgaagataagataaagcactttatgagtatttgttggataaataaaagtaaactaaatggaatttcaaagataattaaagaatggggtacaagtaacatttgaagcaataatggctaagaatttttatgaattatgaaagaaaccaattagaaatattctacagcctacccataccctaggtatttcagtagtttgtttttgtttttgttttgagacgtagtctcgctctgttgctcactctggagttcagtggcccgatcttggctcactgcagcctccgtctcctaaggtcaagtgatctctctgcctcagccccctgagtaactgggaccacaggcatgtgctaccatgcctggctaatttttatgtttgtgtgtattttttgtatttttagtagaggtggggtttcactgtgttggtcaggctggtcttaaattcttgacctcaagtgatccacccgccttggcctcgcagagtgctgggattacaggcatgagccaccatgctcggccgccttcagtttgttttctaataacacagttttatctcctaaccacctctttctcagaattacaggaaaaagatagaaaaacagggaggagaaaagataagcaacatagaggatcagcccatgaaatccaatagcctattaagaggaattccagaaacaacagagaagatggaggagggaaagtgttgtaaagctgagagagaaaaatgttcatgtcaaaagagtccacaaattacgaagtaggatgaatgaaaatggcccatataagattataatagctactaagaaggaaaagtgggtcactgcaatagaatgacaacactaacatcagaatttcattttcaaaatacttagatgttaaaagacagcaaaacaaagctttcagtattttgaggaaaattattttgaacccaagattctgtatctagccaaattcttaatcaaatgtgaaggtaaaatgttagtttctgaagtgtgaagatttagaaaaattatttttcataccctttcttggagatgtttgccagtacaatgaagatcaagatcaagaaagaagataggtagttcaagaaatggtgaaactaatctgtaaaccaatgtaaagaaaatctagaaagaaacagttaattgttgaactttaagaaaaatgtcttcaggtagacaagaatcctagacaattagataacatgagtaataaactggaaaagattatgtctgtgataaagaagacatatttgtatatctccccacaagaaaaaagaaggacaatggaattccaggaaaaaatagttctctgctggtggaatgtaagaaaggagaattcatctaacccagcaagagtctcctaggagtggcacagtggccataggaggaaactataactatgctgtactatgctaaaactataactgtacagaggaaatagagttttagtagcttttccgactcttcagtggttaatctttacattgtcataatgaaaactttttactgattttcaagttttagaatcaccatagcaaaatgcaacaattatgtctactgaactaaatgtaaatgttatcaatatttacaaatgctaaagtcaaggtttaatataagttgggaggtagaaggaaatcatagaaatagtagtgtccttataaacagattatacaagagaaactgttgggattgtgggaataaaaaaataagagatttaaatattatttaaagtgacaaaaaatactcaatagaagaaccgaagataaacacattactaccaaaatttccagacaaatagggaaagggaagggataacgataagtgagctattcatctgtcatcacaaagagtgtataatgtctaaactctgaattcagaaatactagtagataatgcctaaagctgataaattagtaaacacaagggtaagcacattatttagcaatatggaggtaaccactgaagaaactgaacaaagaggttgaattgatagttaaagaccagattgtttacaacattgtgctaagatattgcctgtctttggttactgcaactgtcaatcttagatttctatgggtaatctcgcccaatatgtttcactttctaaccatacagcacaatatttaaagcagccaaattctaatcttttttgccatgctatctaggtgaaaaaagaaacagacaaaattaaggaagatatccttaccgatgaagatgaaaaaacaaaaggactgtgggattccattaaaaggtaattactaatgaatattttaatacatcactagattgatccagaagtctagtatgtggaagttccacaggtagtgaaaatttaagtaaggcaaaggtcctctaatctaggagggataagataaatacataaatgttactactgtgtacaagataggaaactagagctataagacagatgaaaataaaatactatacaaaccaatggagaaaaattatatatccacttacaaggaaccttgggaaatactccttgaagaagtgtgtggcaaagatctgttttaaaggacagacaggatttcaaaagttaaagattgagtgaaggcaattacatgaagacaaaatgattgggtatgttcctcaaagaaaagaaagtagcctagctagctgcaacttgaaaataaaagggactgtttatgttagattgatacctatactgttttattgttagtttaaaaaggaacacaggccaggcatggtggctcacacctgtaatcctagcactttgagaggtgatggcaggaggattgcttgagcccaggagttcaaaactagcctgggcaacatagtgagaccctgtatctacaaaaaatttaaaaattagcctgttgtgatggcatgtatctgtagttccagttactcagaagactgaggtgggaggattgcttgagtctgggaggtcaaagctgcagtaagtcaagattgcaacgctgcactccagcctgggtgacagagtgagaccctgtctcgaaaaagaaacatacataaggaatatattgtctcagatatctaaagaatccaggagtacacctggtgttggccactgggtgatgtggtgtggaaacaatctttctccatctcttaggtctactgttttctgtgtctcctccattttaagatagacttttgtaagtaaaagtttactgtttccagtggaaggaagttgcctctttccaaacagtaccaataaaagttccaaggctgactcatgggtccaactatagctgtgtgtcccaaactgaactgatttctgtgactctgataacccagcatgagtcatatacctacttctagaactggtgggaagccctgtcccacctaaacctcatagaatgagatgggaggaggaatgattccccccaaaataccaggttgttactagaaggggaacagatgttaggtgagcaaaaacaaaagctgtctcctgtagatgcacattgtaaagaactttgaatgtccattttagagatttgaacccaatgtgagctatgatggaaaaccattaatcattttgatcaaagataagaaatagaaatgttagcccaaatagattcaacaacttaaatatatttggttatagtagtcaaaagcacttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaggatcaagtccactcattgagatgatttggagggtaggtatgtttgacaggggataatgaaatagaatctgagcaattttaagagtatcttactaaaagcttccattaaagttagaaggtatagataagaatgattaaggataactgttcaattatggtatagccacttgctatattaaaaggataccaaaaacaaaatgctttgttagaaacggagatggtaagtttttgggacgttaactgctccagatacgtagtgttgtgtgtcttatgatgctttgacttttttcatcttagttttagtcctaacttagaatgattattttttcttgccactgaatcaacttcttttcttatttgggagattacaagatttgaaaaatacttctgtcataacaatttatattttgcaaaataactttgatggtgatttaagttgtttacccaattttattcattctaaatatctgtttatataaaagtattttgaaataaatgtttaggaagaaaaagatgaatttatacattatgaatactgtaaatagaagattcagtcatttttatatatgaaatgggcctatacaaaaatgaaatggagttggtctagctccaaaaatgtaatgaaaatgacagctgggcccagatgacgctaccatgatgtaaaccagtaagtagacatggttccctagtgctttctttgtcatggaagtcatccagagtaccaagagcatactccataccctgcgtggtggagaaaatctgcttggtcagaggagctccaaattgtagatggtttaaaaatattttagcctggatgagccccatcagcagcactcacacacctaccctgttaccacataaattcttgctgtgccgtagttccacacttaagcattctgttccttccctcattgacctgtttaaactttcagtacactagatatggccatgtcaagctgtaattcattctttgttctgaaaacaacctttggcaactcacaaaaattcaaaaataccagcccattcacctaaagacaatatagttatattccacattacaaatttaaaaaaaaactcataaagcttcaaatgatattgtcaaatattttaatattagtttgtaaatattatagagtgtttatagcttaactattttgaaatacatttctatattgattgcttatatttactatttaggcatacaatgtttccatatgtatgtttaagaaatgtcaattacttttttattccaagtttcacagtaagcttgcataaagaaaacaaaaaggaaaaagatgtcctaaacattttttcagttgcttctggtcatttatatgaacgttttttaaggtaggtatattttttaaccttatattttgaaaaagaaatatttacatggttcaaatttcaaaaaaaaataaaggaatatacactgggaaaaaaaaaactcccacctctgtttccttgatactcagttccttttctcacaggaaacccataatattatttttatatcctgctaaggagatacatacacacacacacacgtaaatatatatgtgtatatttatttatttatttcagttgtttaagtccttttacccaaatagtaaagaacatactactttacaccttgctttttttttttacttaaaattatgaggtaagtatatataaatatgaaatttcatgagtttggcttgatttggaatattggttttcttcaaggctagcaaatagacattttggataggtaagaatatatatatatagatatactcacaatatatatatttacagtactttatatatacaatatttatatatatataatttactatagtaaattatccttttccagtgaagaaaaccttgttttataaaaaggaagggaatgaggggagaaatgcatattgcaaagtacaaaaggctatttttaaacagtttatatagaaaggtcacagagaataactcaaaaatatttgaattgtagcactgatacgttaaaatggaacttcagattcatttgtatcctttccatttggaggtttaggttagcaaaccaaatgacccatccagtgaatttgtcaatatagatagatcattcagctcttcagggtttgtagacttaatattaatcacacagtcatggacagctgggcccaggtgaagctaccatgatgtatatgtattcatccttacacattacatacttgataaaccatattttagtttatttcttcacatttcattgtgaaaaccttctaattcataccttcaattatttaaaagcctttaaaagacctatgtaacaaacctgtatgttctgcacatgtatcccagaacttaaagtaaaatttaagaaattaaaattaaattttaaaaaacacttcaaggttaaaaaatatatatgagctcctgttactgttaatgtatattgggtttaatattcttttatacagaattatgatgctttctgttttgcgtaacaccaaaacaccagtgaaattctggttgctaaaaaattatctctcaccgacatttaaagtaagtacatagctttttttgtagaatggttaatgtttgaatagtaaattatttgtatcattgtaagtttatatgatatttctcttttcagaataagctttttgaaaaaatggtatttagtatttttatgtagcttaagaaaaattctgtacaatttttatttagagatgttcaaaggagaggacagaagactgtatatttttaagtaaaatcaaaatcagaatggctagtagtttttcatgataatgagtaattaaatacaatttggcaatggaaaatatatacagattttcaattaaaagaaatggattctgtcatttttgcaaagataggcagaaacagtagtagtatcaagaaaatacaaagactatacctataccgtagaaaatagttttacagtactgaaacaaaaaagctctttcgtctgtgtagtgtattgattgctgggcaccatgatctgaggcattttatatttagaagatttcaggtgatcaacagctattaccctttactcagccctatactcctgctacaaagtatactctgtttcttcctattctccctacagcataatcaaattccgtgaaatttagtgtctccgcagcaatttggtgtctcattcaacagcatttcaaatgagtttgttttttctagaccaaaagcagtgggaaaacagaagtaaaactagccaagcatgcttttattccttaatatttctaggcatgatgccaagtgtttaactgacgttattcaattgtttttcataacaatcccacatgataagaaaaccaagattcaaaagttacgtaactagcttgcacagttgagaggtacctgagaccacttttagattcaataacttactataaggatttatataactccaaaaaacagctgtgctcacagttacagtttttatagcaaaaggacacaaataaaatcagcaaaaggaagagatgcttagggtagggtccggggagaccagacacaaagttaacagttgtcctctcccagtagaatcccgttacagtggatagcacttatttcttccagcaacagtgtgtgagggtactcgtggagtattgccaaccagggaagctcattcaaactttgtggtacagagtttttattgagggtcagctgtgtggacttggctaacggcctgcatgactaaccttaacctctaaccccttcagatgttgaactgatgctttgtggcccaaggtcctcactacaaataacatcattagcatacaatatctagtgtggtccgagatctgcaggtaaacgtagacattcttattagtcaggaaattccaagggtagaggatatttcctgggagatagggtgaagggccagggtaggggatatttcctgggagatagggtgaagggccatacttttctttgagcaagaatcatcctttatagcataggcctgatatgaaacagctaattagaaacacagctgagatttgaacccaggcattcagacctcaggtgcttaaccttatgtaacagcccatttgccctccaccaccaacagtgtctcctcctatgctcatttgacagtaggaaaaaaaaaaaaaacagaaaaagaacctataaatatagataagaagttatactatttttctactaattttttaacatgctttcctagtagtcagacactgaataagggagtatttaacccaaataaactgagatagaaaaatctaaagattctcttagcaggaaaagatattattcaccagaacaatagtgctatgtctggattagaaagtcttgttccactgcatggccaaaagaaatactgtatctgaagtagtattttccttctttttgtgatgtgtttctttcattcaaaatttttcttttgaaaacttcttagtgaaatataacatatactcagaaaagtgcacaaatcatgaaatttagctttggatttttacaaactcaaacatctgtgtaaatcagcagccagatacagaagccgctagctactttagatttgttcctaccagtttagaaaagtcaaacctcctctcttcattcaaatatttgctaaaattatacatacttacacataattattttctgacagcactatacaaactataattccctctcccttttaatttttcttcatagcacttttttctgtagataatagtttatttctacctacttcctctaaaatacaagcctcatgaaggtcataatttgtatttcttttgttcactaatgtacccttagatcctagaacagtgcccgtttcagtgaatatttggacacatatttaatgaagaaaaaatattctttttattttatctgaatgttttattttattttattttgaaaccaaaacaatgactcctggcagctgttgtacccctaatttcaagatttcacagataaaattggtgcttcttgcatttaaaaaaaagtattttaaatctacattgttcttacaaagtcagagaaaaaaattaaacatataaccagaaactagtttcaagtaagaatcaagtggtaaaacgcaaattctatatttattaattcatcttttccaattcctttttcattttctctctcagtatttgagctcttgaactaaatttagcccacagtatatttcattaactgcttctgctttaaacagggaataagctacttctaagcctataagatactcaaatatgaaatattcagaccataatcactactttgtatttttaatccttgaattaaataatgatatatctcaaacatgaagctcctgtatagaatctaatttatcagcttagaacttattttgtgttttttgtatcctctcttcatctttacatctctgaccaaccaacctgttgacatatacatgaactatttgatatgtaggtgttccaagatccagaggcttttttttaagtcagttttctcaagtcagatgttaacaataaaagtatgggaacatttatcttccattaataagtttgttaaataatatagtgcacttatttttaatgacgttaaattatatagttttatttatacttgtgatttcatatttgttagcattttaatatttctcattaataagtatgttatagaagtagtatttagacatcttgcctattagtttataacaatttataggaagctttacctttttaatgttatttttttctctaaaacaaaactactttctcttgaacatattgtttgattttgtgtgtgtgtttttaggaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccaggtaataaggttaactactatttttagtaatacgcaaacattttttacacttctatcttaatatagagattaattcatgttgctcatgtttattatcttcattacggtgcttaagatacgattgtgatatataagcaaagtatctttaaaaacaaaaagtcagaattccaggggaaaattgaaggtattgtaagaagtaccatttattatttaggacatggaagttttctctctaaagtagtagttttttacatttgagaactaaaacaaatacttatattagtcataataagagtagttaatgaattcctgtaaattatgtgctgatatttgtttaaaactaggaatttcttcttgctagaaaagctagcagttacatacaactctcattcttccaccttcaacagcattctttcgcattcaaccaataaccaaattctcatcactctatctcttaaggaaaagagcattttaaatttggccagcttatgcctgtagtctcagcacttttggaggctgaggtggggaggaaagtttgagcccaggagttagaagtcacagtgagatataatcatgccactgcactccagcctgagtgaaagagtgagaccctatctctaaaaataaaagcaaataaatttggccaaaaaaaaaaaaaaaacacccaaggccctctgctttcaaaatttatatgtccaaaaattatgacttttcctttttccctccttgcattgcttttgcatcattagtgggaaaaaaaaattgaaaatacacagaatttctaagaaaaaagtaatatgtaaatgaaaatataaattaaatggataagttagaatttatgtggaacaaaaagtatatttcaatttcttttaagagacagggtctcactctgtcatccaggctggagtgcagtggcacagtcatagcttactgtagcctcagactcctgcattcgagccatcctcccacctcagcatcctaggagctggaactccaggtgcacaccaccacgcctggctaatttttttttttttttttttttttttttttttacagacagggtctcactgtgttgcccaggctggtctcaaacttctggcctcaagcaatcctcccatctgagccccacacataatatctaatatgattctttctcctacctttctttcaatgggtgcactaatatttttctagaaggcttgagcatattaaaaaataacatttatattattttattcaagctatttagaataattgggagatttttctttatgattcaaacttaacatttgccaatatacaataatggagatttggcatggaatgattttgttattcatacattgagaaactaagagctctgcacttacgtaatatttaaccccttccccaaatgtctgattcgtaaaatgacttgtttataaatgacataacaaaatattcttgttggtgagtaagaccactgtcttaaagactaggaatataaattttagtttacctttaacctgtaaggacaagaggaataaatgttaaattcagtaaattcatattacatgaaagcactgtgaggacaatacagctctttggatttctgtagtagagtaataatgatttgagattcccataaaaaagggcttatgttattttacagtctttatcagacagtctattttaattatttagattgtgagacatgatctaaaagaacttcgagatttcgatctggatggagctccttatgggtataccccattttgtgatagccgcagggaaatggatggatatcgtttctggaaaacaggatactgggcatcacatcttttaagacggaaataccatatcaggtaagaaaagtcagacccttaccatttagtaaataagtaatgtattgaattgcaactttcagttttcttaaaaattacacagttttcttaaaaattacacaataaaagcaaccaattacatagtgttcatttcatgccagtcactcttgtaagcctttacgtatattaagtcataaaatctttatgacaatcttttgagatactgttattacctccattttgtagatgtggaaactgaggcatacagcattcatgtaatttgcccaggcttaccctgctagtatataacagagctaagagttaaacccaagtaatatggctcctaactactccagaagatttaaacttggtttgtgaaataaaattaagattatgtcttcaaagcctcatggccttttgtaaggccatgagtttcatgacaacttggaaaatcttggggtgaccctaaaagattatgggttctaccaaaattaaaacaaacttaaaactcttgggaaacagtattagatattaggagcaaatttatgaaaggattaattgttattagatcctaggatatctgtagttaataccgtcactgtagacactcactggaggaaagtaaaactaaaactacataaacaacataggctatcaagaagtaattcatttttgcagtgctttatatgtagtggatctcaagaagttcaggagaattggagcaggtgacaggctcaggagccagtatcaagctctcagtcaagatccaaacagtctttcaaacctagatcaggtaagtaaaatgttaacagaataattttgagtgtgtgtacatagactgttccaactccgtgctcataaactttaaagtcttatattttgagttttttctcaatttactgctgtttatgtaattatctattggatatttctacttatacataattttttcacctcaagctcaacattttcaaaactaatagtattttatcctcacttttccattctcaaacctctactttctactttatgccctgttttagttaccctttgtattagtccattctcactgctaataaagatatacccaagactgggtaatttataaaggaaagaggtttaattgactcacagttctgcatggctggggaggcctcaggaaacttacaatcatggcggaaggggaagcaaacacgtccatcttcacatggtggcaggagagagaatgagtgcccagtgaagggggaagcccctcttaaaaccatcagatctcatgagaacccactcactgtcaagagaacaggatgggggaaaccacccccatgagtcaattacctctacctggtccctcccacaacaggtggggattatgggaattaccatttatgatgagatttaggtggggacacagccaaaccatatcaccctcttttttcttactcttttccatcattgtgtaaacatgctcaagtctctctctctcatctttaagacaaactcccttcatccagtgcacccccaccctgatattgccttaatattttctttcacctcacaagcactattttcctaatatcctatcaatttcctcattattgcatctgaaacattttagataatttaagcagaaacaaaagactctgtattcttttagcagaagcaaaagactcttttttcttatttttatcacaaccatgcatgttcattcattcatctgttgaatacctgctatgtgccagatattctcctaagacttcagacatcagaaaacaaaaacaagatttctttagctcatattttcattctagtagaaaaattttaaaaataatatttaaagataaatgttttggagagaaaaaccatgaaagcatgatagagagttcagaatagtgaataggggctggggcttgcaggtataaattgggtggccatatgtccctatgaagatgacttttgagtaaattttagatggaggcctaaaagctgacacagatgcaggccaaagagagtatctgatgcaaatgtcccaaggtgggcatgggccttccatgtttgaggaatagcaagaaagtcagtatggttgggataaagatggggggaataaagtaaaaatgaaggaaaagagttaacagaggctccagataatgtagaaagcttagtccctttgtttaaaaatctagtaagtgggaaattatatgtcaaaatatgaatgagttattcaagaccacactggtaaggagttgatttttttaatcattcttgaaaattgggagatcttcaaatatatatgtgtttacagactaaatagggtctcttcactattgccagttagtagaaaactgacttagggtcctcagtaaccctcaataacatgccagatttcgattatgaatacatttttggtaattcttaataattttaccaatgtatttttaaggaattcttagtcttaaatatgaatgaaagtctatgaagttgcctgttatctgcctatggacaactgaagaaaggattcatttttcaagcagttcggaaactgtccgaggtgttctcccagtactacattaccacattttggggatgattgtccttactcaaatgtagtttggctcccactccctccaatccacttaacacttctcagtaaaatcaaaatatcttttttcttaggtaaaaatgtgtagtgagcacttcttgtttgtttttatgtgcctctttgcagcacggatgttttcaacctctcctttcttgacactctcttgactctctattggcttccatgtcagaccttgctggttcttctttgacatccctggctttcccaccacaattttgttggtgaactactttttctctacttttcctttaaatgttgctattctctacatctctgccttgacccacttctcactccataccatctctagcggcagtcttgcagccaatcatggttttaatttatatctttctgttaatagttcccaaatcttatctctgtctcttagctttcccttgaattcccaactcctatattaactctactggcattgccacattaatgaccaaaacttacctcaaattaaaaagtcaagaactcaagttctgttcctcttccaccattccctccatcagcaaataccacttagctgcctgttacaggttggattactcaggaagccacctaattctaacatggaaattaggaagtttattaggaagtactctcaggaccaacaactgtggaggaaggaaggaaatggaattggggaaactttacaaattcaattaagacctcagttgactgaccccacagggagctctgaagctgagatggtccttcatagttttcacaggtttgggcaagtctttattccttcatatcaaccagtcattggatatgggctgccccaggtaagggggtgaccttgggtgagacaactcttttcctggtctaatacaatgttatatagaatcctttgtcagtagataactataaatccttggataatggtgctaagtttctgtgagcaagaaaggcaaacccatacatagaatatgtgtataggtcagtccagaagaatctatataaaggacatctactgtagccaaattaccatcaaacagctgattggtctttgcaaagtataagtgctatattagaagctcagtgtttacctctgctgttggcagctctaagagctagatgagcctgggtaagtaggagctcatgctgttgggcccgtacacagtctccatctctgccagcatgtctactccattcatgtgcccattgtgtcattggagtagcctatgatcaaggctagcagacttccacaaaccacataattttgactgcctagttatttagtgctgattctgtgttgaatgctttctggtggctgtttaacatgaagtatccaaaggtcctaacagtttatgccactcccataggctcatccagaagcctctaccccagaatttcttgcccttaatcctcctatttttctatttcttggcctctgaccaattggtcaagccattcaccacttcttatgaatatactccaactatagactacttttctttctacattcatgtacttcattattcagtttgtacagaaagaaaggtagcctatggttggaatatattcataagcaactaaaatagttcttagaaataaatttatagcactaagaacttccattagaaaagaaaaaagatctcaacctcatcttctacctagaaactaggggaaaaaaacagttaaaaccaaagtaaggtcttggctaatgcaataagacaagaaaaggaaataaaaggtatacaaattgggaaggaagaaataaaactgcctttgtttgcaaatgcctacttagacaatccaaaaaaatgaccaaaaaaaaaacaaaaaacagtgtaccaataagggattatagcaaggtcaaaggttaatatataattaatatataaaagtataaattaatatataaaaaattaatatataaaagttagtcatttttactacctatcaggtactatgcttactacctgggtgacaaaataatttgcacactaaacccccatgacattcaatttacctatgtagcaaacttgtacatgtacccctgaaccaaaaataaaaatttaattaacctggagcaaaagactgaatccaaagtctgtgggcttagatcaggtgtctgaaataaagaataaatataataaaagaaagttatttataaaaaattaaatgctattttgcataagatacttttttttttttttttttgagacagagtctcactctgttgcccaggccggagtgcaatggcactatcttggctcactgcaagctccgcctcctgggttcacgccattctcctgcctcagcctcctgagtagctgggactacaggcgcttgccaccacgcccagctaattttttgtatttttgtattttagtagagactcggtttcaccatgttagccaggatggtcttgatctcctgaactcgtgatctgcctgccttggcctcccaaagtgctgggattacaggcgtgaaccactgtgcctggccataagataaattttttttaagtatattaaaattattcccttatgtttataatatacatttttagggttgtattttctttttaataatatcatttgtgtagggatctttgcacattgcctgatgtagatttaagaatataatctatatgacaaagaaaaagtcatttttctgtattccaacaataaacaagtggaatttaaaattaaaaacacagtatcatttaaattagcaccaaaataatatttaagtataaatctagtaaatgtttctctacatgaggaaaactgtaaaattctaatgaaagaaattcaagaacactgaaatacatgaagaggtattccctgtttatggataggaagactaaattgctcaagactaaattgatgaattcttcccagatcaatttatagattccacacaattccaatcaaagtcctagcaagttgttttatgattgtcaacctactgattttaaagtttatatagaaaaggaaaagacctagaataaccaacaccatattgaaaaagaagaaagtcagaagactagcaataccagacttatttcactgtaaagctatagtaatcaagacagtatgttggcaaaagaatagaaaaatagatcaatggaacaatagagagcccagaaataaatccacataaatatagtcacccaatctttgacagaggaacaaagatagagcagagatagtattttcaacaaatgtcactggaacaactgaacatctcataagaaaaaaatgaatctagacacagatcttacacccttcagaaaaattagaatggtttatagacttgaatgtaaaacacaaaatgcaaaactcctggaagacaatataggagaaaacctagatggccttgggtatgtcaatgactttttagatataacaccaaagtcatgatccgtgaagtaataattgataagctggacttcactgaaattaaaaacttctgctctgcaaaagacaataacaagagaaagaaaagtttttttggcaaaaatatatttgtaaaagatgcatctgataaaggagtgttatccaaaaaaatgcaaagaactctaaagactcaacaatcagaaaacaaaccaaatttagaaatggatcaaagaccttaacagacacctcaccaaagaacatatacagatgacatataagcatatgagcagatgctccacatcatatatcatcagggatacacaaattaaacaacagtaagataacaccacacacctattaggaaggccaaaatccagaatactgacaacaccaaaggctagtgaagatgtggagcaagaggaacttgcgttcattgctgagaagagtacaaaatggtatagtcactttggaagacaatttgacagtttcttacaaaactaaacaaactcttaccatacaatttagccattgtaatttttggaatttactcaaaggagttgaaaacttatggctacataaaaacctgcacatagatatttataacacctttatttataattgccagaatatgcagccaaccaagatgtcttttagtaggtgaatcagtaaagaaacgggtacatccagaccatggaatattattaagagttaaaaagaaatgagctattaagccatgaaaagacaaggaagaactttaaatgtataataactaagtgaaagaagccaatctgaaaagattacatactgtattattctaactatatgacattctggaaaaaagcaaaactatggagacagtataaagataagtggttgtcagagtttggtggcagggagggggcaagtgatgaatatggtggagcacagagaatttttaggcagggaaaatatgtagtggtagatacatgtcattatacagttgtccaaacccgtagaatgtacaacaccaagaaagaagtctaatgtaaactgtagactttgaatgagtataatgcatgaatgtaggttcatgtattgcaacaaacatatcactttggtggggggtgttgataataggggagtaggtaatgcatgtgtaggaacagtgagtatatgggaaatctctgtgccttcctcttaatttggctgtgaacctaaaaactgctctaaaaaaataaaatttttaatttagaaaaaattaaatagaaaaaaggaataattaaggttagaatggcaatcagtaaaataaaaaaaaaaagaaaagaaaagaaaagaaagatgcatttttgtagatttttaaaaatgaaaccaaagctggttctttgagaaaatcaacaaaaccgatgaacctctatctagactgatcagaaaaaaaaaggtaaaagacacaaattaccaatatagaaatgtgagacatgacagcacacagattctacagatactgaaagaataatcaagggactattagaatcaactttctggtaataccttcaacaactttgatgaaatggccaaattacttaaaagacacaaaccaccaaaagtcagaacgtgaaataggtaacctgaataacactgtatcagttgaagaaatggaatttgtagtttaaatccccaggcccagatagcttcagtagtgaattctatcaaactttaaagaaagaaataataccagttttacacaaactcttccagaaaattgaagagaagggaatatttttcaactcattctatgaggcagcattcccttgacatgaagaccaaagatattataagaaaggaaaattatagacaagcatttcttaagaaaagttgtaaaaattgttaacaaagttttaagtaatcaaatttagtaatatataaaaaggacctctccctcctccccccctcccctcctcccctctgcacggtctccctctgatgcccagccgaggctggactgtactgccgccatcttggctcactgcaacttccctgcgtgattctcctgcctcagcctgccgagtgcctgggattgcaggcgcgcgctgccacgcctgactggttttcatatttttttggtggagacggggtttcgccgtgtcggccaggctggtctccagctcctaaccgtgagtgatctgccagccttggcctcccgaggtgccgggattgcacacggagtctcgttcactcagtgctcaatgttgcccaggctggagtgcagtggcgtgatctcggctccctacaacctccacctcccagccgcctgccttgccctcccaaagtgccgagattgcagcctctgcctggccgccaccccgtctaggaagtgaggagcgtctctgcctggccgcccatcatctgggatgtgaggagcccctctgcccggctgcccagtctgggaagtgaggagtccctctccccggccctcatcccgtctaggaagtgaggagcgtctctgcccggccgcccatcatctgggatgtggggagcgcctctgccccgccaccccgccaccccgtctgagatgtgaagagcgcctctgcccggccgcgaccccgtctgggaactgaggagtgtctctgccccgccgccaccctgtctgggaagtgaggagcgtctctgaccagccgccaccctgtctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctttgtccactaagggttaaatggattaagggcggtgcaagatgtgctttgttaaacagatgcttgaaggcagcatactcattaagagtcatcaccactccctaatctcaagtacccagggacacaaacactgcggaaggcggcagggccctctgcctaggaaaaccagagacctttgttcacaagtttatctgctgaccttccctccactattgtcctatgaccccgccaaatcccgctctccgagaaacacccaagaatgatcaataaatactaaaaaaatttaaaagaaaggatcttatatcatgaatcgtgaccacatgaactttatcccaggaatgcaagactgattcagtattagaaaatcaatgtaactcactatattaaggactaaaatacatatccatatatatacatgatcagctaattatatgcaaaagagcatttgatatactccagtatcctttcctgatttaaaactctcagcacactagaaccggaagggaacttcctcatcctgataaagggcatctatgaaaaacctacagctaacatcatacttaataatcaaagactgaatgctttctccctaagatcagaaacacagcaaggatatccactcttacctttcctattcagtattgtactagacagatacctagtacagcaaggcaagaaaaaaaataaaaggcatccagattggcaaggaataagtaaaactggctgtcttggacgggtaagggggacagtcaatgtgatcatctaggtagaaaacctcatgtaatctaccaaaaagctagaactaataactgcatttcacaaagttgcaagatacaaaatcactatgaaaatccaattctatatactagcaataacaattgaaaattgaaattatccatttctgtagcattttaaaaatgaaaaacttagtggtcagacttaagacttacagattgaaaactacaaaactgctgagagattaaaaatcagctgaatatttagagagatataccttgttcatggttggaagactggatattgttaagatgtggtttctccccaaattaatcactagatttaatgcaattccaataaaaacattactctctattttttctatatttattagactttcttgtacaaattaatgaagttgattctaaaattcaaatggaatgccgtagacctaaaatcgccaaaacaggccaggcgtggtggctcacgcctgtaatcccagcactttgggaggccgaggcaggtggatcacttgaggtcaggagttgaagaccagcctggccaacatggtgaaactctgtttctactaaaagtataaaaaattagctgggcatggtggcgggcacctgtaattccagccacttgggaggctgaggcaggagaatcacttgaacccaggaggtggaggttgcagtgagccgagatcatgccattgcactccagcctgggcgacaagaacaaaactctgtctcaaaaaaataaataattaaaaataaataaaaaataaaatcaccaaaacaactttgaaaaataagaaagttaaaggacttataccaccttgttttaagacataatatatagctactgtagtcaaaatagtttggtgttggtgtaaagatagacaatttgatccatgaattagaataaagaacccagaaatagaccccatatatggccggttgacttttgacaaaggtgcaaagataatgcagtggagaaaggatagtcttttcaacaaacagtgctggaacaattagatatccttatgccaaaaaaaaaccccaaaaacctctaaaccctaatatgccgtaagtaaaaattaattccaaacacatcatagacaaaggtacaatataaaatgtttagaagataggagaaaatctctgtgatcttgagttaagcagagattttttaggtatgatactaaaagcatgattcataaaagaaaaaattgataaatatacaaagagctcccaaaacttattaataataaaataagtaatctgatttgttaaagaatcagattgacccatcaccaaagatgatcaagtgtcaataattccatgaaaagatgctaaacatcattagtgattagggaaatgcaaattaaaactatggtgaatacacaccaattagaatggttaacattaaaaagactgaccataccaagtgttgaaaggatatatacctgctagaattcgcatacattgcttgtgaaaatgagtgtaaaatggctaagcccttttgaaaatcagtttggcgatttcttttacagtttaacttaaacctgccatatgattagtcattatacttcagggtgtttacccaagagaaataaaagtacctggccacacaaatgcttgtacataaatactcatagtagcattattcataaaagccaaaatctagaaacaacccccctgtatttgttacctgttgctgcataacagcttatccaaaacatagcagcttaaaacaacaaacagtttgtgtggatcagttcctgtagtctgacctagctcagtgttctgcttcattgtatctctcaagactgcaatcattgtgtcagcccggggactgccgtctaatcaaaagacttgactgctaggcaaagtcactcacatggttgtggacagggtttattcttcaagagctattatacggaaagtctaatttccttgctggatgtggctataggcagtcatcagtttctggcagatggccttatccataagggcaaacatgagagagaagaatcagagaaagagaggatgccaacaaaatgaaagtcacagtctgttatagtctagtctcagaattgacatcccattagttttgccatattctgtttgttagaaggtagtcactagatccagccagaccaggagaaggaattgcacgagagaatggataccagaagtcaggaattattggaagccatatcagaaactgcctactgcaaatatctgtcaagaggagaatagataaaaagatatggtatattcatagaatgtaatactactcaatagtaaaaaggaatgaattatttatacacagacaacatggatgactctaaaaataacaatgctgatccataccaaaagtatatagatttatatataatttatatgaaaagtcagacctaaagtatttgtattatataatcctatttatataaaattgtagaaaatgcaaactaatccaaggtgaaaaaagcagttcatgcttacctggggactggattgggtgcatagaggaaggataggagggaacaattgcaaaaggacacagggagtcttaagggtgatagctatattcaattatgttaattatgtgatggtttcacagaaatatacatatgtaaaattctttatgcccagtagtggtactggcataaggttacacatattggtcactagaatagaattgagagttcagaaataagcctatgcctctactctcatttgatttttgtcaagcattccaagacaacttaatggggaaagaatagtctttttaacaactatgctagacaacaggaaattcacttgtaaagaatgaagttggacccctacctcacatcatatataaaaattaactcaaaatggatcaaagatttaaatgtaagaactaaaaccgtaaaactcttagaaatgaacataggtgtaaatctttgtgactttggattaggcaatgtttttaagttataaaaccaaaagcacaagcaataaaagaaaaagataaattagcatcaaaatttaaagacttgtatgctttaaaggacacaagaaagggaaaagacaacttttagaatgggacaaaatatttgcaaatcatgtgtctgacaagatactaaaatccagaacatataaagaactcctgtaggatgtgagggcaatctggctgctacatctgtcaccccattgatcaccagggttgattcagctgatctggctggctacgcaactgacctcttcctccctcactgctccatgtgtgttcctcccgaaactgcatgctgggttgaagaagatgaccatccccaatagaggaggaccaatcttcagtcaagggtacactagtagctgcgcttccctgccagaacctccaaacaagctctcaagaactcccataactcaatagcaaaggaaaataaccaatttacaaagtggtcaagggatgtaaatagacatttaagcatgtttatttttatttttattttccgtgttttttattttactctaagtcctgggatacacgtggtgaacgtgcaggtttgttacgtaggtatacatgtgccatggtggtttgctgcacctatcaacctgtcatctaggttttaagccccacatgcattaggtatttgtcctaatgctctccctccccttcccccagccctccaataggccccagtgggtgatgttcccctccctgtgtccatgtgttctcattgttcaactcccacttatgagtgagaacatgtggtatttggttttctgtacctgtgttaatttgttgaggatgatggtttccagcttcatccatatcctgcaaaggacatgaactcattcttttttatagctgcatagtattccatggtatatgtctgccacattttctttatccagtctgtcactgatgggcatttgggttggttccaagtctttgctattgtaaatagtgctgcggtaaacatacatgtgcgtgtgtctttatagtagaatgatttatcatcctttgggtatatacccagtagtgggattgctgggtcaaatggtgtttctggtcgtagatccttgaggaattgccacactgtctttcacaacagctgaactaatgtacactcccaccagcagtgtaaaagtgttcctattactccacatccttgccagcatctgttatttccagatgttttcatgatcaccattctaactggcatgagatggtatcaaaaccactcattgtggttttgatttgcatttctctaataatcagtgatgatgaactttatttcgtatgtttgttggtcgcataagtgtcttcttttgagaagcgtctgttcatattcttcgcccactttttgatggggttgttttttttcttgtaaatttgtttaagttccttgtagattctggatattagccctttgtcagatggatagattgcaaaaattttctcccattctgtaggttgcctgttcactctgatgatagtttattttgttgtgcagaagctctttagtttaaatagatcccatttgtcaattttggcttttgtttctgttgcttttggtattttagtcatgaagtctttgcccatgcctgtgtcctgaatggtattgcctaggttttcttctagggtttttatggttttacattgtacatttaagtctttaagcagagatttaaatgtgtttatttggagattttaatatgtttatttaaatagacatttaaatacgaaatatgtctatgtaaatagacattgtatgtgtttactagccattgatatatcttctgtgatacacaaatgtccaataaacacatgaaaagatgctcaatgccattgtcattaggaatagcaaatcaaaaccacaatgagataccacttcatactcgctatgatagctacaataaaaaagattgacaataacaagagtggacaaggatatggagaaaatggaaccatgatacgctcctatttggaatgtagaatagtgtaccaagttcaaaaacagtttgacaggtcatgaaaatgtttaacagagttaacatatgacccagcagttccactcctagatatatacccaagagagttgaaaacatgtgtccaaacaaaaatttgtacaaatgtttatagaagcattgtttataacagctggaaaatggaaacaacccaaatgcccatcagttgacaaatgaataagccaaatgttgtaaattcatatagtggaatattatttggctgtaaaaaggattgaagtactgaaatatgtcacagcatagatggaccttgacaacattgtgctgacagaagccagacacaaaaacctgataatgtataattttacttatgtgatatgtccagactaaacaaattcgtagagacagaaagtagattattaggtacatggaggttagggaaggatatgaggacagtgtgtgaaataatcagctaaagatcagctaagtgacaacagagtagacccatatatataattgacagaattaaagttcccctaagatttatattcaggaggttaaaatgaaaaaacagtcggcatggggggtagtgtgtgtgtgtgtcctgtactcatggaactcagccatgttgagttccatgagaacagttacagagattgagatttaatcaggactatgactttgtcaagaaagtacaactaagtgagagaagaataagacagttgagagtatattcagaagaataactatataggggtgaatacatcaaggaatgagggacagtgaaatagtggtaaaatcagttgattggaggttccaaggggtcaaaggatattgatatctgagtactcagtggagtgagccaaaaatcaagaggtggtcagagagtggcaccatgaaattgaaagtatagaagacttggtctagtatataaccatttgagttagtagcttagataatatggtaggccaggttatttaaggaagggattccaaggaactaagggtgtcagaagggacagttaaggtttttctttctttgattaacggactttatttttttagagcagtcttaggtttacaaaaaaaatgagcagaaagtatgggtaattttctatttctgggctctttattgtgttccattgatgtatttgtctcttatttttccaataccacactgttttgattactgtaactttatagtaagacttcaagtgtggtagtgtcagccctctgactttattcttcaatattgtgttggatattctggatcttttcctttttccctaaactttagaatcagttggccaatctccacaaaataacttgctaagcctttgattgggattgtgttaagtctatagataaatctgggaagaactgttatcttgactatggagtcttcctatgtgtgaacatagaatatctcttcatgtatttcagtgttctttgatttctttcctcagaattttgtagttttcattttgttgaggaacatattttattagatttatgtttaagtatttctctttttcggtgctaatgtaaatggtgtgttttcttaaatttcaaattatgtttgttcattgctggtatatagaaaagcagttgacttttgtatattaactttttatcttgtaacattgctaaaattgcttatcagttccagaagttttttcccttgattcttgggattttctgcataaacaatcctgttatcacaaacagtgacaggtttttttcccttcccaatctatatacattttccttttcttgtcttattgcatttgctaggactttcagtgtgatgtttaatagggatgttgagagaagaaccttaaaattgtgaatcttggagcttatgtaggacaaccagcacaagtacccttcatactcttggagagagaggaacatgcctttgctcttgaatataagcagatcttctatagggaaaggaagggaaggactccacccctggaatataaacaaatatctctggggaagatttgtctgattctctccaaaggtctctaacttactaggctagtttgccagtcaaacatccattaacccagatgccagcaatctttacttagagagctctgagcatgcagaaatgggaaaatattcatggatcattgtttccaatggggagatgaaaattcacctcagaatccagagagcattgtggtgaccaatatgaacagtaattgcaggcataatgtgagcaatagaggcagatagaggtagtgaggctgtccattgtggggactattgaatggtaggtttctatgcctccttcttcatccttgttcccaggggtagagtctaggagagatgtaggtatattccagtgcatggattcattcatgacacaagatgattggatcaccttaggtattttaagctttaaagtgtagagaaatctcagatttgcatatgttttatgatctgtttacagtctaactgatgtcttacttcattcagcttctttccttctgactctaaatttcatacgtctatgattaaatcacaattttctgtaggatctccccaataatatgatttaccaagtcgccattaagtctcttcctcaagactggctgtggtgtgaaacctggtgtgatgatgaatccaaacaaagagccaaaacaattgatctggtgagtgtctttgttttcatttgtatgtaagcagatacagaaatgtttaaatagaaatattttctttctgttttacaaagggagtggcatacgtattacttcgcttcttctgctgttcagtctattacacatttacttaggttggcaagtatagggttattttgggggcccccaagaccaccctgaggtttgatgattcactaaggagattcatgagatgcaaaatataatcatattcatggctatgatttatcacagtgaaaggatataaagcaaagtcagcaaagggaaaaggcacatggggcaaagagaaaatcaggtgcaagattccaagagtcctttctctgtgatatcacacgggacaagcttcattcctcaagcaataagagattccacaaccagtgtgaagtattacctactaaggacatttattagaaaccccagtgtccaggggttttactgggggctggtgaccatatagcactgtctgcctgagacacacctaaatttccagcactcaggaggaaagcaagtgtttagcataaacacctttgcacagataatttagacacagtgagttactcttataaaggaatggtgagaaccatcctgaaccctgtgttcccagatgccagcgaggagccaaacttacaagcaggtctttctaagaatagcaatttcaggctttctgtattaactcttttctgcaaaaggacttttgaaaaaaaggcttagagggctgggcacggtggcttacgcctgtaatccctgcactttaagaggccgaggcaggtggatcacctcaggtcaggacttcgagaccagcgttgctaacatgatgaaaccccatctctactaaaattacaaaaaattagctgggcgtggtggcacatgcctgtagtcccagctactcaggaggctgaggcaggagaattgcttgaacctgggaggcagaggttgcagagagcggagatggcgccactacactccagcctggagacaagagcaaaactccatttcaaaaaaacaaacaaacaaaaaaaaagggctgagagctagctgaaaatgtttgtggattagctatcatcttgacatgtcttcagtttagttatcctgccaatattttcccccaaataaaggcaaacaagacaattttgtctacttaaaatatatcatacatgcttttttcttacttatttttaagagattatttttcctagattttcatttaaagcagtttatgctgtgcagtttaactctcctaaacataaaatatttcaaagtaatttatttgttgtccatttagattttatattccactactaccttgtctttagtaggtataataagtttttttcctagtatattgtttttaatgtgctaagtgtagaaaattgtttacaagatcttcactgacgaataagctattaaaatgttagaattcacacaattttgaacaaaaaagagcaggaaaacaaaatataggaactttttcagacatgtatagaaatacatattttaaaaatagcatgccagcatgttagaatgtaatcatagttggtagaatatagcagaaacaaataaaaaggcatttttaagaggtaagcaagggaatttcataaagagaggccaagaacattattgaacacaactactaatatgttgttagggttctgttgtggctcatacagtagtggtgtaggtcattttgggatctttagtacttagactaacatgagctaccataacaaacccccaaaattcagtggcttcatactcattccagcagcagacctaagtggatatctccgtcattgagtagccctcctgtgtgccatgtctcagggagtactttttgtccacctgtaactgcttcttccagtgcagtagccacttgccttatgtggctgttgagcccttaacatgttgctattctgaattgagatgtgctgtaaggtataaagtacacaccagattttgaatactcaatacaatgaaaataacatatatctcattactaatttttgtattgattacatgttgacttagtattttggatatattgggttgaataaaatatagtattaaaatttatttcacctattcctcttacatttttatacatggctactagaaaaatttagtatttttctagtgaaaaaacccacaaattatgtgtatggttttcattgcatttgtattggatagtaccaatctggagggaaggggaaaaaaagtgtggagaacatatatcttgaatcctaaaggcatggccccttggtgggagttggtcacgtggccatatctagatgtaacaggagctgagaaatggcattcctggatggacagctacttcctagcaatagcaataccaatacccaggaaaaggagaagtggcacaaattttggtgttcagcccgtctccctcatagaaacactaagagtagaatgagagaacatgctattcttcatggaggagaaaagagaatgcagaaaattcccaaggaaatggcctaacagaagaaaagagcatgactaataatattgaaggtgggaatgaaaatgtttatgaatgtcattatactctctcaactttccatctcagagtttttcagcctcagtactattggcattgaggagtggagaattctttgttacaggggttttcctgtgcattgttgggtattcagcagcatttctggcctctgtccactagatggcagtagcaccccaccactccccggccatcacacattttctccagactttgccaaagctccccgaggggcatgattacccagttaagaaacactaataaagcttatagagtgtatgcatgagcacacacatacacacacacacacacaaacccaatgtagtacaaatagctaaacaaaacataatatttttatttttttaatagtatgacagaattaaaaaaagaattagtcccattatcttcactatatagaagacattgcctataaagttaatttctgcaaggaaaattgtgttgtccacttacctcaggaatatgtcactatggaaaagaaatccataatgaatcaactgaaaatatttggtgaggaaagggttaagacaacaggctcacggctcatgactaatagctttcccctaagaaataagaggaaagcaagtggagaaaatgtcaccagaagtgagcttcaagttgcttcctgccttaattctttgtaaatagtgaatgggcttcctttattacttgatgaagtttatactgctcccattgtcttctgtctcagtaaatggcaaatccattttttatattgctcaagccaaaggtactggtggctttgtctttctttgatgcctctctttacttacagctcacgtccaatatatcagcagatcctttcagctgtaccttcagatacatagtgtgtcagactcttatcaaccttctataatttttgcttttaactttaatttcccaagaaactctatagtagtactcaatagtttaaactgattgtgtattgatggaaccttagagattttcctattttaatttcttttgcagttgaataaattaagctacacaccctacacacacacataattatgtgatacatacacatcctactactagtaaatatggagttggaaccctgagaaccgagatgccatttccatgtttttctactgtgcctacaaagcacactagtctgctatgttcttctacatagtggtaatgtaattagatcttttgtcaaaaagttttacataatttttttttgacagacttatgagtcatcagaatgtctttcaacaatttttatttaaatttctgattgaggtatttgtattaagcaattattacatacataagttgtgatatatcatttcacctgatcctgtgtgtattaaacttccagtacttagcaggactctgctttttataaaatgtattttgtttgccctagtgacacagcattgtccttatgtttccaggagcatggtctttcattaacaaaatttacttaaacttttagtgcaataatcccaaaacaaaagaatccaaactaaaagctgctgccagaattgtcccagaatgggtggagtatgatgctgagataagacaactattagatcatcttgaaaacaagaagcaagatacaagtaagtcatcaacgtgttgtgatgtctgaaacatgcgttgcattaatgagattagaatagactacagactcatttcttagtgaatttataaaatgattaagaatttctttaagaaagtctgtggcataatttaaaggtgtatttttgtgtagactaagcttacaagtttaaaacatagataatctgtttccccatggatacagcttcagctcataactctatatggatagatagtgtaacattagtctcctgacacaacatagaggtgaaaaataaaagtaaaaggagtgtttgtctttaagattgcactgaatttcctaaatgtgaaaatttgagcaagtcctaaaaattaataaaagctttacatagctaactaaaaatatcatttcctatctccaaaattaatctcatatataacagaggtttccctacatgtttgtggttctagtatgtttaatcatgggctggagaatgacttggattagatttgcttcaattccttttatgaaaaaaactgtggctaccttggcatttcattgccctacataagtgttcaacaaatgtgctgaatttattttttaaagctgatacaaacttcttgattgtcctgtaattctctttccctgtcagtgctgcctgtgtctccctattcttcactctttcttaaaaaaccccctgaactcctattgtgttcgggtcagtgtgttagagactttcactagattatattggctaatactctcaataattcttcccagtggttcagaatacagttctcattttcctcagctttactgtttagggaagccgaaatgattatgtataaactgtctcatataaacgtgaaattgtttcatcttgactttaaaaaaaaaaaaaagttttcctttaaaaaaaaaagttttcttggtgtgttcaaaaagttcattatacacacccatgtatgtataataatttagtatagataaagatactatttcaattcataagaaaatattctgtaagtggtatgatatgactttttttaaagggagagaagtaggatgacaaagggaggagggagagaaggaaagaaagcaggaagaaggaagaaaggaaaattacctcaacaaaaaacatctttttcttatatataagtatttcttttatcaaattgggaaagaggtaacagttaataataatgagcattggtgagaatgttggaaagttagcatttttatacaagtaaacgtatagtagctgtataagttaaggaaattttatatgtataaaaacttaaaatttgtataccctttcacccagcaattcacttcaacaaacttaaaaaaagaaaaatgatgtctatattggtgtttattatagcattatttttaacaatgaaatagaaataatctgtccatcaatagacaattggttacataaacattgatacaaacaatgaaatacagtgtagcctttcaagacaaacaaggtaaatgtatttgtgctggcagcatattttaagttaaaaaataggttatagagcaatatttataattgatctcgtttccattaaagaaaaatcataggtctgtatgtatgtgtttgtgtatagatatgtatataagtaagggagagaagttttacaaaagagatttttttttattattattatactttaagttctagggtatatgtgcacaatgtgcaggtttgttacatatgtatacatgtgccatgttggtgtgctgcacccactaactcgtcatttacattggatatgtcacctaatgctatcccaccccctacccccaccccacaacaagccccagtgtatggtgttccccaccctgtgtccaggtgttctcattgttcatttcccacctatgagtgaggacaggcggtgtttggttttctgtccttgtgatagtttgatgagaatgatggtttccagcttcatccatgtccctacaaaggacatgaactcatccttttttaaggctgcatagtattccgtggtgtatatgtgccacattttcttaatccagtctatcatttttggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttttagatccttgaggaatcgccacactgacttccacaatggttgaactagtttacagccttaccatactgtaaaagtgttcctatttctccacatcctctccagcatctgttgtttcctgactttttaatgattgccattctaactggtgtgagacagtatctcattgtggttttgatttgcatttctctaatgaccagtgatgatgagcatcttttcatgtgtctgttggctgcataaatatctttttttgtgaagtgtcttcatatccttcacccactttttgatggggttgtttgattttttcttgtaaatttgtttaagttcattgtagattctggatattagccctttgtcagatgggtagattgcaaaaattttctcccattctgtaggttgcctgctcactctgacgatagtttcttttgctgtgcagaagcgctttagtttagttagttcccatttctcaattcttgcttttgttgccattgcttttggtgttttagtcatgaagtccttgcccatgcctgtgtcctcaatggtattgcctaggttttcttctacagtttttatggttttaggtctaacatttaagtctttaatccatcttgaattaatttttctataagatgtaaggaagggatccagtttcagctttctacatatgactagccagttttcccagcaccatttattaaataaggaatcctttccccatttcttgtttttgtcaggtttgtcaaagatcagatggttgtagatgtgtggtattatttctgagggctctgttctgttccattggtctatacctctgttttggtaccagtaccatgctgttttggttactgtagccttgtagtgtagtttaaagtcaggtagcatgatgcctccagctttgttcatttggcttaggattgtcttggcaatgcaggctgttttttggttccatatgaactttaaagtagttttttccactgaatctatgaattaccttgggcagtgtggccattttcacaatactgattcttcctgtccatgagcatggaatgttcttccatttgtttgtgtcctcttttattcctttgagcagtggtttgtagttctctttgaagaggtccttcacatcctttgtaagttggattcctaggtactttattctctttgtagcaattctgaatgggagttcactcatgatttggctctctctttgtctgttaatggtgtataggaatgcttgtgatttctgcacattgattttgtatccagagactttgctgaagttgcttatcagcttaaggagatttggggttgagacgatggggttttctaaatatacaatcatgtcatctgcaaacagggacaatttgacttcctcttttcctaattgaataccctttatttctttctcctgcctgattgccctggccagaacttccaacactatgttgaataggagtggcgagagagggcatccctgtcttgtgccagttttcaaagggaatgcttccagtttttgcccattcagtatgatactggctgtgggtttgtcataaatcgctcttattattttgagatacgtcccatcaatacctaatttattgagagtttttagcatgaagggctgttgaattttgtcaaagaccttttcggcatctgttgacataatcatgtggtttttgtctttggttctgtttatatgctggattacgtttattgatttgtgtatgttgaaccagccttgcattccagggatgaaacccacttgatcatggtggataagctttttgatgtgcttctgggtttggtttgccagtattttattgaagatttttgcattgatgttcatcagggatattggtctaaaattatcttttgttgttgtgactctcccagtctttggtatcaggatgatgctgtcctcataaattgagttagggaggattccctctttttctattaattggaatagtttcagaaggaatggaaccagcttctctttgtacctctggtagaattcgactgtgaatccgtctggtcctggagttttttttggttggtaggctcttaattattgcctcaatttcagagtctgttcttggtctattgagggattcaacttcttcctggtttagtcttgggagggtgcatgtatccaggaatttatccatttcttctagattttctagtttatttgcgtagagttgtctataatactctctgatggtagtttgtatttctgtgggatcagtggtgatatcccctttatcattttttattgcatctatttgattcttctctcctttcttcattagccttgctagcggtctgtcaattttgttgatcttttcaaaaaaccagctcctgaattcattgattttttgaagggttttttgtgtctctgtctccttcagttgtgctctgatcttagttatttcttgtcttttgctagcttttgggtgcgtttgctcttgcttagcttgttcttttcattgtgatgttagggtatcaattttagatctttcctgctttctcttgtgggcatttagtgctataaatttccctctacacactgctttaagtgtgtcccagagattctgatatgtccaggttgcagcagagagagaggtttaatcatagggctgccaaatgaggaaacagaatgaaaactcaagtctgtgtccctgagcagtttgtgactagtgatttttaagggttttggagggagccagagtatggagagcattgattggtcgaagagtgcaaggtgaagtcgtggtatagggagatgaagaaactatattctcatgctgaattggttactttgtggggatcttcaaactggttggtgtcagctgttctgctggaactcacgatctgcttaggcaattcttaaaagccttatgattctgatgtcagaaatcccatccacaagaacaatggggatgcaaatggtcagtatctagtgctaagtaactttcagttacaaggaagtgggtcaaagtgctgcctgactaatagttaaccatacttctgtccagaattcttgtttaactctataaggatggcttgagatatagtatatcttttataatttacatttctctttttcattatattagtttgctagggctgctataacacagttccacaaactggctggcttaaactggacatttattgtctcacagttctggaagctgaaagtccaagatgaaggtgtccacagggttgataccttctgagggctgcgaggaaagaatttaacacagacgtctctccttggtttgtaaatggctttcttttccttatgtgtcttcacattgtcttcacattctctgtccttgttcagttaggacacctgtcatattggattagggtctacgcttatgaccttattttaacttgatttcctctgtaaagatcctgcctccaaataaggatacatttggagataccagaagttagaattcttgtaaattttgtggggaccaaaattcatgtatttttgaaatatgaattaaacccataacatgggtggagttaagaatcttgtcatatatttaaaggccattagtatttcttccgctgttcttgtcatttgcctgtttttttctagaggattgttgcctgacactggaagaaattaatttctgttccacacatttgtattgccatctttatcatatattaaattccaatattaggatgtcttgtttggccctttttattccgttccattggtctctgtctatacatgtgccaagtacataccactttaattattaaggacttatattatgttttaatatcaagtaaggctagcctttccttattactcttcttttttgttgtttttctgtgtattcttgttttttttccatacaagccttagaatcaacttagtttcagaaaattttctgtgtttttcttggggggctgtgtgggatggtcagagaaaggattacattaattagttggcttgagagaattgacatcttcatggaaactactgtctcagaatacattgtctttctatatattcaagtccagttttcctcaagaatcataacattttaatcatatagcttatatatatatatagtttaagcttttctttgctactgttataaatggaatttttctcttgaagaatatcttcttactggtggttgcttgtacataaagactactttctatacatggatctttatttcccatgatcatactgaatttttatattggttgtagtaatgtttcagcttattctcttgggtttttccaggaatacccacatcttatctccaaataaagatggttttcccttttcctttctgatcattgtacatcacactgtttttgtttgtttgtttgtttattttacttgctttgacttatacatctaatacggtgttaaataataaagtggtggtagtaggcctttttccttactgtggttgaccaacttctatgtttccccgttaagataatagtgttggactgaagaagaatatttttatcatcttgaggaaataaccattgattcctattttaatatttttatcaaagatgggttgaattggttgcattttatcaacttattcaacagaaatagaggtgacacataatttttcaacttatagattataaactacaacattatttgtagtttattataaattataatctataactatattaatatatttcctaatatcgaatcattttttctaatattgaagcatccttgtattcctagaataaactccacttggccccacaggttggctggacacagaagagcagtagcaatcactgtagtctggttctcagagactcctactcctaggagaaggggaagagcaccacatcaagggagcaacctgtgggacaaaagaattcagacaacaggccttgagtcccagatctttctgctggtgggagtttctttcagcagagacataattgcagtgctaggctcagcaggaaaaagtctggagctgtaccccaacattcaggcagacttggtgctcttggagggtcttggagaagacctttcccaccttgtccaccactgcagacacagctggggcttctcccacaggagctcagtgtggctgaacctatagacagccttcctggaacacttcagggtgactgcattgccgcaggagaggtatcctccaggttcaggcttgcacaagaggcagtcacaattcctctctccttagaacatcaacatgcctacagataaaaatacctgaatagctggaccactgggataagagtgagtctgggagttggatagctttcttgcttggcctggcaaggaagctgaggtggctctcactcttccccttgttaagacatcagtgcatctaattgagagctccctcagccaccttcatcaaggctggtacctctgtccaccattggatattacatttaccacctgctttagctacaacaggttcctacccagggataccactcctatcctgaagcctgaaccatcaactcagtaaataaaatactggggagaaattaaattaaaaagtgcacaccacaggggaatgaggtaagcttcaagagacctctgccattacaattccataggagatagcaaacttgccaacacactgagtacatgactattacaaccacatctgaggaagccatcatagaaagactctccacaaccaaggaattcatagagtcttcactcccaaaagcacaaataaccaaattaagctataataaacattaaactcacattcttaagggggaaagaagaaattaaaaatgctgtcaaataaaaaataaagaacaattagaagaaatagtatacccaaatgagaaggaaccagaaaagtaattctggtaatatgacaaaacagtgttctttaacacccccaaaaaagatcacacggtctctccagcagtggatccaaaccaagatgtaatctttgaaataccagataaagaatttagaagattattacactactcaaggagataccacagaaaggtgaaaaccaacataatttttttaaaattcaggatatgaatgaaaaattttctagagagatataaagaaaaatcaatcagaactctggaaatgaaagacatgcttagggaactataaaatgccatggaaaggttcaacaatagactacaacatgtagacaaaagaattttagagctcaaagataggcttttgattaatccaataagacaaagataaaaaggaatcaaaagaaatgaagaaagtctttaagaaatatgggattatgtaaaacatccaaacctaagaataattggtgttcctgaggaagaagagaaggctagaagtttgcaaaacttatttgagggaataattgaggaaaacatccctggccttgctagagatttagatatccaaatacaagaagctcaaagaactcctcggaaatttcattatgaaaagatcatcaccgaagcacacagttgtcaggtatctaaaatcaactagaaggaaagaattctaagagctgtgagacaaaagcatcaaataatctgtaagagaaaacctatccgactaacagcagacttctcagcagaaaccttataagctagaagggaaatggggtcctatctttagcctccttaaacagaataactgttagtcaagaattttgtatccagcaaaatgaataaatccagtaaaactaaaacctttcataaacgaaagagaaatgaagtcattttcagagaaacacatgctcagggaatttgctactaccaaaccagcactataggaaatgctaaaagaagttctaaatcctgaaacaaaagttcaacatgcactaaaatagaacttcttaaaagcaaaaaataaaaaataaaaaactcacagagcctgtaaaactaacacaacaacaacagtttatctaggtaacaactaatattgatgaatagaacattaccccatatctctattaacattgaatgtaaatggcctaaatgctccaattaaaagatatagaatggcagaatgaatttaaaaatcacaatccaaatatctgctttcttcaggagacttaactaacatataagaattcacataaattcaaggtaaagggatggaaaagataagctacacaaatgaaaaccaaagcaagcaggcgtagctattcttatatcagacaaaacagactttaaggcatcagcagtgaaaaaagacaaggtcattatataatgataaaaggatcaatccaacaagaagatactataatactaaatttatatgcacctaacactggagctctcatatttataaaacagttactactagacccaacaaataaaatagcaacacaataatagtggtggacttaagtactccactgacagcactaaatagattgagacagaaagccaacaaacagtggacttaagctataccctaaaacaaatggacttagcagaagtttacagaacattctgcccaacaactgcagaatatacattcttcttagcacatggaacattctccaacataggccacaaaacaagtctcaataaatttaagaaagtcgagatcatatcaagtatcttctcagacaacagtggaataaaattagaaatcagctcccaaaggaactgtaaacactatacaaatacatggaaattaaataatctgctcctgaatgatttggggattaataatgaaatcaagatggaaattcaaagattctttgaaatgaatggtaatagtgacacaagttatcaaaacctctggaatacaacaaaagcagtgctaagaggaaaagtcatagcatcaaatgcctacatcagaaagtctgaaagagcacaaatagacaacctcaaggaactagagaaacaggaacaaactaaacccaaagccattgaaagaaaagaaatcacaaagatcagagcagaactaaatgaaattgaaacaaacaaaaaagaacaatgaaacaagaagctggttctttgaaaagataaacaaaattgatagatcattagtgagactaaccaaaaagagagaaaatccaaataagctcaattcgaaatgaaaccggagacatcacaaacaatactgcagaaatacaaaagatcattcgagaccactatgaacacctttacatgtacgaactattagcatagtactggaagtcctagccagagcaattaggcaagcaaaagaaataaaggacataacaaagtggaaaagaggaagtcaaactagtgctgttcaccagtgatatgaccatctacctagaaaaccctaaagacttatccaaaaaaatcctagttctgataaactaattcaataaagtctcaggctacaaagtcactgcacacaaatcagtagcactgctatacacgaaggatgaccaagctaagacacaaatcaagaagtcaatcccttttataacagctgcaaagaaaagaaaatacctgggcatatacctaaccaaggaggtaaaagatccctacaaggaaaactgctgaaagaaatcatcatagatgacacaaatgaaaacacatgctgtggaaataatcaatattgtgaaaatgaccatactgcccaatgcaacctacagattcaatgcaattcccatccaaataccctatcatttttcacagaactaggaaaaacaatcctaaaattcatatggaaccaaaaaaagagcctgaatagctaaagcaatcctaaacaaaaagaacaaatctggaagcatcacatcactagatttcaaattctactacaaggctatagttagcaaaacagtgtgatgcttgtataaaaataggcatgtagaccaatggaacagcagggagaacacagaaatgaagccaaatacttacagccaactgttgtttgacaaagcattaaaaaacataaactggggaaaggtcaccctattcaataaatgatgctgggaaaacttgcaagccacatatagaagaatgaaaccacatccccatttctcaccttatacaaaaattaactcaagatggctcaaagacttaaatctgtaaccataaacattttagacaataacactggaaaaactcttctggacattggcgtaggcaaagaattcatgaccaagactccaaaagcaaatggaacaaaaataagtaaatgggacctaattaaaaagcttctgcatggcaaaagaaataatcatcagactaaacctacaacccacagaatgggagaaaatatttgtgaactatgcatctaacaaaggactagtatccagaatctacaaaaaactcaaattagcaagaaaaaaataatcccatcaaacgtgggcaaaggacatgaatagaaatttgtcaaaagaagacgcacaaatggccaacaaacatgaaaaaatgcccaacattactattcagcagggaaatacaagttaaaaccacaatgagataccaccttactcctgcaagaatggccatgaagaaaaagtcagaaatgagtagatgttggcatggatgtggtgaaaagggaacacttttaccctactgttgggactgtatattagtgcagcctctatggaaaacagtatggagactctttaaagaactaaaagtagatctaccattcaatacagaaatcccgctgctaggtatctccccaccggaaaagaagttattgtatgagaaagacacatgcacacacgtttgtagcagcacatttcacaattgcaaagaaccaacttaaatgccttaaccaatgagtagataaagaaaacatggtatatatatcccctggactaaaaggaatgaaaatactagtaaggaacaaaataatgtattttatagcaactgggtggccattattctaagtgaagtaattccggaatggaaagtcaaataccgtatgttctcatttataagtgagagctaaactgtgaggacacaaagatgtacagtgatataatggactttggggacttgaggcagaaggagggaaaagggagtgagggataaaagactgcatattagatacaatgtacactactcaggtgacgggtacactaaaatctgagaattcaccgctatggaattcatccaagtaaccgaaaaccacttgcaccccaaaagctattgaaataaaaattttaaaaaagaataaacttcacttggtcatgacctattattcttatatgtgctggtagtcttgtctctaatgtctaaatatttttgcctcaatattcatagatgaaaactgtagagctcttttgtgcaattttttcaggttttaatatttatttttctattgttaccaaagttaccaccacttcataaaaagaattaggagctttgtattccttttttgtgctctggaacagtttacatagcagtgggacatggggctttttaggggagtagactgctttgtctgcttcttctgtggaaattaatctgttcaggctttatatagcttctggagtcagttttggcaaattatgttttccaagaaaaagatttatattggatatattctatagtgtcataaaaagtatcccctttaaaaaaaagtctttgtttcttgtttattttatttatttattttttgagacagtttcactctgtcacacaggctggaatacagtggtgcagtctcagctcaaactctgcctccgaggttcaagtgattcttgtgcctcagccttccgactaggtgagattataagtgtgtgccaccatgcctggctaatttttgtatttttagtagagatgaggttttgccatgtaggtcaagctggtcttaaactcctggcctcaagtgatctgcccaccttggcctcccaaagtgctgggattacaggcatgggccaccacatccggcctatttcgttccttattttgtacattcatgctttctcttatttttctcctgtttttctacattgtgttagctcagttttagttgattctacccctttgacctaagagttgtataatgaagactgatgttttcctatgtgaaagagcctttatgttttctgattttgttatttctattgttattgtattgagatcaaataatattgtctgtattatttcttccttttacaatctattgttgttttctttgtggcctaataccagtttttatgaatgtttcatgagttcttaaagagaagatgcattctctttaccgaagtatagatacatacatacatatatacatatatactattacatacatacatatgtatacatgtatatgtgtgtgtgtgtatatataaggtctattttattcattatgcttttagggcttccataagcttatttattttggtggtgagcagtgactaaatcaaagatagatgtaaggataacaatggtatataaataaatgttagacagtctaataaggcaggaataatacaacaacaaaaaatagaaagggagaaaaagtagaagaataaacttgcttactactctatttgtaataactggcagtcaagtgatgttgaaagttgacaaatgtaatagaagcttaaacatattcaagagtataataaagggaaacaccaagaaaggtaatatattatcaatatttaaaaactttttagctcatcttggaatcttaagttataattgtcatctactttgtgtgattttggggtaagttttcattaactgtatgaatgttagcctattttttatttctcatagtattttgaatgaatttttgaatgaaagagtttcctagacttggagcacaggaggatcctagggaaggtaatatataatgggtcatggttgtttcagctttgtagtttagtgttttctctactgctgctgtgggaaaggcctagaggtaactcttccatgtgtccgcagctctggctctcaagtcctagcctggttgagaaaggcttcttcctgcaggtctctgtttcataaatccctcctcttgccatcccaggtgacgccactatagctggtattttgtgagatcttccccctctgtacccacagcctgagccttgattagctttctctctctgcctccccagtaatcagtcctgccctgttcaagctacatcacactcacaggcacttcctctcagtaacaggctcttgctcttctggaagatgctagagacttctcagcacctgtcagaccacctttcccttaacatgtttctcttccatagtacctttgcaacttcccatccagttctgctgtacaactctgttttcagcagtacttaaccacaattttgagtttgcaggttttctgtttcttagttttgctgaaatgttgtttgtggattttgttttgttttcttcttgttgttatatattattaacaacaagaaagagggacaattcacaaataagctgccgccatgttgttctggaaacagatgtcaatgcaaagattttcttttcttttttgagacagggtctcacactgcctcccaggcttgcatgtagtgcatagtcatggctcattgcatcctcgatctcctgggctcaagcaattttccagcctcagcctcctgagtagctgggactacaggcgtgcaccattgctcccagctaatttattattgttgttttcagtagagacgagggctcactgcattgcccggggctgttctggaactccctggctcaagccatcctcccgccttggcctcccaaaacgttgggataataggcatgagtgcctggccagggtatttttggtgctatgcatttttctcccaggttctgattctgataaatactagacttttattataatttttataatatagtttggatttaattttttatttggttcaaagagaagttgttgttttcattttaatttcctatagtagtgggttttctcctaattttggtatcaatttctagtttaatttcatgatgggcaatgaatgtcatctgtaatattgctccctcttagaatttaagtttttcatcatggcttttttctttaatgaagcttctaatgttataatctttgctattttttagaatttgcttttagaatttttagaatttttttgaatttgcttttgcatgtcttcagccttttattttcaacattcgtaagttttaggtatatattttttatacttacattgtggtttttttccttccaatgtttttgtgttttagagacaggctgccactctgttgcccaagctggaatgcagtggcaatcatagctcactgcagcctcaaactcctgggctcaagcaatcctgccactcagcctcccaagtatctgggaccacaggcatgtgccaccatgcccagctaattttgtttctcctgtagggacagggtcttgctatgttgtccaggctggtctccaactcctggcctgaagcaatctgcctaccttagccccgcaaagtgctgggattacaggcctgaggcactgcacgtgatctttccttttaatctgagtataaatttttctaacttttgagttgttacccttatacttactgattataccagaatgtttatgatcttatgttacactttgattttttgtttttattaatctttactgaggtataagattcaccaattttaagcttacagtttagtgacttttttttgagacaaagtcttgctttgctatccaggctggaatgcaatggtgtgatctcagctcactgcaacctccacctcccgggttcaagcgattcttgtgtctcagcttctcaaagtagctaggattacaagcatgtgccaacatgcctggataatttttgtatttttagtagagagggggtttcgccatgttggccaggctggtcttgaactcctgacctcaagtgatccacctgcctcggcctcccaaagtgctgggattacaggcatgagccactgtgcccagcccagtttagtgactttttactaatatatacagtcatgtaaccaccatcacaatcaagatgtagaacattttccttacctcatgcagctctgcaattcacctttgtggcagaaccttcctttccacacccaactcttacaatcactaagctgctttctgttgtaacagttgtgcctttcctccagtgccatacattgaataagtatatattcttttgtttgaattcacaaaattgaaaccaaagacttatcatgttgttgaatatatcagtagattattcctttttattcttgaatgctattccattgtatagatatactattctatgcttatcctttctatttgatgaacctttgggttatttccagtttggggctattattagtcttagtctggaccatatgttttcatttctcttctgtaaatacctagtagtatgggggtgttgggtcatatggaaagcttgtatttaacctaagaggctgagaagctgttttccaaagtggttgtaacattctaactaacaacatatgagagttccaattgctgtacttcctcactaacatttgatatcactctcttaatttaatggatgcatagtgatatattgttgtagtttcagtttacatttccctacagactaattataatattagttcgttcttacactgccattaagaaatacctgagactgggtaatttataaagaaaagaggtttaattggctcatgtggttccacaggctctacaagaagcatggcagcatctgcttctggggaagcctcaaggagcttttattcatggtggaaggcaaagcaggagcaggtgtcttacattggaggaacaggaccacgagagagaaggggaaggtgccacacacttttaaacaaccagatctcacactaactcactcactatcacaagaagagcaccgagggaatgctgctaacccattcatgaggactctgcccccgtggtccagttacctcctaccagggaattataccctcccacctccaacactggggatgagatttggtgaggacacagatccaaaccatatcgttgtgcttattggccatctgtatattataagtttttttgcaaagtgcctattcaagatttttgctcttttttaagttttggattttgaatttctttggaaaacaaaaaagcccactgagattttgattgcaactcttgttttaaatcagtttggtgaagattaatgtgttgattatgttgagcttccaattcataaatacgatatgtttcttgatttattttggtctttaattactcctagcagagttttagtttgcagtgtacatattttactaagaattttataactgaatgctaatataaatggtatttttaaatttcttgttggttgctaatacatagaaatacaattaatttttgtatattggacttatgtcctgtggctttgctatactcacttattagttctagtagagttcttaggaattttttcataatgggtcctgttatagttgtagagttcacaggattgtcttcacagtggatcatatcttcagcaaataaaaatagttttactttttcctttccagtcttcatagtaatgtgttttatttatttttcttgttgtgctggactggcaagggcctctgggttgagaacagatacccttccatgcctgtttttcatcttagtgagaaggcatttagttttagaccattatggatgatgttagctttgggtcttcatagatgtcctttatcaggctgtaaaagtttccttttattcctagtttactgggagttttaatcataaattgatacttgagtatgtcaaatgctttttcaatatctgttgagatgatcatatggcttttctcttgtagttaatatataaattatactgattgacattacagtgtttaatcaaccttgtatttctgagataaagtctacttggctatgatggaggatcctttttatatattgctggttttaatttcctgaaattttcttaaagatttttgcatctgtgttcatggagaatattgttctataattttcttaatgcctttatctggtgttaatgtcaaagtaatgcttgtctaatagaatgagttgaagtcaaaggagattgcctcagatgagactttggactttggagttttgagttaatgctggaatgagttaagactttaggagactattgggaaggcatgattgtattttataatgtgagaaggacatgagatctgaggcaaatcccttcgcctatgagcctgtaaaataaaaaacaagttagttatttccaagatacaaaggagatgtaagcattggataaacattcctcttccaaaaggaaaaaattggccaaaagaaaggggctacaggcccacacaggtccaaaacccagcagggcagtcattaaatcataaagctccgaaataatctcctttgactccatgtcccacatccaagtacactgatatgaagggtgggctcccaaagccttgagcagttccacccctgtggccttgccgtgttcaacccccgaggctactctcacaggctagagttgagtgcctacagcttttccacactgaaggtgcaagctgccagtggatctactgttttgggctctggaggacagtggccctcttctcatagctctgctaggcagtaccccagtggggactctctgtggggggtacaatcccactttttcactccatacttccctagtagaggttctctctaagactctacccttgcagcaggcttctgcctagatacccagactttttttaatacattctctgaaatctagacgatggctgccaagcctcattcactcttgcactctgcatgcctacaggcttaacaccacatgccagccactgaggctaatggcttgcaccctctgaagtagcagtctgagctatatctggggctcctttagccgatgctggagccagagtggtcagaatgaggaaaacagtgtcttgaggctgtgcagggcagcaggaccctgggcctggaccatgaaaccattcttcccttctaggtctctgggcctgtaatgggaagggctgctgcaaaggtctctgaaatgcttttgaggactttttctcattgtcttggatgttagctcttggctcacttttggttatgcgaatatctctagcaagtggttgctccacagcttgcttggattcttcctttgaaaacaagcttttattttctacatggccaggctgcaaattttccacttttacaccctgcttcccttttaaaagttccaactttaaatcatttctttactcccacatctgagcatagcttgctagaaacagccaggacacatattaaatactttactgcttagaaatttcttctaccagataccctaaatcatcgctttgaagtcaaacttccacagatccctagggcacaaacagaatgcagccaagttctttgttaaagcataacatgtatgactttgctccagttcccagccagttcctcatttccatctgagagctcacttcactgtccatatcactatcagcattttggtcacgaccattaaccaatctctgagatgttccaaactttcctttatcttcctgttttcttttgagccctccaaactcttccagcctctgctattacccaattccaaagttgtgtccacgttttcaggtatctttatagcagtgtcccactccttggtaccaattttctgtattaggccattcttgcactgccataaaaaaatacctgagactgggtgatttataaagagatttatggttcatggttctcaggctgtacaagcatggtgccaacatcacttgggttctggggagatataattcacatactatacaattcaccgatcaaaatgtatagttcaatcacttttagggtattcacggagttgtgcatccatcacggcaatcagctttagaacattttcactacctcataaatgggggaggcctcagggagcttttactggtagcgaaggtgaagtgggagcaggcatatcacatggtgaaagcaggagcaagatgagagagagtaaggtgggtacagtataccacacacttttaaacaaccagatcttatgagaactcactatcacaaagacagcaccaagccatgaaggactgccaccaagagccaaaccacctcccaccaagcccccacctccagcattgggaactacaactcaattcaatatgagatatagatggggacaaaaattcaaactatacatttagcctgtaatctctcattctggagactgcattatctgatgtttatatagaccctcaagcttttgtgtttttaatgtttgcatagtgtattttttatccttttacttaaaatctgttagtatataagggtgggtttcttgcagagagcatatagttgggtctttttatccaatcttaaagactgcttgtcactgtagtatttatacaagggtgggccaatttatacaagggtgttctgtgggtaaatctgcttttatacagctcctaagaattgtttttacatttttaaatggttggaaaaaatcaaaagagtaataacttgtggtacatgaaaattatatccaaatttctagtttttctaaaatttcattggaacatagatttgctcattcattcatgtattatctgtggctattttgtgcttgcagtggcagttgcatagttttggtggagattacacagtccacaactaaaaatatttattatctgtctttttacagtaaaagtttgctaacctttcatttaaagcattacatttattgtaattatggatatgattggatttaaagaagccatttcctatttttctgtttgatttgtgctccctatgccttttttccttctttttctgccttgttttgggtttttttcttcaaattccgttttatctccagtattattttattagccatactccctttattttttaatgaagtttctctacagtttagaatatatgtctctaacacactatagtcagccttaaattatattactttgtttcatatatagtgtaggaaccttgcaaccttatacttctgttttttcctcttttctcttatgctattgttataatgcattttactattatatattattaatcccatattacattgtttctatttgcattttaaacaattatctaccgctttgttatataattcacatactttacaattcactaattcaaagtgtatagttcaatggcttttagtatattcatagagttgtgcatccatcacagcaatcaaaattagaacatattcactacctcataaagaaatcctgtcctctttagctcacgccctaatttccctatctccctgaccctgaacaactgatctataaagtactacgaatctacttctgtctccacagatttgcctagagatttcacatggataggattgtccagtgtcataattagtaactggcttatttcacttagcattatgctgttaaaatatattcctatgaatatttatatacaggttttaagtggatattatgttttcattttccttgggtttatacttagtgaaatcactgggtcatatggtaactctatgtttaaccacttgaggaactgtcagactgttttccaaaaccactggctgtattttacatttccaccagaggtatatgaggattctaatctccctacatccttgtcaatacttattatgtctttttgattaaaaatatcatagtggctgagaagtagtatctcactgtggttttgatttgcatttccctgatggcaaatgatgttcaccatcttattgtgtgcttattggcagtctgtatatcttttttagagaaatatctattgagatcctttgcccatttttgaattgtgttttctttttgttgtgtatttgtaagagttctttgtatattttacatacaagtaccttaccaggtgtaatttataaaattttttcccatctttggttgtcttttcattttcttgatgatgtcctctgtggtacaaatgtttatatttttgatactcaggtttttttgtctttccttgcttgtgtttttggtactatagctaagaaactacatttgaccctttaacaacacaggtttgaaccgcacaggtccacctatctgtagatttttttcaacaaacatattggaaaaatttttggatatttgcaacaatttgaaaaaacttgcagaagaaccatgtagcctagaaatattgaaaagactaaaaagctaggtatgtcatgaatgcataaaacatatgtagatactagtgtgttttattatttactgtataaaatatccacaagtctattattaaaagttaaaattgataaatgtatgcacacaaacacagaccatacatggcatcataggcagttgagaaatataaacaaacataaaattaactgtagtatatactatgctactgtaataatatcgtagccacctcctgttgctgttggagtgagctcaagtggtgtatctgcttaaaacactaatcatctccacatgagcagttcataccgtgtttagtgcaataccataaaacttgaataataccatgggacccaaatgaagtcatggattatcactggtgatgccggaagtgctcccaagaagcagagaagaaagccatgatattacaaaaaaaagtcgaattgcttgatatgtacaacagattgaggtcgtcacatgtggttatccatttcaagataaatgtatccagcgtaaggaccattgaaaaaagaaatgaaaattttgtgaagttgtcactgcagctgtgtcagcagcaccaaaactttataattcttgcaaaatacctatttatctcatattaaaaatgcagcttttatgtgggtgcaggattactataagaaaggcttacctgtagactaatataattcaagaaaaagaaaagtcattatgtgacaacttaaagcaaaagtaaggtgcaggatctaaaactggagaatttaatgccagcaaaggatggtttgataattttagaatgaggtttggtttttaaaagtcaagataataggagaagcagctcctgccaaccaagaggcagcagccaggcagcccagctttgctaagggtctctctcagtgtgctgaggctgcggaaaggctgcagcctgcaggcacttggcacacaccctccctgctgctaggatgccaagaggaaggtcagctccaccgaagggacagcgaaggagtagctcatgagaggagatctgcacacttgtcagctaaacctgcccctgcgaaagtggaaactaagccagaaaaggcagcagaaaagggtaaatctccagacagaacgtgcaaacaaaagggaaaggaggagcaaagggaaaatgggctgaagtggctaatcaagaaagtaaagaagatttgcctgcagaaaatggagaaacaaaaaccgtggagagttcagcctccaatgaagctagagagaaagaagccaagtctgattaatatcctataccatgtcttatcagtggttcctgtctcccttcttgtacaattcagaggaatatttttatcaactattttgtaaatgcaagttttttagtagctctagaaacattttgaagaaggaaggaatcccacctcatcccattttttaagtgtaaatgctttttttaaaaagagctaaatcattcaccagtttatttttgggtacaaccagaaaatagtgtgagatattgaattataggaggctttgactatcttaggtgtcaggttaacattccatagatggggggttagtttttatatcctataatacaaagcatactaaacagcaatatggagtcacggtcctgtactgaatgtcttaaacatcttaaattacttctgttcccttgttgttttttagtagaattgtttcctaaagaaaaccactccatattcgtggatttccctgtctgaattgtgtgcactctgtaacatatttagttgtgatagtcctgttttccaataactttgtgaatgtgctgtgaatgaaaatttgagtatgtagtgtacatgctattcagttatgaattggtaggacgtatttaacagcttatcaacatgtgaagatattggtacgtgatagcctcttaaggaaattttgcctccggatattaagctggaaagtcactagagtaacttcacaaagaatttgcaatacatggctttttagatttttggtacatatgtgaagaattgtgtacaaattgaaatgtctgtgtgctgatcctcgacccaaccaataaaatctcaattatgaaagaaaaaaaaaagaaaatcactgaggagaaaggattatttgcctcaacaggtttttaatgaagatgaaatttccctgtttgtagaaaaaaaaatgccacaaaggacatttatttgtaaggaagagaaatgaaaaccaggatttgcaggaagagataggctatctctattattttatacaaatgcagttggtcttaagatcagtaatattcttatctataaagctgctaacccccaagccttgaagataaagataaataccagctgccagtcttttggttgtacaacagaatgtctgggcaacaagaaccctttctctgcattggttccatcaatgcttttgtccctgagatcaggaagtatgttgcctgtaagggactgccttttaaagttcttttgatattgggcaatgctctctggccacccagaactccatgagttcaacactggaggtgtctatcggcccccaaactcaacatctgtaattcagcctctagatcagggtgtcataaggacctttaagccttgttacacaaagtactctttggaaaagattgtcagtgccgtggaagagaaccctgatagaacatgaaagtctggaaggatgataatattgaaaataccatcattgttatagaaaaagccatgaaagttatcaagccccaagcaatacattcctgctggagaaaactgcccagatgttgtgcatgacttcacaggatttacgacaaagctaaccaaggaaatcatgaaagagattgtgaatacggcaaaaaaaaaaaaaaaaaaaggtgagggctgagggtttcaagatacggatttctagaagaaattaaagagctagaagacaccacaccagaagaattaacagaagatgacttgatggagatgagtgcttctgaaccagtgccagacaatgaggaagaagacatagaagcagtgccggaaaacaaattgacattagacaattggcagaagagttccaattattaaagactgcttttgctttttatgacatggatccctctatgatatggagactgaaactaaagcaaacagcagaagaaggattttagagaaataacaaaaaaattagacagaaattacaaggtatttctgtgaagttacactgagtgtgcctgcctctgctgcctccccttctacctcctccacctcttccacttctgccacctgagacagcaagaccaaactaacaactcctcttccttagcctacggaatgtgaagacaatgaggatgaagacctttctgatgacccacttgcacttaatgaatagtaaggtatattttctcttatgattttcttaacattttctctagcttcctttattgtaagaatacagtatataatacatatacaaaatatattaactgtttatgttatctctaaggcttccagtcaacagtaggctattagtaaagtttttaaagagtcaaaagttatatgtggattttcaactgtgcaggggtttagtgtccctaacccccatgttattcaggggtcaactgtattgcccaatccaattcacaaagatttccatgtatgttttcttctaagagcgctatagttttaggtcttatacttagatttttaaatctatctttaatttttaaatatgatatgaagtaggagtccaacttcattctttggcatatggctatctagttgtcccagaacaatttgttagagagactgtcatttccccattgaatggtctgaacacccttgtcagaatcatttgatcatatatgcaaggatttatttctgggctctctattcctttagtctatatgtctcttcttattccagtaccatactgttttaattactgtagctttgtagtaagttttgaaatcagtgagtccaattttttttctttttaaaattgttttggctattaaggtccctcaagatttcatatgaattttaggtttttctgtttctgcaaaaagtgtcattggggttttgatagggattgcatcagatatgtagatcactttgagtagtactgccgtctgatgttctttcttcctgacaacaaatatgtaatgtttttctaacaccaattctccaattcactggacaccaactggatctccagtaattcatttcaactctgacattaactcctggagttaaccttcagaccccacagattaagggcccagcctgcaggactgccccacttcagatatcaaccataaatctgatgcccaggctacccatattcctgcctgaccagctacatacagctccctaagctacaaagttgggttgctgaattgacatcttttttcttttttgatgttagtgtttacagctataagtttccctgatcacttttttttattgcatcccataaatttgtctgcttgtgtgtttaatgactcctgtctttgtttagccttggactttttttttttccactgtgtgttttttttttttttttaataatctctttcccccttatctctgttctctctgtccaagattctaactagttggatttttatacctcttggttcaatcctataccatttttatgtattttttcattgtggttaaaaaaatcacgtaacaagatttactgttttaaccatttttaagttcagtaatgttaagtatattcacattgttttgaaatagaactccagaactttttcatgttgcaaatctgaaactctatactcattaacagttccccttccccctctctccctgcccctggcaaacatcattctactctgtgaatttgactactctagatactttatataagtgggataatatagtatttatttttttgtgactggctgatttcactcagcataatattgtcaagatttattcatgttgtaacatgtgacagaatttccttcccttttaaaagactggataaaatcccattgtatatatatattgccacattttgtttacccattcatccatcgatggacatttggtttgctttcaccttttggctactgtgagtaatgcagctatggacatgtgtgtgtatatctctttgagaccccgctttccattattttggatatgtatgtccagaaataggattgccaaatcatatgaatatttaaggaacctctatttttcatagcagttgcattattttacactcccatcaacagtgcaaaagagttccagtttctccatatcctcaccaacacttcttattttctgggttttttttttttatagcagtcatactaatgggtctgaggtaataatttcattgtggttttgttatgcatttctctaatgattagtgatattgagcatattttcttatgtttgctgactatttgtatatcatctttgaagaaatgtatattcaagttctttgtccattttttaatcaggttatttgattttttgtttttgagttgcagggtttctttatatattgtaaatattaatggcttatcagatacatgatttgcagatattttctcttatttgctaggttacctttccattctgttgatggtgtcatttgatacacaaaggtttttaggtttaatataatcccatctatctatttttacttttgttatatttttggtgtcatatgtaagaagtcattgccatgtcagtgtcatgaagatttttccctatgtgttcctcaggagttttataatttcaggtcttatatttaggtttttaatccatttttagttaattttcatatgtcatgtaagataggagttcagctttattcttttgtgtgtagatatccagtttgcccaactccatttatgaaagagactgttattttcccactgagtattcttggcatccttatcaaagatgaattgatcatatacacaagagtttatttctgggctctctattccattgggctatttgtctttatgccgggaccatactgttttcattactgaagctttgtaatatgttataaaatcaggaaatgtgaatctgccaacttcattctttttcacaatattttcggcatcccttgtgattctgtatgaatttcaggatgagttttcctgtttctataaaaagcatcattggggtttttatagggattttgttgaatctgaatctgtagattgctttgggtagtatagacatcttaatattaaatttccagctcatgaatgtggaatgtctttccatttatttgtgtcttctttcatttctctcagcaattttttgttattttcagtatacacatgtatcacctcctagattaggtttattcctaattattttgatccttttgatgctactgtaaatagaattgtcttcttagtcctatagatcttttgtacttatattttctcttgtttatcttttcctttcatttgtgttctgaaaaaattctttgacattatcttcaatctttctattcatttattttagaggggtaatcacttcttaatttctaacagatctttcttttccctgcttgcttctttttaatttcattttgttcttgttttatggtttcgtggattttttctaatatcccctgaaataccagttagaactgttttgaatattgctttagttcttttcagttcctttttgtttaagctgtcttatgtattcatcttggcccttttttcttttgttactggtcttcctcaaaaacctggagatctttggctgtttgtatatatttaacaatgaaatgttagattgatcaatataataactggtgtgggtttcctctgccagggtttaaatgtgtttctccgagagccttccccaaatgggagggttaattactaactaacccacggtgtacaactggcaggcttccttctaggtgtatggtcatggaacagatcaaagcccatcctgtacaccaccccaaaagcccaaatgagggcgctttactcaagagcagacactcatataaaaataccccttttcggccgggcacggtgaatcacacctgtaatcccagcactttgggaggccaaggcgggtggatcacctgaggtcgggagttcgagaccagcctgaccaacatggagaaactccgtctctactaaacatacaaaattagccaggcgtggtggcgcatgcctgtaatcccagctactcaggaggctgaggcaggagaattgcttgaacccgggaggcggaggttgcggtgagctgagatcacgccattatactccaatctgggcaacaagagtgaaacttcgtctccaaaaaaataaataaataaaccaaaaacctctttccccctctctcccaccctttatttctccctctttgtctctctcaaaattgttcaattttctttcaagaatagacttccactttttatcttagaatagataccaggctatcggctgggcacagtggcttacgcctgtaatcccagcactttgggaggccaagacgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggtgtgaacccaggaggcggagcttgcagtgagctgagatcacaccactgcactccagcctggacgactgagtgagactccgtctcaaaaaacaaacaaacaaacaaacaaacaaacaaacaaaaaaggatagctaataccaggctgtcagtttctcttttggattcagaagaatgagagtggggtggggagctgacaggcacagattttccacggacggccctttacttgatagcctcactgtgtgactcactgtccactggcgtttgttatagcctcgtccagcctcctccatcaggaaagccaactcatcgtttcagcggtgtatcctgggatgaagttgtttcgtgcagtctatccctgtttcccatttcttgaaattcattggtaactttgccccaacaagtgtcttgtaaccacttccctcgttctcattattgtttttcctttttatatttattatctttccagtagaatttagtgaagaaatatagtctgccatcttgaattgtggaacagcatgcatttaaattgtattttatttaatttctgcctgaaaatattgagttctcagtgatttacatcagttggtatgtgacagctcagtgatgcagaagagaccattttgttctctgagagtctcatcagaattgtgcttgcatttatgtagtacttatgtctatgtcagagtgctgtgtcctcccatcttagatgacgactatatattaatatgtcctctgctttctgttgttccattacattaagggtagaatactgtattcacagtgaataatctgttagtattcttcaagacctcttatctgccaggcaggatgctagatcctaaagataacaaagataagtaaggtatgttccttgtcctcatagactcatgggagctcacattctaggtgggtagaaagaccagtagttatgagacaatataatagacatcacagtgtacaaagagctattctcgtgttgcgtaatgaagcatataggtactgaactagcaaataaaggatcctcagtcagtaccggtgcttcctcatcatatgtaagtaatatttaagatatttttatgtttaagatgccagaagctaaataaacttttctcccttatagttttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaacctgattgttcctttttcctgatcaccagttaaagtttgacattttgccagatagcccaggtaccggactagctggtgtttatcaaactatagccttttgtatctggttttatgtgcatccacatttccttattcacaaaatgcatttaaaattacagaaatgcatttaggctgggtgcagtggctacacctgtaatcccagcactttaggaggccaagacaggtggatcagctgagttcaggagtttgagaccaccctggccaacatggcagaaccccgtctctacgaaaaatacaaaaaattagctgggcgtgacggtgggcgcctgtaatcccagctacttgggagcctgaggcaggagaattgtttgaacccgggaggcaggggtttcagtgagccgatattgcgcccattgcactcaagcctgggcgacagagtaagactgtctcaaaaaataataacaataataatattacagaaatgcatttaaaattacagaaacctattttgtatttttccttctgagacaacaataattaataattaagcccatttattccttaactattgttttaaaatggaagtaatattgttgcatagtaatcatttatcttaaacaatgttttaatcttatgcggtatttggattttttaatgtttctaattttatgtcataaaaagcatttatgggcatgtgggatatatgtgtattctctttttaaaaggactaggtacttttatgggaactaagttgaggatgtaaccagtttgtttttctgatgtgtattaataatagatgaataatagtaaatgtttaaaaactatccaactattctaaaatcataggatcatgggactggaagagaactcagtgccatttggacctcatcctgtggagagtctgattcattaggtctaaagtaagcttggtaaatcatgattgtttaaaaagctctccagatggttctgtaattagacaagtttgagaagcatttaatagaattgggccccagccagtgtgccggcccctcttctaaggccctgcctgtaaagctgagcctcaggccatcttggaaattccaggacaacagggaactctccacctctagagacaggctggtccatctttggacagctctgtacacacagttccatcatgagccgaagctcactcctgtgagcttttcagaacaaggctaatccttctgtgtttgacagaacagcccatagagttaaaatactactcctcccatcagctccattcattcctaataagagagcgcctgcctctccctcttgcagtcatcctccctttgttacttgttcgtgtttgtctgtattaaaatggagtgcaccatttatggcctgctctggtggaactaggttattcctgtgagttcagagtatcctatagggtacactcagaggctggagcagtaaatggtcctggggcggccagcgtcatggtgctctccggctcactcttgggagtcagctgaagctggggattggtaagaggtgagactctgtaaggttctaggtcaggccagatgctccacccagctacccagaggtctgctgcggtggctggggcacaaacctcaactataagatggtactttgttttcctttgttaccagcctgtcttcacttctgtgagaatcttatagaaaggatgatcagctgggcagagacaccggattcctacttttattacctacaatggccttctccagtattctaggtcccatattttcatggagtattaagctaaaattacagaacaatgtaaacacagtcttgatggcccccctccctgtttgcatcttgtgatctgagtggccagtttacatgttacatttccaggtgagtgacaccttataccagaaaatccagatttataaataaggtatttctttacagtgagatgttttaattaaatggcttgttttaaaaatgctgttatgtcaagagctctcatgcatacaaactgctgtgcca

SEQ ID NO: 15525 - DNA, 117807 bp, Human
tgtacatttttttctgtctaatgttacctttgttgtaaaattatctttttttaaggaatgctttgtaaagcttagttctaatattacagaattcatagttatgtaattaatctcaaaatcactcaccattgaagacccttgctatttttatttcctataacacgaagtctattatctccttaataatttttaatttccatccttagaacttcttcagctctgctactttttccttaaggccagggtcataggcagcacactggtgataactcactgtctagaaatattgcattttgtttacaaagttattttctatgttcagcattttgctggctgccttgggtacagtacctcaattgaatgtctacacctgcatatttgtggacattgaaatcatctaccatttttcagagacactaccttgtgatataaaaaaacagaagccaaaaaaaaaaaaatcccaaggaatttctgaaggagcctctcttcactactctgctcttgttagaataatgagtaacactggtataacattctacaatttacaagaatatttatctgcttcatgaaacctcaaaacaaacctttgagactatcaggatcctaaccactttacagatgaagataacttacataatagttatggggtttcctggatctgactcctttattcttcacattacattatgttgccttccccacaactaatcaaggactccgttttttcttttttctttctcgaaaccatttcctccatattagttccctttggaatagaagcctttttaaaagtccaccttagtatatcttcagggaatcacaaattcactatgctatttataattcatgagtttctctaatggtatcaaggcagcaaatacaggtgaagtaataattatccacctgatagtacttaacacacataccccgtgtaaaaatactgctggtgtacagtgtgtgtgttggtgacgccggaggaagtggccgtgaacaggcttaatgccgcattgagtaacttcaacctcatcttgctcaggttcatatctctcctgaatttcccctggtaagcgcaagattcaggatccgttctcacagttttttgtttaccagttgatgttggctgcattcaggaacgccttgctctcttaagccacagtgccttcctggtctcttcttcacagggtcttccacaatcgctctttttcctgggcacggtggtttgctgaaagtcggggtggggggcggggcgttcccaagtttccaggccaattacctacctgccttagagcaattacgcacttctctctggtagtccctgaaatgttctaatcatcagatcgccccagcttctcctgaccgtttcttgcttacggctcagttcagacagtatttgttccgggacgctcagcgggaggcggtttttaccggctcactcgagaccccaattccaggcgccctgcagcttccctcagactccccgggaccgtgtttggccttcccattcgtacgctgcggctgcgctttcctctcgtaacaccacgctggcgaacctggaaaggatcaaatagtcccactcgccaacctagcgcggcgggaccggcccaaaagggcctttgcagcctgcgcatgcggactcggcggccgccaccgactccccgtctgcttccctccgggcggcagccgcggtttggagcttgctgacagctctgcgaccggcgggcgcagcctcgtctcgtgcttccacgttatcctatcagggacggggcggggcggcggcctccgcagcctatcagcgcgaaccacgaccccggcgagcccgggaggaaagccgccagaaagaaggcgattggatggcggcggcgctctggggcgtagcgtcgcccgggccccgcccaccgctgccttcctctgctgggctccagagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgagtcctgccctgccccggccaggaagtgggctcccggaccaggccccccgcgctttcccgtctgcgcccgggcgcctgtcccggagcggctcgggaggtggggcgagcgctgggggagcccgcggcctggcttgggcctgagcccgcgcccggttccgggtttgtctggggaagaatcgaggggactggcgggccgcggggccgggacagcgggtttggactaaggaaccgggccgcaggagtcggaggaggcggggtgcgggggcaccgggctacgacttcaggaagtcctgggacgcggagacttgggcagcctttgggtcctggcctcgcttgggaccctcgctgggcgcctggggacactgtcagtcattggtgctggctgggaggaggcactaaggtggccaaaagacttccttcgctctggagttcttgggtggggaaggagtgtcatgtccggctgggagttggaggggacagtgttgactatttaaaaagtgtgtaaccatccccattaagatgcactgtcgtgtagagaaattgttagtttggtgcaatgaggagccgctgttggaattccatctcccggacggccaggcactgagtttgtggttttacaactcccaacatggtgtcattcaacgtatggctggcattacttttccaagttcgctgtaaaaaggttcccttaaaaagatacgaacgattaaatttcacttcagtcctgcagactggaatgttggctactccagaatagcgaaaatagagggctgtcctatcttagatggcagcggggaggagtaagaattaaagttgatagtgccgatttaacgaatgcttctggcgcggttactgtgcgaaatattcgagtgtaatgacacatcacatgcactgatctattttcatccccataaaaagggctagttgtcaaggaggtcaaattaaacctttgagtattccattcaaagggagcgaggaactaaaaattgggaattgtttatagtgaattcttctgaaagttctcaacttttttttttaaagtagtactccccagtttttaggtgtcacccatagcaatgggcttttgcttttgcttcccctggtaaccatattttttgaaccccaaatcagaacacgtagtgtggcaacattgggacaaagaatttgacagtgaggctgcccccagaaaaatctaggggattggaatttgaaggtctgtaccactttaatatgggtcatatattctagttcttttgcattttcaaaagcttcattcctcctgcccccgcaccccaccatccctcatctgtagtatttatctccagttatcattaataatttattttggacacttaagagaaagttgcctatgttctgtttaatggtgatttttttttttaagttacagagatgcacaattttgaatgattgcttttcccactactttttagaattgctgttctgtatatgagtctgtaaggactcttaactcttcatttccctcctgtggtattttccataagaaaaccacatttgagagcttttctgtgtaggaggcactggtgacatttctcagaggagtgccagagtgtcttctttaggaccattgtctgtgtaaaatagcagggacttagtacaggtaacagaaaaaggaaagaaaggagcctttctgtaagccatatcttattcacgaaagcgtgtggtattcattcctactttacagaccagggaactgaggctccaaaggttttactaaagttcattttgtgtgcacgctggagacagaagttaagtagttgacaacatcatgtgagtccaagcacttttaagtgatggcagctgagaaaaaaaatcagcactttttttttttttttttttttgtaattaacaagaaggttatttcctgggaggtttaatacagtggttctcaaacttgagtgtgcatcagaatcgcacatggagggctttttaaaacagagtgctgtaccccacttacagagtttgattcattaggtcttgatgggacctgaaattttgcgtttctagaaagaccctggatgaccacacttgagaaccactggtgtaataaattatatagaggagttaaattaggtgtctgctatgtatttgacactggatttggtgatagggatataaaggtaagaactctgacttgaattagcaaaccgttagcccctgttttcccaaataaattgtgtctggattcactaatctcatagttctctgaaaggcaaatggtgctactgctaggcctgaggcttaataaaattgtgttgtattaaggatttttgttaaataggtaggttttagctgctcttgtcacacaaaaagtaattatgtgagatgatagatatattaatctgcttcactcttattaatctgcttcactattgtaaccattttatgtgtgtatatctcataatactatgttgtaaacatcaaatatatacaatacaattcacttttaaaaaaagaaatgaaggagaatggttatgagagaagtgaatgtggaactaagagtggcacaggatggggaagagataacctagtgtttttctgattttgaaatatttgcctttgttttcttctagatttttctgttaattgtcatccagagacagaaagtatatatcatgaattgaaagtttgagtcttttggcaccctcccttctcaaaggcgtttgaaagagtgaagtctaaagcactagatgagatcgaatttttggaatagaaagaaaactttagtagtatctgctttagtattctcatgttacagataaggaagttatttcatttctttgctaatggtttgtcctcttggtgacttgagtagcaacacagcctgggaacgaaaccttttttctcttatcatagttttatctctttttcttccttaacatgctatctggacccaatttttctttatttcattgagctgattaaaccatatattttggccatggggaaaagaatagttgaaaatatatagttgaaaatctatacgtataaaatattgtgataagttttatttgaaccatgataagttttatttgaacctaacctattaaaggtatgttttgtcttttctaggattttcttgacattatctaaatagggaaagaataaagtagcaaaaatgagtgactttaagtaatttaaataaattaagtatcataaaaggtggtcacatattttctagaattattttaaattctttaataagataggctgtagttagcagtagtatcaaagttccagttctcttgacatagttagtatttgctgagaaactgcctggaaatgcagtggttttcattctgtgaggtaggggaagttgttctgggaggggatgcactgtagtaattaggttttattttcccatatgaagttaattaattgttgttaagtttaatttctactgctgtggtctcttttgattagtgtcctgcagttaatctttgtttatatggaagtatcatgggaacccattcacctgctcttcagaacgcaaacatttcaaccatagatttatttttctttccatatctttagaaagctacttaaaaaaattaaatctgatgagtttgtatcatttggagttctggaatatggagaagactcatttaatcagtcagcaaaggcttttactaactatattgctctttggtgaggtatatatacgtagcatagaactcatggcttttgcttttgagtttacagaccacttagggtttaagacatgcatttgtgaagcattcacgtcctctttttctcctttcccgctttagactgagtggtccattattgtagttagtgtactgcaaatgcccatttattttctggcccctgtaatcttctgttttactcacctgccaaaacccaacactggttaaattcaacttggccaactgtttttataccttataggtaaacacggacggaggaaaatggagacaactttgctgattagtctcatttatctttatttttattttcaattttttttcgagacaaggtcttgccctgtcacccaggctggagtgcagtggcatgatcctagctcaatgtaggcttgacctcctgggctcaagcagtcctcccatctcagcctcctgaatagctgggaccacaggtatgcaccactgcatcccctactaagtttttaaaattttttgtagggacagggtcttctatgttgcccaggctggtcttgaactcctgggctcaagcaatcctcatcccttggcctcccaaagtgttgagattacaggcacgagccaatgcacctggccctgattagtctcattttaaagaaacaatctcagtcgcaaatgcacattaaatactgctaacactcccacaattctttactatgtctattcttgaaaatcaatatttcaaacattttcctcctttctgaagcctctaatttaaactctcctttcctctctcccctacctcattcttttagaccttgtctttactgagaaaatgaaagccatcacaaggcaagttcttctttctacctcaaaattcactagcttatctacatttgtacctattctgctactttttctcatattgaaatacattaaatgtctctattcccagataaatctaatctgtgtacttacaccctggattccatttcctctcaccttctgaaaatgttgctcctacagttgtatctttgtgctgctataacaaaataccacagactgagtaatttataaaaaaaatttcaacctgaattttggagagaacattcagataatagtagatgctgaacttcctgtactatctttctttggctagattccactgtcttctgtgtttctgctacaagacttcttttagactctaccccaccttgctagagtcttggcttagccttctgttcttttttagagaagaaacttagggctttcctcattcctcatattctaagtgctccaacctgaataaccatctctctctctgggattgctctctggtctgggtctgccaccgcctttgcttgaactttagtatctttgactatgagttcttgcctcctttagtctggttcttccagtcttgattgtaactcacgtcatacctttaaccccccacctttaagtttaaaaaaatccttattttctgctctccaaaatataagatattctaatactaatttcagtgaaagacatagttggctactctacctttttccctgcccttgctgcttattttgctgacttatgatcactgcttgtctaaggagaaacctattgtctaatgctgattaggaaatggcatgatgtttggttgtcttacctctctgaaaataatgtttacagaccatgtggcaaaggaataaaaattacctgtggctcaaaagagagtggattgcaaaaacagccaataattcgcaaataatttgatttttcagatgtgtctttatgaatcattgatcatatgtttgacttgataattgttatgtattttagattttattctgatgaattataatacgtttaagtaaaaaggcaaatagttaaattcattcaacaaatattgcatacccactatgtgcgggatactgaattaggtgatacaaagaagaaaagacagctcctcctctcaaacttgcttttgataagttttgtggagttgggactttgagaagcaggcaaattgtgaaaagcaatatatagagagagtgatattgcaaagtgaagtcatgtacttctgagtgtggaaatgcaaaatataggaagattgaaggagctttttttccctctctcaaaacaatacagtgtgagggaaggtttcacaaaggagccagcatttgagggcagaatctttttttttgtttaactttattttattttagattcaagatatacatgtgcaggttacatgggtatattgtgtaatggtggggtggtatgatttagatctgtgccccacccaaatctcatgttcagctgtaatccccagtgttggatctggggcctggtgggaagtgattggatcatgggggtggtttctaatggtttagcaccatcccccagagctgttattgtgatagaattctcacaagatctggttgtttaaaagtgtgcagtatctcccccctctctgtcttcctccggctctggccatgtgaagatgtgcctacttctcctttaccttttgccatgattgtaaatttcctgaggcctccccagccatgcttcatgtacaacctacagaaccgtcagccaattaaacctcttttctttataaattacccagttccggctgggcactgtggctcacgcctgtaatcccagcactttgggaggccgaggtggatggatcacgaggtcaggagttcaagatcagcctgggcaagatggtgaaaccccgtctctactaaaaatacaaaaaaaaaaaaacttagcctgttgtggaggtgggcgcctgaaatcccagctacttgggaggctgaggcagagaattgcttaaacctgggaggcagaggatgaagtgagccgagattgcaccactgcactccagcctgggtgacagagcaaaactccatctcaaaaaaaaaaaaaaaaaaattacccagttccgggtatttctttatagcaatgtgagaatggactaatacagaaaattggtactgggagtggggcattgctataaagatacctgaaattgtagaaggaagcaactttggaatggggtaatgggcagaggttgggacagtttggaggactcagaggaagacaggaagaggaacgaaagtttgaaacctcctagagacttgttgaatggttgtgaccaaaatgctgatagtggtatagacagtgaagttcaggctgaggagggctcagaatgaccgcagatgaggaacttattgggaactggagtaaaggccactcttgctatgctttagtaaagagactggtggcattgtacccctggtctatggatctgtggaactttgaacttgagagaggtgatttagggtatctggtggaagaaacttctaagcagcaaagtgttcaagatgtgacctggcctctagcagccagtgctcatattcatgaacaaagaaatgatgtaaaattggaacttacatttaaaagggaaacagagcagaagagttggaaaattttcagtctgaccatgtggtagaaaagaaaaacccatttataggggagtaattcaagcagactgcatgaatttgcataagtaaagaggagccaagtgctgatagccaagacaatgggaaaaagggctccaaggcatctcagcgacctttaaggcagctccttctatcataggcccagagacctaggagggaagaacagtttcctgggccagggccctgccagcctcaggacactgctgcctgcatcctagttactccagctccagccatggctgaaaggggcccagatatagctcaggccttcagacggtgccagcccaaacccttggaagattccacatgctgttaagcctgcaggtgctgaaagccaagaattgaggcttgggagcctcagcctagatttcagatatatggaaaagcctggatgttcaggcagaaggttgctgcaggggcagagccctcatggaaaaatctctactagggcagtgcagaggggaaatgtggggttggagcccccaacagagtccccactggggcactgcctagtggagctgtgagaaagaccaccatctttcagaccccagaatggtagatccgctgacagcttgcaccatgcacctggaaaagctgcagccactcattgccagcccttgacagcagccgcgtgggctgagccctgcaaagtcacaggagtggcactgcccaaggccttgggagctcaccccttgctgcaatatgccctggatgtgagacatggagtcaaaggagattattttggagctttaagatttaataactgccctgctgggttttagcacgtgcatggggcccgtagcctttttcttttggccggttttacccttttggaatgggactatttacccaatgcctataatcccattgtatcttggaagtaattaacttgtttttgattttataggcttataggtggaagggacttggcttgtcccagatgagactttggacttttgagttaatgctggaatgagttaagactttgggggctgttgagaagggatgattgtattttgtaatgtgagaacatgatattttggaggagctggggcggaatgatatggtttggatctgtgccccacccaaatcttatgttgaattgtaatccctaatgttggagttggggcttggtggtaggttttttgtttttttttagaaatctccatattgttttccatagtggttgaactaatttacattgctgccacccatatatgtgttacaatttcttcacctccatgctaacatctatttttttttaagctttttagtaatagccactcagacttgtgtaagatgattgatatttcattgtggttttaatttgcatttctctgatgattagtgatgaacattttttcatgtttgttggctgcttgtatgtcttcttttgagaaatgtctcttaatgtcctttgcccactttttttttttttgagacagagtcttgctctgtcgcccaggctggaatgcagtggcacgatcttggctcactgcaagctccgcctcccaggttcacgccattctcctgcctcagcctcctaagcagctgggactacaggtgcctgccaccatgcccggctaattttttgtatttttagtagagacagggtttcactgtgctagccagaatggtcttgatctcccgaccttgtgagccacccgccttggcctcccaaagtgctgggattacaggcgtgagccagtgcgcctggccctttgcccactttttaatggggttctttgttttcttcttgttgagttgtttgagtgtcttgtagattctggatattagtcctttgtcggaggcataatttgcaaatgttttctctcattctgtagtttgtctctttgccctgttgattatcttttgatgtgcagaagctttttagttaagtcccatttgtttatttttggttttgttgcatttgtgtttggggtcttcgtcataagttgtttgcctaggccaatgtccaaaatgtttaatctatcttgaggtagtttttgtatatgctgggagacagagatccagtttcttctgcatatggctagccaattttcccagcaccatttattgaattagggtgtcctttccctgttgtttatatttgtcagctttgtcaaagatcaatctgttggatgtaagtatgtggttttatttctggggttctctattgtagtccattgatctgtgtgcgtatttttgtaccagtaccatgccattttagttactatagccttgtagtataatttgaagtcaagtaatgtgatgcctctggatttgttctttttggttaggattactttggctattcatgcccttttttggtgctgtatggactttagaattgtttttcctagttctctgaaaaatgacattggtgatttgataggaattgtgttgaatctacagattactatgggcagtatggttattttaatgatagtctccaaatccatgagcctgggatgtttttgtgtttatttatgacatatatgatttgtttcataagtgttttgtagttctcatggagatctttcacctccttggtcagtgttttcctaggtattttatttttttgcatatggcttttgtaaatgggattgaattcttgatttggtttttggcttgaatattgttggtgtatagaaatgctacagatttttataccatggttttgtatactgagactttactcaagttgtttatcggtcttggagtcctttagtagaatctttagggttttctaggtaaaaaaatcatatttgtgaagagacataatttgacctcctcttgtcccttttggatatcttttatttctttttcttgcctgataactttagccaggacttccagtactatgttgaattggaatagtaagagtgaacatcattgtcctgttccaattcttagggtgaatgctttcagcttttccccattcagtatattggctgtgggtttgtcatatgtggcctttattatgttgaggtatgtttcctgtatgcctagttaatctagctagcagtttatcaattttgctcatggatttggagaatataatatcgttaaaaagacaacactacctaaagcaatccacataccacccaaagcatactgtcttggttactgtagccttatagtatagtgtgaagttgggtaatgtgatacctccagcttagttctttttgctaaggattgctttggctattcaggttcttttttggttttatatgaattttagaatatatatatttttaattctgtgaaaaatgacattggtaatttggtaggaatagtgttgaatctgtagattgctttgggcagtatggccattttaatgatattgattcttccaacctgtgagcatggaatgtttttccatttgcttgtgtcatgtatgactactttgagcagtgtttaatagttctccctttagcaatgtttcacctccttggttagctgtattcctaggtattttactttttgtgtgtggctattaaaaatgggattttgttattgatttggctctcagcttgaatgttgtcagtgtatataaatgttactgctgcttgtacattaattttatatcctgaaactttactgaagttgcttatcagttccaggagccttttggtggagtccttagggttttttaggtatagaatcatataatcactgaagagaggtatttgacttcttttcctatttggatgccttttatttctttctcttgcctgattgctctggttaagacttccagtactgtggcaaataggagtggtgagaatgggcatccttgtcttttctagttttcaagggaaatgctttcagctgctgcctgtttagtatggtgttggctgtgggtttgttatagatggcttttattgttttcaggtatgcttcttcgatgtctagtttcttgagggatttttatcatacaggggtgttggatttcatagactgctttttctacagttttttttttttttgagacagagtgttacattgtcccccaggctggagtgcagtggctctatctcggctcactgcaacctacgcctcccacttcaagtgattcttgtgcctcagcctcctggggctggggttacaggcatgcatcaccatgcctggctacttttttgcagagatggggttttgccatgttggccgggctggtcttgaactggcttcaagtgatcctcccacctcagcctcccaaggtgctgggattacaggtgtgagccactgtgctcagcctttctgtatctattaagatgatcatacgggttttgtttttaattctgtttatgtggtggaccacatatgtttgcatatgttgaaccatccttgcatcccagagacaaagcccatttgattgtgtgggtgtgtgtgtgtgtgtgtgtgtgtgtgtgtgtgtgtgtgcgcgctgttggatttagtttgctagtattttgttgcatatgtttacatctattttcatcagggatattggcctgtggtttcctttttttggttgtcttgcctcattttggtatcaggttgatactggtttcatagaatgagttagggaggaatccttcctctttgatttttttttttttcgggggggaatactttcagtaagattggtaaccagctctttgtatgtctggtaaaaattggctgtaaaaaatctgtcctgggcttttttttttttcctggaagattttgtcaggactaatttgattttattgctcattattggtctattcaggatttctgtttcttcttggttaaatcttgggaggttgtatgtttctgggaatttatccatttcctctaagttttctatctagtttgcataaagatgttcatagtagtctctgatgatgttttgtattttctgtggtatgagttgtcacctttctcatttctggttgtgcttatttgaatcttctctctttttttcttggttagtctagctagtggtctgtcaattttgtttatcctttcaaagaagtttttgttttgtagatcctttttctttttttttctttttggtcacaatctcatttagttcattctgatctttttatttcttttctcccagctagttttgggtttgttttattcttatttttctagttccttgaggtgtggtgtgtggttgttcatttgcgatctttctatctttttgatgtaggcatttaatgctgtaaacatgcttcatagcacagcttttgtggtatcccagaggttttggtatgctatgtttctgttttcatttgtatcagaaattattttgatttctgctttaatttcattgctcgcccaaaagtaattccggttgtttacttttcatgtacttgtgttgttttcagagttccttttggtattgacttctaattttattccattgtggttcaagaaatacttgatatgatttggacttttttttttctttttctttttcttttttttattgatcattcttgggtgtttctcgcagagggggatttggcagggtcacaggacaatagtggagggaaggtcagcagataaacaagtgaacaaaggtctctggttttcctaggcagaggaccctgcggccttccacagtgtttgtgtccctgggtacttgagattagggagtggtgatgactcttaaggagcatgctgccttcaagcatctgtttaacaaagcacatcttgcaccgcccctaatccattcaaccctgagtggatacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcgactggccaggcggggggctgacccccccacctccctcccggacggggcggctggccgggcggggggctgacccccccacctccctcccggacggggcggctggctgggcagagaggctcctcacttcccagtaggggcggccgggcagaggcgcccctcactttccggatggggtggctggccgggcgggggggctgacccccccacctccctcccggacggggcagctggccgggcagaggggctcctcacttcccagtaggggcggccgggcagaggcgcccctcacttcccagacggggcggctggccgggcggggggctgaccccccccacctccctcccggacggggcggctggccgggcggggggctgacacccccacctccctcccggatggggtggctggccgggcggggggctgacccccccacctccctcctggatggagcggctggccgggcagaggggctcctcacttcccagtaggggcggccgggcagaggcgcccctcacttcccagacggagcggctggccgggcagggggctgacccccccacctccctcccggacggggctgctggccaggcaggcggctgacccccccacctccctcccggacgaggtggctgccgggcggagacgctcctcacttcccagacggggtggctgctgggcggaggggctcctcacttctcagacggggcacttgccgggcggagggactcctcacttctcagacggggcggttgccaggcagagggtctcctcacttctcagacggggcggccgggcagagacgctcctcacatcccggacggggcggcagggcagaggtgctcctcacatctcagacgatgggcggccgggcagagatgctcctcacttcccagatgtgatggcggccgggaagaggcactcctcacttcctagatgggatggcggccgggcagagacgctcctcactttccagactaggcagccaggcagaggggctcctcacatcccagacgatgggcggccaggcggagacgctcctcacttcccagacggggtggtggccgggcagaggctgcaatctcggcactttgggaggccaaggcaggctgctgggaggtggaggttgtagcgagccgagatcacgccactgcactccagcctgggcaccattgagcactgagtgaacgagactccctctgcaatcccggcaccttgggaggcggaggctggcggatcactcgcggttaggagctggagaccagcccggccaacacagtgaaacgccgtctccaccaaaaaaatacgaaaaccagtcaggcgtggcggcgcgcgcctgcaatcgcaggcactgggcaggttgaggcaggagaatcaggcagggaggttgcagtgagctgagatggcagcagcaccatccagcttcagctcggcatcagagggagaccatggaaagagagggagagggagaccgtggaaagagagggagagggagaccgtggaaagagagggagagggagactgtggggagagggagagggagagggagagggacaatttggactttttttgagtttattgaaactttccatggccaagcatatggttgattttaagaatgttccacacacagatgagaaaaatgtatattttgtggttgttggatagaatgttctgtaaatgtctactaggtccatttggtttagagtttagtctaagtctggagtttcattgttcactttctgccttgatgatctgtcttgtgttgtcagtgggggggttggcgtcccttcattattgtgtggctattgatctgttttcttaggtctagtagtaggagttttatgaatcttggtgctccagtgttgagtgtgtatatgtttagcatagttaaatattcttgttgtattgaatcttttattattttataaataataataaccccagggcccaaccccaatctcagccctactccactctagcgctatagttgtagcaggagtttttctgctcatctgcttctatcccctaatagaaaatagtgtattaatccaaacctttacactgtttaggtgctattaccaccatatttagagcaatctgtgctctaacacaaaatgatatcaaaacaatggtagcactctccacttcaagtcaactagaccttacaatactcacaattgacattaatcaaccacacctagcacttctacacatctgcacccatgcctttttttttttttttgagacggagtcttgatcttctgcccaggccggactgcagtggcactatctcggctcactgcaagctccgcctcccggatacatgccattctcctgcctcagcctcccaagtagctgggactacaggcgcccgccactgggcccagctaattttttgtatttttagtagagatggggtttcaccatgttagccaggatggtctcgatctcctgacctcgtgatctgcctgcctcggcctcccaaagtgttaggattacaggcgtgagccactgcgccccaccgcacccatgccttttttaaagctatattatttatgtgttcgggatccatcatccacaacctcaacgatgaacaagatattctaaaaataggaggactatttaagactttaccccttacttcttcctcccttattattggcagcttagcacttacaggtatgcctttcctaataggcttttactctaaataccttattattgaaaccacaaacgtgatataccaatacctgagccctttctagtactcttattgccacctccttaacagctgtttgtagtatcagaattattgtctttgttctaataggacaaccccacttcacaactctaattattaatgaaaataaacccttcctaattcaattaaacacctaataataggcagtatcttcactggatttcttatcagcaatagtattatccccacctcttccccccagacaacagtaccacctcatctaaaacttacagcccttagtgtaacctagggattttgctagcaatggagctcagtcttctaactaataatcttaagactattagtcttctaactaataatcttaagactattagtcttctaactaataatcttaagctaaaatatccattacagacattcaacttctccaatatactggaattttactcaaccacaatccattgtacaaccccttgctcaagccaaaatctggcttcacttctactatacctagtttgattagaaaagtccataccaaagacaatttcacagacccacgttacagcctccattaccatatccactcaaaaaggcctaattaaattttatttccattccttttttatcccctcctttctaactctactcttaattatctactctattaccccaagtaatttcaattacaacataatcagcaacaatgttcaaccagcagccaccaccaatcaacacccataattatataaagcacctgcacccacagaatcctcatgaatcaaccccggaccctcaccctaaaaaattattcaacttcctacactactaaaattaattgtaatcaccaccccatcatattcaaccattcatcaaatcaacaccaattctattaataaccctaatgataaagttcctcaaatatcatatttgatccttaatgtctcagggtattcctcaatagctattgccacagtataaccaaaaacaaccatcataccacccaaataaatctaaaagactattaaccctgtaaaagccccaccataattcaacacaataccacaacccacagcaccactaataaccctaaacctccataaataggagaaagttttgaagacaaacctacaaatcctataaccaaaataatacttaataagaataaagcatatgtcattattcccacatggcttgtaaccatgactaatgataggaaaaataatcattgtacttcaactataagaacactaatgattaatatacataaaatacacccactaattaaaattataaattattcatttattgatctccccacaccatccaacatctctacatgatgaaattttggctcacttcttggtgcctgcttaattctccagaccatcacaggattatttctggccatacactacacaccggacaccttaactgctttctcttcagttgcccatatcaaccgagttgtaaactacggcagaatagtccactattttcacgctaacggtgcttcaatattcttcatctgcctcttcctgcacgttggccaaggtttatattatgggtcacttatgtccctagaaacctgaaatactggtattatcctcctactcaacaactatagcaacagcgtttataggctacatactcccatgaggccaaatatcattctgaggcgctacagtaattacaaatctattatcagccattccatatattggaacggatcttgttcaatgaatctgaggtgggttctcagttgataaagccactattgcatgacttttcaccttccattttatcctacccttcatcattatagccgtagcaattctccaccttttattcttgcatgaaacaggatccagtaacccttcaggaatttcatcagattccaacaaaatcaccttccacccttactatacaaccaaagatatcctaggtctaatatttctcctcctccttctaataactctagtattattttgacctgacttcccgagcaatccagacaattacactttagccaaccccctcagtatcctaccccacattaagccagaatgatattttttgtttgcatacacaatcttacgatccatccctaataaactagaaggtgtactggcccttctattctctattctattctagcagttattcttgtactacatacgttcaaacaacaaagcataatattctgcccattaagtcaatgcctgttctgaattttagtggcggacttgcttacagtcacatgaatcagatgatagccagttgaacatccttttgttaccatcggacagccagcatctattatgtaattctccattttccttgcccttataccactcactgccctaattgaaaataagctacttaaatgaaactgcccttgtagtacaactcaatactctggtcttctaaaccagaaatggagagtctctccccaggacaactcggagaaaaagcattcccgcttcaccgtcaacactgcttcaccatcaataccgcttcaccatcaacacccaaagctgaagttgtaattaaactattctctgtattctttttggcacatattttaactaatatgtcagtattgactgccaacactaatatattagtactcctatgtactttgtgcattactgttaatccccatgaatgatatatgtgctataaatgcttgattgtacatagtacatacacacataaccttacactaaagagccattccacatgcatataagcatgtactaacaatcccttaatcaactatcactcattcagacattacactcacatgacgaaactcgatccacatgaatatcgaccagtactggaaacccttgatattacatagtgcatacgttcattcactgacgtagtgtatttcagtcaagattaacctcgccaacatggatatcccctaccaagctttggtctgttaatctaccaacctccaagaaatcatcatccctctcgggcgtgttactctcctcgctctgggcccataacacttgggagtgactatactgaaactgtacctggcatctggttcttacctcagggccatgaaactaagattgaaactaagattgcccacacatttcacttaaataagacgtcttgatggactagtgactaccaccctattaaccagttacgggagcactgtcatgcatttggtatttttaacttttggggatgctgtcactcaccattgtggaaggccttctttgccttttttaaaaaaaaattttaaattgttgttggtttaaagtctgttttatctgatataagaatgtttactccagcttgctttttttcccagttgcatgatacatcttttgttacccctttactttgagtctataggtgtctttagccattaggtgaggctcttgtaggctgcagatggttgtgtcttgtgttttttttttttgagacggagtctcgctctgtcgcccagactggagtgcagtggcgtgatctcggctcactgcaagctctgcctcctgggttcatgccattttcccgcctcagcctcctgagtagctgggactacaggcgcccaccaccgcgcctggctaattttttgaatttttagtagagatggggtttcaccgagttagccagtgtcttgtttttttatccagtttgccgttgtatctgttaggtggagcatttaggccatttaccttcaaggttaatattgatatgtgaaagtttgttcctgttatagtgttgttagctagttgccttggagtcacaattgagtaatagctttataggatctgtgagctttgtatttacatgtgcatttatcatggcaaacatcatccttttgtttccacatttagaactcttttgcgcttttcttataggtctagtctagtggtgatgaattcctttagtgtttgcttgtctgtaaaagacttcgtttctctttcgtttatgaagcttagtttggtaggatataaaattcttggttatagtttttttgttcgtttgtttttggagtctaaaaagaggccccaaactcttttggcatgtaaggtttctgctgagaatttcactcttaatctgatgggattccctttgtcaatgatttgacacttctgtctaactgcttttaagattcgctgatagtctgatgactacattccttggttatgttcgtcttgtatagtatcttccaggtgccctgtgaatttctaatatctggatgtctgcatatctagcaagatcaggggatttttcctgttttatttcctcaaatatgtttttttaaaatttcttactttttcttttccttcacaatgcctgtaagttgtaggtttggttgttttacataatcccatatttttcaaaggctttgtttgattttaaaaattcttttaagattttaaaacaaattctttttttttgtctgactgggtaatttaaaagaccagccttcaagaagtttttttttttttttttttttaaagacatctgtctcttccttcatttcctagattgcttttctggttatttttgtgttggttttcaaccttctcttggttctcattgagcttctttacaattcccactttgaattctttctctcatttctgaattttcattttggttgtagtccattgccagaaagccagtgcagtctttttggtggtgtcacaacattcagatttttcatggtacctgaattcttaatgctggttttttctcatctagagaaactgacacttgttgttgtttgaatttacttcatttaaatggcttttttttttctctcccccaacctgccttgtgcctatagagtatgctctagggtagagtcttttgctttgcttttatagccttgtgtacttttgttggcaggttttatatttgttgtgcaattcaacctacaggcctgtaggtggtacttactggtatgagccagcagcagcaaaagcagacagatgtgtacctgatctttgtttattgtgagattcactgtgttgtttcaggtgatgggctagacagtggaaattcccccatcccctgagcttctgtttagcagtgggtcagggcgagatagctggatagagctggatcgtctagcttgcccacgaatactccaatgataagcataggcactagtcctgataggggtggttgaggtctctgctgcatgttagggagctgcactggcttcatgtcctggacagggaggaatgtgatgtgttccctgtcacacccttgttctggggctcgtgactctcagtgcagatgcacagtgttgtctgtctccaggccacagtgtagccgagagtcacagtaaatgcctgtcatgcagttctcctgggattggtttaaggacatgagggcagagtcttgatggatgagtaggaatttctctggtgggcaagtgtgggagaccattttatgtaatagcaaatgcaaagggatgaagcatgagaacacggtctattcagagaagtatagcaagtttagttttttataggagtataaagtaagaggtagaggaatgatggatgataaggctggacccacggcatgaaacctgaccctgaaaggtgttgtttgcttttatatctgaagggatttagttttaatctagccaatgatgtgaaaactctgcagaatttttagtataagtgcattttgaaggattgccctggcagcagcataggggctggatttgaaggaaggtaagatgagagctgggaacatctcagtgaggaggcacaatgcctcttatggggaaagaagggtctgcaccaccagctcttagactgtggcaagttctgttatggaaatgtgaccaaagcacaccaaaagaataataattaattctctctggatgattagagtgtaccatggaaattttgtagaggaagtgatattatcatataattaaatggaaattatgttgggtaaaattgtaatgtaataaagatctcagttttattctggaaagaagaaatgctggatactcattttatcctagaaggcaagagaaatttagtttgaagagtaactcaccctctggggtaagagtatgacatggcttgacatagcagttcaaataattttgcacatgtgttcttggcttccctttagatttcaggttcatcctgtgaggttgaaaatgattgtagctaaaatgttatgttaaatgataggttgagtgagtcaagcatgaaaagcctaataactgtggaaagcttaccctggtttacatggggaaaaggattgttcactgtgctgaaaagaaaactggtctttggaaatggatcttgtttcggtagttgttgtgagtccttgggcagaatggttaactaccttgagcctcagttataaaactatgaaagacgtttacttcctggggttgttttgatgatttagtgaaataaagatacagaaatttccagcacatagtagattgttaagtctgtttgtattacatttctcctcataaagtttcttttttcttttctttttcttttttaaacatttttgtttgagacaggatcatgctctgttgcccagactggagtgcagtggcatgattgtagcacctggcctcaagtgattctcctgcttcagcctcctgagtagttgggactacaggtgtgtgtcaccacaccaggctcatttttaaaattttttgtagagatggtgtttttcttgtccagactggtcttgaactcctggcctgaagtgatcttcctgtgttggcctcccaaagtgctgggataatagatgtgagccattgcaactggcctacttttattgtttatataagatatggggtctcactgtattgtccaggccagtctcgaactcctgggctcaagcaatcctcccacttcagcaacctgaatagctgggattacaggtctgcatcactgagctcacctaccaggcacctttacttatgaaaattttctttatatataaattattttcataaaagaggttttcagaactgtttttaatgtctgtagtttctcgaactaaccagcttcaagtaatatgccaaaaaatatgttttgggatggcatattctggtctcctgcagtcattttttgggagggtatgttctgagccccaaaatctctcttcctttctttccattccttataccaagaggtccaacaggcaaccaaggtattcagttacttttgtgccaacctaataagacactatggagaaactacagagtagctgagaaagctactgtgtttagaaggagaaagagcaaggtaaagtgaattccaatcagctttttgctgtattagatgaaataaggagttcagtgcttttggtgactaaaatggcaggtagttgctcagtaagttgctttgggtatcctggactcctgctttttctgtacttgacctccatatctagcctgttgatataagtcatgtgtgtcttttttctctcttattttttctgtgttcactgctgctactccatggtcatgtcatcatcatgttgcctggattatcatgtagatactgaattggtttccttcttcctctctggatgtttattagagtcacctagcacttaaagtgttccgctccagaataattatgtcatgatggcaaggagagctagctgaaatactagacattttttttaaagcctcattaatcatgtgacatctaggcatttaaatgtcatgtcctttgtttttggatggtcagtttccctattccagccttttcgacaaaggtagcatccttcctacttttccttcaggtttcaggtgagccttcaggggaatcccccgagggctgtccagtggaactttccgcgatgatgggagatatttggtatcatttgcattgtcccatgcagtggtgttggagcttaggtcacgctaccccaaaatatgacttcaggagcccacaatatgctactgcaaaatatgtctctttgtcatattggttatttagagttggttattttgagaaactgtagacacaagaatagctctgaaaagttgcccttttgtcagagaaatttacatctatgagggaaatctttttccctgctctgcagtaggaggagaggggccgctaaatggaaaaggcattgacttaaaaactgcacaacaaatcttactcttgttttcagttttttcctggccatccccctgtaacagatttccccatcaccctccacttcctttattttagcaaatgatggtattccgctgaagtttaaactctcattgaaatctactctggagatttactcggttctcttgaattttctcgcatgtatgtttgaggtatacatatgaaacaactcttgttaatctgtcttttgttacagggagtcccagtttatgaagataaaaaattattttttctctcctataccagccactagttattgagcacttaaactgttactagtgtgactgtgaaacaagtttaaattttatttaattttaactgtgttaggtgctttaacttgtgccctcacagtaccctgtgtacattcccccattataacactatagtgtatgtattcccaacattttattattaaacatatcgcaaagttgaaagaattttacagtgttcatccctatacccatcatctagattctaccactaatattttaatacatttgttttaacacatatgcatctggacatttctgtatccaaccattaatcctttaaaaaaatacatttcaagataacaccagtatacatggccctaaatactttaacaggcatataaccaacttttgtttgcatgtaaaattaatgtataatgaaacgtccatattttaagtgtgtatttgctgagttttgataatcacatataactgtgtaacccacacctctaagcatgatgagaacattaccagcagttccctcctgcctcttcccagtctgtcttttctcttaccctcccaagcaaccattattttgattttcttctgtaatgtccttcagcaccccaaagagcttagcatcatgctcaccataaaggagaaatgcgttggctacttagtttccgtacgtgcctttgtgcacatatttgaataccagtacaacaaagcaactttatttttgctatggtctgaatatttgtgttcccctcatgcccccaattcatatgttgaaacctaatctgatgtgacagtattaagaggcagggccttaaggagaaggtgattagatgatgccctcatgactgggattagtggccatatgaaagaggcctgaaggagcttgttttcccctttcaccacatagggactcaacaagaaagtgcagtctattaggccctcatcagacactgaatctgctgacaccttgatcttggacttgctagcctctagaactatgagaaataaatgttgtttataagccatccagtttatggtatttttgttatagcagcctgaatagaagaactgagacaattttctaagaagatacagctatccttgcagggaagaaattcttacccataccctaatggagaagactcctggttccatcagtcacgtatccatcactggctacataaattactactcttactccatcaccatcccactcaatattcagttatataaagactaaattgtaaagttaacttcagtaatttgtgtataaaataaaattgggaattagggagaaaaatatggttagtacagtcaattcttgttattcatggtggttatgttctgtaaagtcatcgtgaacactgcattagcaaatattgaaccatttctcttaggggaaatacagggttaagtttctgcaagcctcaaatcacaacttatgtcaacagatcaagacataaccttgttttctgtgtgtttctgtttaaagacaccttactatgtatggttgatctattaacattgaacttacagctaatggcagtgtctttcatatttgaagaaagcttaactaaaacacgattttttcagtaaggtacagcccagctttcatgagcataggaacacctgacagtacttcagtactatgcttgggagtcactcaaagtggtgaaatcagtgacaggaagcatacacaaaaaagtggcaccaaatgcacagtggaaaggacaattgtttatactatgaaagctgacacaggaagatggagtgttaccttgttcagcctcagctggaacatatgcttggagtgatttcagtattttgctaccctgaacatgcatgtgttcttgaatgactgaaaatgctgtgaatatgagtttggggattacgaatgaattttagtgcataggcaaattcacaaatacagaatctaaattatgaagattgactgtatatacaaataaacatgtatataatcaaagagaaaatatgcaaagctactgcatagcttgtgtctgtaactggtctgaggtggtagctgaaatatgtggcttccttcatctactccctgttctatagctctcttgccttctgccagaatttcagttactctggctttttttttttttaacctgattgagtgactcataaactttccttcttgaagggactgtgtcttatttgctctgttttttggttgctgtaacgtttcattaaccttgtattgagcatggaagtagtatgacatgccctaggcaatcttctgggttccacttaccctactttgcctccattgcaaaatagcacacttgtttgcccttggtaattcggattcatttttccaactagtagattaaccaatgtttttggcttgttggtttcagtgacataagaagtacaaaatggccatatgggagtctcatcttccaattaatcggaaacattgttgtgtcccctttggaagcatttctcctttaaggactaagatctccaaaccatcagagctcaaagttgccaggactagaaacagaaattttgcaagtggcttatgtgggtataataatgagaggagccatgcctgcttctactttttgattcctggactgacatattctggctgtgggcaagatagcatcatataatggtctgtgattgaaataataaactgcagcttgtaaaacagagccccatcctttcaggtttttgtctcctaactagtgctgctgctgaagtcttcagtaagccattctatgtgatggagtaatggtaaaaccagttaatcttagtgtcatgagcacattgtccacctcttttgctatgaagtgaattccttaaggagatacagtgctgtatagaatgctgtaatgataggtaatacattctgtgagtctatgaatggtggagttggcagaagcattgcaggcaaattcatatctggaatatgagaaacggatccattatggaagagaaccaaataaaatcaatctgccactaggtggccagctgtctctttcccacccatggtgccatactgggaattcagtgttggtctccagcattggcagatcagatgctctgcagtagctttagccagatcagttttttcagttttagaaaggactaatctgtgtgtgtgtgttttttttttttttttttgagacagagtctcgcagtgtcgcccaggctggagtgcagtggcatgatctcagctcaccgcaacctccacctcgtgggttcaagtgattctcatgcctcagcctccccagtagctgggattacaggcatgcaccaccacatccagctaatctctgtatttttagtagagatggggttttgccacgttggccaggctagtcttgaattcctgacctcaggtgatctgtccgcctaggcctcccaaagtgctgggattacaggcatgagccaccgcacctggcctaatctgtgtttttgaacccattcataatctccatccctgccaccatggccactttgttcatgggtccattgcacaagcttagatatgatggagaaggaggttgagtgccacccatagagtatgtcattttatctacctgattattaagagcctctgcattgatgtgcccacctagtctctcatggttcagtgctgctgcttaagtttctgtgcaactctaaaatcccatcatccgcactgaattcaacttatctcaatattgacttcctcctgtagtcatacctgtcctacaaaggggagtgacaagaattttgaaaaccttgttaggtggtccctcactaatacatttctccctctctctctctctcttttttttttttttaattttgtttcagagacaaggtttgctctgtctcctagactggagtatagtggcacgatcatagctcactgcagacttgaactcctgggctcaaaggatccttcctcctgcctcagccccccaagtattaaatagctgggattccaggtgtgtgccaccatgcctggctaattattttatattttttagagatgaggtctcattatgttgcccgggctgctcttgaactcctggcctcaagcagttctcctgccttggcctcacaaagtgttgggattacagacttgagctactgtgcctggccactaataggtttctaaatgtcttagtaaaaggagtgttttctaggccctctcatggacataagtggcaatttggtgtgtaggtaacacatgataaatccagtccaaccttcctatctctctaaacctttggatccctctctcttattatgctagggaaactttggaacctcagccttattaaatgttaaattaatataattaatgcttaattaaattaaacttcaagtttcagtcagccaatcaagtaagctgttaaagccacttccagttttgtgagttaacacattaaatgtgggatctctagtacagaagtagtcaaaccttttctgtaaagggtcagatagtaaatattttaggttttagaggccatatgggttttgtcacaacaactctgttctgctgctatagtgtgaaagcagccatagacaatatggcccatccattaatgggcatggccccattctagtaaaactttagttacaaaaaacggtttgttgacctctgctttataagtatatacatataaatgaattagagccaatgtagtgttatatttcaccctcctggtctagcacctttagaatccattgccatacatgttctgtgggattgtgctagtttatcagcagatcttttagtgtgttcagctacttcctttgggtcatagtatatacctgttcttctggagcctgtcaaaatttgacatgggttagtgacaatggcagtggttagggtgtgtcttgaggaggactgaacatcctcttttaaggcatccaccatgggtaaagctgtcctcaggtttttaagcagtggaagagtcatctcctcagacaaggggggaaaactacttctggtaagggagactcagacggacttgggggttcaagttggtcagtttcatttgggtccaaataaatattcccattccaaatttaaggattccattctttactaatctgtcccctttcacaggagaaacttggtgagaccatgaattcagctattgttttaattcagcaaccctcataattaaattaaattttatatttgattttcagctaaatcagctctaagaccatgacttgatctgaaagttggatctgagctggttattttctccctgtaggtgccccagtgcagcagtccccaacctttttggcaccagggattggttttgtggaagacagtttttccatggactgggttgggtagggggaggatagtttcgggatgaatctgttccacttcagatcatcaggctttagttagattctcataaggaatgcacaacctagaccccttgcatgcgcaattgatgatagggtttgtgctcctgtgagaatctaatgcctccactgatctgacaggaagcagagctcaggtggtaatgctctctggcttgccgatcacttcctgctgtgtggcccagttcctaacaggccatggactggtactggtccgtggctgggggcttggggaccctgctctagtgctctcaaaagaacccaccccacatcaaagtccttattttcataatttctgccattatggtcagttgcagcagccacttgggcttctaagacatgtccctcagtacttcattacagtcaaccaaagtgatagcttagttaattgtgactccaatacctactgtggattactagcatttcatctcccattggcgaggaacttagcactgcactgaagcccaaggccatgaccaaaccagtcctcgaattgcatctctgtgggcctgtctcctaggactgctcccaataccaattgtgtgtcactcatggtccgttgaggagagaccgaaatcatgtagttacttagaaaggggaagtttaatctaagaactgttaagttgtgataggagagtaactaaagatgtaaagagaactctaacggatattctaggactaagagcctcaaggaaggaccaacttgcaagaggggtcccctctaccaggctggggtttagagcttattggagaaggtatagctgtagcccaggtttgctggtggagaagattgctgtgtggctggtccatagtaattgggcaagcaggaaacaatcctttcatgtataggtgagcgaaggctggttagcctgtctacgaagggagtccaggtgcttctgtgggtgtgaaatctggagtgtgtgggctgaggttgccagatcactgaggaactggacccctgggcataagctgtggctaagtacccctggatgtcctcctcatccataccatgcagcaggaagtccaccccatgacagaccatgcagcaggagccagaagacagtaaaatgcaccaagcagaactaggaagtgtcctttctgcagtgttgcttcagtgccctgtactgacaaagcataacattgtactcactgtaaagaggaaatgcctgcaaactccaggcctttattgcagtgcaggtaccgaaggatgaattcagagcggagaggcaacatattgataattggcctagtccatcagatcatgttattgattccacagtagttccctgttttaagacaagtaaatattcaaagctgtagacaggtcctctacttctttgacctcatactactatcttcctcttggctctgctgcagccatccaggcctttctcctgtttctggaacatatctgcatgctcccgacttaggacccttgctggtccctcttcctggaagctattttcctagctgtctgcatggtgagttcctcatttttttcaagtcttgctcagatgtcagtttctcaagaaggcctgccctttacgcgcttatttgctactctaagtcccctgaactccttacctcttcacatggcttgactttttccacagtacttttcacccaacatactatataatttacttatttatcatgtctgtctcctcccacgataacatcaggcgccaggacggtatgaggggcaggagttttttaatgttgctcacttattgcagatacctaaaatagtgcctagtgcattataggtgcttaataaatacttaaatattgtaacagtctctatgatgttcattaaaggtgagattctaccttcaaacaattttcattttattattcaaaatatttttactacttctgcattacacaacttccctttattttctggactggttacattcttttgactgattaggtcaagatgggtacattttttgtcttgtgctccatataatgaaatagggtttgtattttatgttacgttctttacatcatttttcagcttctgtgacttttctcatctgagtagatgactgagacagataactatttttaatattatattttttagaattaaatcttagttcgtggaaagttaactgattgtttttaattttatttttaggtgctgaatgtggagtaaatgcagatgttgagaaacatcttgaattgggcaagaaattacttgcagctggacagctagctgatgctttatctcagtttcatgctgccgtaggtttgtatcatggaaccaaatcactcagtgtctgtcttagtgaattctagtaatagctctttttttaaaaataacatttaaaataaacattatttcatgtttaaataaaacatttaaatatatttgtgggattctgagcgaaatagatggataaaataaatatataacacttaaatgtatgtgcatctaacatgagagaagtttgaaggttagtgaggcctgctactaccaaggataactcaagatatttctgacaaacagcttttctcagtgtattatttggcttctgactttttttttttttttttttttttgagacggagtctcgctctgtcgctgtcgcccaggctggagtgcagtggcacgatcttggctcactgaaagctctgcctcccgggttcataccattctcctgcctcagcctcccgagtagctgggactacacgcgcccaccaccactcccggctaattttttgtatttttagtagagacggggtttcaccatattagccaggatggtctccatctcctgacctcgtgatccgcccgcctcggcctcccaaagtgctgggattacaggcgtgagccactgcgcccggccagcttctgactttttgaacagattttactgaatgcagtttaattttcttgatgacttgggttttcaatatgtttacttgatatccttgggagatgctgcagttcattgcctcttcagtattggtcagaccccagctgctcttcatttatactgttgcttcttatttcttactcatgtctgtctgtagaatcaactgtcgtgcagctgctcatctgttaggactgtaagaagtgagatgaccagaataaataggttcttagtgaaggcttaatggattttctctccttttcttttctttttttttttttttgcttttttgagacagagccttgctctgtcacccaggctggagtgcattggtgtgattatggtgattatggcttactgcagcctcagcctcctgaatagctgggattataggtgtgtgccactatatccaactactttttacaacttttattttttatatttttgtagagatggggtctcactatgttgtccaggctggtctgaaactcgtgggctcaagcagtcctcctgccttggcctcctagagtgttgagattgtatgcatgagccaccacatctggcatggatttccttatgagtcactgctaaacttttgtactgggactttttgaactttcctcagagttctttacttatatatttttaccttgatttgaatggttgagagtgtgtagttaacaaccgagggtggtgttttgttttgttttgttttgtttttgtttttgtttttgtttttgagacaggatcttgctctgtcatccaggctggagtgcagtcacgtgatcttggctcactgcaacctctgcctcctgggctcaggtgatcctcccacctcagcctcctgagtagctaggactacagctgcatgccatcatgcccagctaatttttgtatttttttttaatagaaactgggtttcaccattttgcccagcctgtctcaaactcttgttctcaagccatctgcctgcctcagcctcccaaagtgctgggattataggtgtgagctaccgtgcccagctggtgtgttttttaataagatacagctgtgctcccagaaaaactatcatcctattgttgtaatttactatataaactcaatgtagttaggttttggtttgtcatacttttctttatgctttttcttaaactcagatttttattattcagatttttattaaactcagatttttattagctctctgaactcataggaaacatatttttttgatgaaaaaactctattcaaggctgggcatggtggcccacgcctgtaatcccagaactttgagaggctgaggtggtggatcacttgaggtcaggagtttgggaccagcccggacaacatggtgaaacttgtctctactaaaaatataaaaattagccaagcgtggtggtggccacctataatcctagctacttgggaagccaagactggagaatcacttagacccaggggcccggaggttgcagtgagccaagatcgcaccattgcactctagcctgggtggcagagtgagactccatctcaaaattaaaaaaacagaaaacaaaaactctactcaagagacatggcataattataagaacatacaaaagttgaaaaatgaggggaaaagtggaaaaaaagatacctttgtgagtagtagagaaagccattccacgcaaataaaggattcactctaccagaaaaaatatcaattttaaatgggtataagcctaataacatagcctctaaatacataaaacaaaaattgacagaactaaaaggagaaataacaaatttataattacagtggaaggctttagcgtctttcaataatatataggaaaacagacaaaaataacagtaaagatgttaacgacccaattgaaatacacataacacttggacacagctacagaatacacattcttccaagtgtaagaacattacaataaaaatattataggaaagtctcatgaacataactacaaaaattctgaaaaacataatagcaaatgaatctaaagtttaaagaagtccacatattatgtttgtacacacaaacacatacacacaccactggtttctattataaggatgtaaatttggtttggcattcaaaagtcagtattagtcatcacattaaaagactacaggagaaaaatattatttcaaaggtgcagaagaaatatttgataaatatttaacaccatttctgaaagaaaaagcaccttttaaacagtttgggaatctgtattggtgagtacaccaagaatcctatagctaccatcatactttatggtgaatattgatagctctccccacacctcaccaccactgagattgagaacgagacaaggatacccactattactacttgtaatcaacattctgctagaggtcctagccaatgcttttttctttttttttttttttttgaggcagagtctcgctgtgtcacccaggaagctggagtgtagtagtgcaatctcagcttactgcaacctccgtctcccaggtttaggcgattctcctgcctcagcctcccaagtagcgggggttacagtcatgcaccaccacgtccagctaatttttgtatttttagtagagatggggtttcaccatgtttgccaggctggtcttgaacttcctgacctcaagtcatccacccgcctcccaaagagctgggattacagacatgagccaccgtgcctggcctagccagtgcaatttgtataccaattttctgtcttgcaaccttgctgaacgtgttcattagctctaataatttttgtgttggtgttgattctttaggattttccatatacaagattatgttattgggaaattacagttttgcttattttgtcatggaaaggacccagtgggaagtaatttaatcacgggggaaaatacagttttacttatttttgtcatgggagggacccagtgggagttaatttaatcatgggggtggttacccccatgctgttctcatgaaagtgaatgagttctcataagatctgatggttttataagggacttttcccccttttgctctgcacttccccttcctgccatcatgtgaagaggatgtgtctgctgccccttctgccatgattgtaaatttcctgagggaaatttactcatgccgaactgtgagtcaattaagcctctttcctttataaattacccagtctccggtatgtctttattagcagtgtgagaacgaactaatacaattgcccagcccctgtaatttggcaagaaatagggcataaagattgagaaaggaagaaataaaactgtcattcacagaggacttgatacacaaataatctgcagactatcataactgaaatgaatttagcaaggccactcactagataacaaattcaacatacttttgtagcaacagagtctctctatattagcaataaacaaatataaaaaacacctaagaagaaatctaatgaaagatgtgcaagaacactttgctgaaaaccacaaaaatagttataagaaacttaagaaagacttaaatgaagagatataccatgttcatgaataggaagattcaatattgtaaagttgtcaagtggcccccaaattggtctacagattcaatgaaatctaatcaaattctagcactttatttcattgaaattgactcgctgattctaaaatgtcttatggaaatgcaaaggacttcttcatgagttgccttgtggacgagatttaagacaacccaagccagctctctttggtctgtgagaagcatacatgtattctttgccttgaccatgtctgtagacagaggacagtccaaatagcaaccccttcttccttcttatgagagcagagagcctgctagtctcttgccatttagagttttcagggatgagtcagataccccagtcagtctactctgtcctgcaaagaggacacttacaaacttttccaagtggccctagaaatctcaccttggaatgtaggggtagctggtacctgttgggatgtcaggtgaaacataaatagttgcattgcagtagcctgctgtataaatatacggagaacttctatcgtatgtactctatgaaggtattagaaaaatatggctttgtggattaccttgaaaagggaaacattttaatcttggcgttgccactgggtaatcctgtgacattggtccagttatgtaagaaaatgcacactttaaaaagttacctgcaagttcccagcagtttttgctgtgtcacccatgggaatttttgtgaagatcagatggtaataatgaatataaatatttctttgaaaatagtatataatcactcaggaggctgaggcgggaggactgcttgagctcaggtgcagtgagctatgattgtgtcaccacactccagcctgggcaatggagtgagactctgtctgtctccttctctgtcttgctttttttcttaaaaaaaaaaaaaaaaaggtgcagtaggatatgtaaagaatgtagaaatataatttttgtgtctctgaaaattaaggcttttctaaaaacaggtttgctataataacaggggtttcttaactatgtgacatttctgttgggaagtttgcatttcgatgactaactcaccttaagaaatagtggttactttgcacaataatttgcacaagatttttcattaagggctgtttactgtgtgaccacatcgttactaagtccactatttttctggtgattcaaactgtcttcagtgcttcagcatggcaatttaaattcttttcagttactgtcttagaaaaagtgtgtcttaaagtatttattcttacctactaccattagaatgtttgcagaaatgtatataccttctacctattttatactttattgtttgttttcttagtctcacatttattagaaacatcaagggctatggcatataattaaagtcggtttaaatgactgctccttttttttttagctttatcactgcaatacaagactttttgagacagctctttcccaaaattcccagtaaaatgttactgtgttcaccaagaggtgtaaatcagtgatgctgaaacatggcaatttattggtgtgatttagtaaagggagaatgtaaataattgctagtgcattctgaatctgaataacaggcagtgtggtggcttacaactgtaattctagcactttgagcactttcgaaggctgaggcaggaggattgtttgaggccaggagtttgagaccaacctgggcaacatagcaagagctcgtctctacaaaagtaaaataaaaacaaaattagccaggcatggcagtgcccacctgtagtcctagctacttgggaggctgaggtggaaggattgcctgagcccaggagtttgaggaggcagtgagctgatggtgccagtgtgctctggcctggacaacagagtgaaaccctgtctccaaaataaagtgtcattttgttcaatgtgatctggcaagtagcagtgactctcaaatgggatacacatcatagtttctttttctttttttttttttttttgagacggagtctcgctctgtcaccaggctggagtgtggtggcgtgatctcggctcactgcaacctctgcctcctgggttcaagcgattctgccttggcctcctgagcagcccgagcagctaggagtataggcatgcgccaccatgcccagctaatttttgtatttttagtagagacggggtttcaccatgttggcgaggatggtctcgatctcttgacctgatgatccacccccccttggcctccaaaaatgttgggattacaggcatgagccactgcgcccagccacacatcatgatttctaggaagaccatttatcattttagttcatgtagaacacattgttcataacaaactatagaaaataaagtttaaggctgggcgtggtggctcatgcctgtaatcccagcactttgggaggctaaggtgggcggatcacctgaggtcaggagttcgagaccagcctggccaacatggtgaaacctcctctctactaaaaatacaaaaagttaaccgggcgtggtggcaggtgcctgtaatcccagctacttgggaagctgaggcacgagaattgcttgaacctgggaggtggaggttgcagtgagttgagatcatgccattgtactccagcctgggcgagagtgagactctgcctcaaaaaaacaaaaacaaaaaatccccagaaaataaagtttaaattttctatcatagtgaaatgggagggttttcatatctcccttgcagggcgtgcaacagggttgtggcttctgtcttcggggccccactgctcagacccttactgggagcatgcagatgggcaggtgcagaggccgtggggagtgcttttgggctccggccccacggcaatgtctaggactcctgaagcccaagtgggtgtgtgttacagtgtgctgcttcagctacgccatctgcagacggcttgtgttagtcagctcagtagaccctctcccttattgcaaggacggggccagtgtgacagcctgagttcttgctcggttgtactggaagaatcagatcatatacatgggctggaaggttgagtgcaaggtttattgagtggtggaggtggctctcagcgagatggatagggagccggaagtgggggatggagtggtaaggtggtcttcctctggagtcgggctgcccagcggccagactcttctatggccactcctggctgaactcccctcagcatccacgtcgttctgccatcgctgctctgccagtgtctgctggtatgctcttcttctcctctagacatccagccatttgtatctgtgtctgcttaaggtctctgatttatatgggcacagtatggggtgcgtggctggccagagtgatctcggaaaatgcaacatttgggcatgaaaacaggagtgcctgttctcacttaggtccgtgggcacaggcccaagggtgcagccctacctgggaccccacccctctctacccagcacttccctgcccccctcccatatcaataggattatgcagtaggtggtgatggggtgttgtgaccttttgaaactcttaagagatgtgcgtttatcagaagagaactatggggataatgaatcctgggatctgaaaccctaaatttaatagactttacagagggtcttaggtatatctggcacgaacaaatgtcttaagtggtagattaaatggtgggcagtgtgaaatgatcgatttcttcatttgcttggtaagaaaactagcacaacccttacatagttttgctgaatccaaaaacaaaatccatttctagatttttatatcacttaaacttgttatggtgctttctcatcacatttcaacctcacttctgaaatgaggacaaacattactgtttacatttagacaaaaggaaacaaaaagtgctctagcaactttctgaaggtgatattccagttcaaaagattctgagctatgctactattttaatgtctggtcagttcagtaaattgttgaatgaaggagttcagttgggtgagctgagagaatgagtaaaacattttccgtatctagatgatatggtttggctgtgtccccacccaaatctcgaattgtagctcccataattcccacatgttgttggagggaactggtgggagataattgaatcatggggatggttccccccatactgttctcacagtagtgaataagtctcacgagatctgaagattttataaattcgcttggctctcattctctcttgtctgctgccatgtaagatgtgcctttcgccttcggccatgattgtgaggcctccccagccatgtggaactgtcagtccattaaacctctttttttaaaaaaatacccagtcttgggtatgtcttcatcagcagcatgaaaacggactaacgcaccagtccagtgtgtttttcctatgcctctcactaccaccatttacaacatcatttgtaattggctttctgatgtgttttctccagatagtagttgtattgttttattctggctaattttctcatatttgaattgtttgatagttctaggattctgggtagaggttaaatccatctcccatgttcaagtttctaataagctagtataaggatttgaattatgtggtttaaaatgaaatatagtatttccatatttccacatgtagacttgcaaataatttacataatgaacaatattatatattggatggataataggaaaaatacttattttcaaggttatccagtcttgtattggtaaaaactaagcatgcatttctaaaccaattcttgtttcacttgctacttcatgcacagtgatgtaggaatggactctagttccattaactgttggtattttaagatgaagaaccagggaaggctattttgatttactgtgcaggtgaccccatgcctctaagaaaattgagacggagtctcgcagtgtcacccatgctggagtgcagtggtatgatctcagctcgctgcaacctccacttttcgggttcaagtgattctcctcttcagcctctggagtagctgggattataggtgtgcaccaccatgcctggctaatttttgtatttttagtagagacggtgtttcaccatgttggccaggctggtctcgaactcctggcctcaagtgatccacccgccttggcctcccaaaatgctggtattacaggcatgagccactgtgcctagccagaaaattgattcttgattcatgtgttaaactattgtcatttgattctcagtggacaaaaaaattcagtttctcctattatattctccccgtgcagaattcttctgtgacctctggtcaccaaaatgtgtgggaatttctctccaccaagtaatcctacagattcttcagcagacagcagctggatgtcctctaattctgttcagttctgacactgtctatctggaggtagcctaagatcccacagattgagagctcagtgccacaagaccactcctgacttcagaagccattcataaggccctggttgttttacctgtacttctgactgactggctgtaaatgaggattcccatgaccccttccttgggttcaattaatttgctagagcagctcacagaactcagggaaacacttacgtttactggtttattatgtgatattacaaaggatacagacgaacaaccaaatagatggaagagatgcatagggccaggcatatgggaagggatatggcgcttctttgccctctctgggtgtaccaccctctaggagcctccatgtttttggctgcatggaagttcttccaaaccctgtccttttaggtttttgtgtacacattatcacttaggcatgatgtattatatcattggctgttggtaaccaactcaaccttcaacaacccgaggctttatcacttaggcatgatgtattatatcgttggctattggtaaccaactcaaccttcaacaacccgaggagggtacagagtactcaaagttccaaccttttcacctggtaggttcccctggcaaccagctcccatcctgaaactatctagtgcccagctggtgcccagctaccagccgtttcgttagtatacaaaaaagtaatcactccagagatcccacgggttgtaggagctatatgtcaggaagctggaagaagaccaaatatatatcttatagtacaacagattccttatttatgtagatttggtgttataaattggggttccaattccatttcctgtcttaaaatgcctaaaaactgaacagtagaattagtgagcactccagaaatattgtatgtagacaatttttgtgtatgatgggatccttaatacaaaagttatacacagtcctctgtggagattttttcttcatggattggaatggtcaggtttttccaaatagaaatctaatgtagtttaccgtataccatgtaaatgctgtgtaaatagttgttttactgtactttttagggaataatgaaaaaagtctgtacatgttcagtacagacacagttttttttttcctaaatattttcagtctgagggtggttgaatctacagatgtggaacccatggatacagagggccaaatgtgtataaataattaataatcagtgcttagggttaggtgcagtaagggatatgtattatagaatgttatggaatttgagagaaggaaaggtttatttttccatgtatagtcaaataagtcatttgagctgtgcctcaaagattgagtaggatttggacatatgaaattgatggggttgtgtactttaggccttaaatcatcgtatttccagtattattctttgcttagtgtgaataagccatggataacttaaattttttaaaaaactaatgaatatgaaagtaatccatatgtattgtgaaacattttggaatacatggactacagaaagaagaaaccccatctctctgcttggatagccactgttgacacgcagtgaactgcctttgctgtctggtgcgtcacttaaatgttagtaattcttaagtatgaaatcattctatggccagttcacaaaccagacccataaaattttaatttattgtaccttacaaataaaatataagctgaactgaaaaatactgtatatcaagcaagttctaaatgtagttactctgattcctactctttcctcaagttaattacagtattttgtaagaaatatcctatattcaggctactgattttgctgtcctgtccttgcctcctaaaggaagttatttagtaaagaaatgttagtgacgcttagctgggatcatatatttttatttttagatttaagaaaaagaaggtttttttttgttgttaaaatacctaattccttttttaaaaaatacattttttttttctgactggttcatgtttttacttttttattgtggtaaaatgtatgaaaatttaccattttaaccatttgtaagtgtacaattcagtggcattgtgttcacattgttgtgcagtcatcactatccatttccagaactttttcattatcccaaactgaaactctgcatccattaaacattagggccctattcctaaccctttacaccagcccctggcaaccactattctaccttctgtctctattatttgaatatgttaggtacctcatattagtgaaatcatacagtattttccttttgtgtctttgcttatttcacttagcataatgtttttaaggttcatccatgttgtagcatgcctaggagtttcatttctctgtaaggctgaatgaataacctgctgtatgtatggtatatcccaccttttgtttatccattcatccactgatggacttcggggttgtttctgcctttggactattgtgaataatactgctgtgaacatgtgtgtttgaatgcatatttgacccttctttttatttctttggggtatatacacaggagtagaattgctggcccacattgtaattttacattaaattttttgagaaatcatcttacggttttccacagtgccataccatcttacatcccaccaacagcgcacaggtgttccagtttctccacaccttgcgaacatttgttattttatctttttatttttcataatagccatcctaatgggtgtgaattggtatctcaatgtgtgtgtttttttttttttggttttgcttttttagtttttattagtatttttgttcccccatgcagatcaatgtggttttgatttgcattttcctaaaaacttgtgatggtgagcatcttttcatgtgctctttggccatttgtatgtcttctttcatgtttggttgtatagcctaatctctttttctgacccaccttcccctggcattttcaatgccattaacaactgttcacaaccataattttgaatgattatggactgtcctgccgtatagattcttctattgtaatgttttccaaatgacaagaactttaggagtagaacttttagggagtttaattgtatatcttatgatgatgaacacctgagtagataaatcttttatttttaaaagattgatggctggcttttgtcaaggttagttttagaattctttatatgcttctatttccaaatgctttttagaaggattgttctgcagcagatttgcttctgactgaatccactcttttctgtacttcgtaggtgctgataagcagagtaaaattagctcggaaacctaattcatctgtctgctttccttacaaatgttaacttctctagcccctttctctagtctcactctcatttctgttctcctcctttgtccttgtacctttatttcttcacctccattctagttggagtttgtgagggagcagagattatacattcaatatatcaatttagtcagaggtttatacatttctaaaaccctggacaccaatgtgcatagtccacattcttagtatttcacttaggagaatctccatagagacaaactgaattgcatacttaacaaaagttatgagttgaggctgggtgcagtggctcatgcctgtaatcctagcactttgggaagctgaggtaggaggattgctggagcccaggagttcaagaccagcttaggcaacatggtgagactctctacaaaaaattaaaaaaaaaaaaaaattagccagccgtggtggaatacgcctgttgtctcagcttctcagaaggctgaggtggcgaatacgcctgttgtcccagcttctcagaaggctgaggtggcaggattgcttgagcgtgggaggtcaaggctgcagagggccatgatcatgccactgcgctccaacctgggtgacagacaccttgtccgcccccccccccccccgccgaaaaaggttataagttgaatatagttaatattctagaccaggggtttgcgaactttttttctaaagggctagacaagtagtttcggctttgcggccacagtcttatgtttttcttttgttctttcttttttttgggcaacttttaagaaatgtaaaaaacattcttaattgaagtctgtaggtcggatgtggcttgggctgtactttgctgacccctattctaggtctatttgcactgatcttgctaggcaacatgactcttttttgatgatgagattcttttcttaatgtccatcttagtagagttgcaagtgctgatactgtccaggtgatttgtttttttttaaatttttatttttgaataaatgactaagaggtaatattattttaattttcagatggtgaccctgataactatattgcttattatcggagggctactgtctttttagctatgggcaaatcaaaagctgcacttcctgatttaactaaagtgattcaattgaagatggacttcactgcagtaagtatatctcaactttctttaaaggggaacttaacagaacttggggagagataatttgtttcataaggtgaggactggcatgctagacatagctggaagagatcaaagctacagtgatgttgtggactgaggaacaagagaaattcaaagtccctagaatcaaagatctgtgtgaaagagaacagcgggtacattagatgtttttttttcagaagtctggcagtgatgtcagctttgtggtttagaaagacaaatctgtgtggaggctggagtgtgaggcaagatgtgaggctgagacatgagttgatgaagaggctgaattaagatgctatcaggtgactggcagcagttgcacttaaggctgtaccaggaagaataaagtggggattacttaattgggctatgatttgtggtgacaataaaatgctaaattagcagagacatcccctggaaccaatccacaagcttcagaggtggagaaacttgtagcctagtaggaaatcctgatgattggcaggtcaccataaaggttgtgacagatgtgtgaacagggagggactcatgaggtagaactcaggtggggctttcagaggcagaattgacaaccactgatcaattagacggtttcagaagtaatttgatagccatttattatttatttcctactgtatttcgagaaggatttgagataactgattagatatggggtgaatgtttgatttgaaatattactaatattttaagatggaattcccaaatctcaaatatttttcaaatttatcttacacagctaagcaagcacaacctttcacaaaggttaaatggctcattttcttagtattatgatagttggagtggcttttttatgatagtttaatcttgctttttattgtattgatgaatttaacagggttaggaaaattttatttactgtaaaagtaatgtatatagggttaagtggaatattaatgtggcttcattggtcatccagagttggtattcttgaaagaaacgggattacacacattagaagaagaggaatatcagatgaagggggagaaactggtgcatgttagaagggaagagtcattggtaaagtcccaacttacgcaacttttattgtagggcaaaaagtatttttaaaaattgagatataatttatatgccatcagacttaccctttaaaagtattcagtggtttttagtatattcacaagttgtgcagtggtcaccactagctacttctaggacacttttatcgacccccaaagaagccctgtacctattagcggtcactccccattgctcccctagctcctggcaaccacttatcatagatttgtttcatataatgtaacatcgtataatgtttggccttttgtgtctgacttctttcacttagcatagtgttttcaaggttcattcatgtagcacatatcaatatgtcattcctttttatggctgagtaatattgtatggatatattatatttgtatattgatttagttgatgggaattgggttatttccactttttggctatcattgtgaacatacatgtacaagtttttgtgtggacatgttttcagttttcttgggtagaacaaaaagtatttttaaggaagcatactttaagaaaaattatacacattcattggttccaggaattattcttggtgtcaagtcagatgtgcactggaaaaataaatatttattaataatttgtttatttagttttattcttcgtgtttaaaaaagatttagaaatctataatattcaagataatcctctgccccctttttttctaggcaagattacagagaggtcacttattactcaaacaaggaaaacttgatgaagcagaagatgattttaaaaaagtggtaagttcaatatgtatttgactctaggaagatgttattttgagagaacgtatttgaccttttttatattatgacagttaatagtaattttatagctaagagtcaatagtcttagacagtaaatagagaatagccagatttatatatttaagaatcacaaatcctgaattactatttgatggcagacatcaaagaatcctgttaacagttggaaggtaaagcgtacccaatagatatataatcttaactcagtttatacagcttgcttgttctgctttgtccaccatgagaatctaaagatgtcagctgaactacttttaaagcccttgttaatccttattaggctttggatctgtccttttggagatccttcatttgatttgagaggagtaatgaaacagattctttttttttttctctttttttttattattattatactttaagttttagggtacatgtgcacaatgtgcaggtttgttacgtatgtatacatgtgccatgttggtgtgctgcacccattaactcgtcatttagcattaggtatatctcctaatgctatccctcccccctccccccaccccacaacagtccccggagtgtgatgttccccttcctgtgtccacgtgttctcattgttcaattcccacctatgagtgagaacatgcggtgtttggttttttgtccttgcgatagtttgctgagaatgatggtttccagtttcatccatgtcgctacaaaggacatgaactcttcattttttatggctgtatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttataatcctttgggtatatacccagtaatgggatggttgggtcaaatggtatttctagttctagatccctgaggaatcaccacactgacttccacaatggttgaactagtttatagtcccaccaacagtgtaaaagtgttcctatttttccacatcctccccagcacctgttgtttcctgactttttaatgattgccattccaactggtgtgagttggtatctcattgtggttttgatttgcatttctctgatggccagtgatgatgagcattttttcatgtgttttttggctgcataaatgtcttcttttgagaagtgtctgttcatatccttcacccactttttgatggggttgtttgtgaaacacattcttaaaagggaattttgcagtcatccattatggctgctttacaaagtgtaaagtgctttggatttgttagggaatgttacagattttgtgtcattgaagggggtatatactaaaaaatgatttggttagagacacttagctggtctttttatgccctcattaggcttgttttaaagaccagcatttttgttttacatgggtttgcttctggaatggtctagaaagggtatataagccactgtttattatttgcattttttatagtttatggaaatgcttagttactatgatgataaccactatgaaaagaaaactaaaatttctaacattatcataacacttgtcacaatactctgtcatctgtggataaatccaaaaacattagatttaattgtattggatcagaaactgccttgtggtctcaataaaatcggctgtcattttctttttatctatctcccctcctacttgggaagatgcttgagagcaggctgaagactgggtggtggggaggtgatagtgccggagtaatctttccctagcccaggcctttgttcaaagaacgtgttgcataaacatttgtcaaatggatgaatgaattataaaacatgagaatgtgtttctgcttctagcagatgcttaaatctgttacttaggttttttttttttccaattaaacttgagagtagttttttagaaataatttaggatatagttttagcacaaattaatccttattgggcattggatgtttcttctggataactgagatcttggtaccttggatatgccttgggttaatgtcttttctgtgatcagtattaaaacttctcagaaacaaggaggtggactctcacagaccttctactttttagattgctctttggcagtcatacttgtagagtgttcttaaagcaaactatttttttagctcttactattgttatagggattcttccatgagaatgcatatctgtctttaataatcttttagttttaattgaactttttactgagataattgtagattttcatgcagtggtaagaaataatacaaatagatgacaggtgccatttacccagtttcctccaataagaaaattgtttttgtacctatgaatttatccgtagtgtaaaactatagcactgtatcacaaccaggatattgacactgatacaatctatcaatctattcagatttcctcaattttagtagtattcatttctttgttgcatgtattccatatactttatcacatgtgttggttcatgtacctaccaccatagtcaagacactgacttggtattctgttaccctgggatccctcctgttaccctttgtaaccataccaatttccatcccaccctgctctggccccctagtcatactttctggcatccactaatttgatattcatttcttaaattttgacatttcaaaaatcttacataactggaatcaaatgttatacaaaaatcttttagaattgactctttttactcagtgtaattttctggagatttatctagatttttacatatcctacttagtttgttccttttagatgctgatggacatttgggttgtttccatttcttggctattgcaaataaagctgccgtgaacattctcgtacagatgtttgtgtgaacgtgaatttttgttatccctgggataaatgtccaggagtgcagttactgggttgtatggttattgcatgtttattttgtaagaaagcaccaaattgctttccagagtgactgtaccattttacattcctctgcatccttgccggcatttggtattgtcattattttttattttggccattctcatagatgtgttactatattgtggttttaatttggatttctctgattactaatgatgttgaacatcgtttcctgtgcttatttgccatctgtaaatccttttcagtgaaatttctgttcatgttttctgctcatgttctaattggcttgtttgcttttttattgttgtgttttaaatgtcctttatatattttagatactttgttggatatgtagtttacaaatattttcccctcagtctgtagcttttcctttgatcctcttcacaggatgttttatagaacaaaatgtctaatttttaaattaatacagaatatttgtgcatatttatgtatttttgaggaacatgtgatgccttgttacatgcatagactgtgtgatgatcaagtcagggtattcagaatatctatcactgaatatttatcatttctgtgtgttgggaacatttcacgttctcccagctattttgaaatagacaatatattgttaactaccctactttgctattaaacattacctcttattcttctttgctgtgtgtttgtacccattaacctctcttcatccccgcctcccactgacacaccctttccagtctctaatgtctatcatgtctgtcatcctactctctaactctgtgagagtaacttttttttttgctcccacatatatgtgagaacatgcaatgtttgactttctgtgcctggcttgtatttcactaataacctccagttccatccatgtggctgcatatgaacatgattttaattcttttttatggccaaatagtatcccattctcattcactcattctctctctctctctctctctttctctctctcttttcccccgccctctccctctccccctcccactccctctccgcctccctctccctctccccctccccctccctctccttctccctctccctctccttctccctctccctgtccttttccctctccctctccttctccccatccttctccctctgcctatccttctccctctccctctccctctccctctctccatacacacacacataccccatacttaactttattaattcatctgtagatgagcacatttggtaagattccatattgtggaatagtgctgcaataaacatgaggatacaggtatccctttgatatactgattttgattgtatagtagttctatttttagttttctgagaaatctccatactgttttacatagtggctgtactaatttacattcctgccaacagcgtataagagttcccttttctctgcattcttgccagcatccattattttttgtctttttatagtagccattctaactgggtgaggtgttctcattattgttttgatttgcatttccctgattattagtgatgttgaacattttttcatatacctgttggctatttatatgccttttgagaaatgtctgtttatgtcctttgcccatttttaaatgggattatttgttttcttactgctgacttctttcagttccttgtatattctgtatattagttgcttgttggatgaatagtttgcatatattttctgtagtcaacagcttgtctgtccactctgttgattgtgtcttttgctgtgcagaggcttattatttttacatttttgagttggggtctctgtcacctatgctggagtacagtggcatgatcgtggcttactgcagcctcaaattcctgggctcaagtgatccccctgccttagccccccaagtaactgagactacatgtatgtatcactaggcctggctaattttaaaacattttttgtagagatgggatcttgctatgttgcccaggctagtcttaaactcctggcctcaagtgattctcccactttggcctcccaaagtggtaggtttacaggtgtcagccaccattcccagcccagaagctttttagtttaatataataccatttgtttatttttgtttttcttgcttgtgcttttgagatcttggccataaaaactttgcatagaccaatgtcttaaagcatttttcccatgttttcttctagtagctttatagttttaggtcttacgtttaagtctttaaggcgtttgtgttgatttttgtacttagtgagagacagggatccagtttcaatctgctgcatatagatatccagttttcacagcaccatttattgaagagggtgtgtgtcctctccccaatgtatgttctcggcccctttgttaaaaatcagttgctgtaagtacatggatttatttctgggttctctaatctgttccattgatgtatgtgtctggttttataccaataccatgctgttttggtcactatagccttgtaatatactttgaagtcaggtagcctgatgcctccttactctttttgctcaggattgctttggctattcaggctctgttttggtttcatatgaattgtatgattgttttttctatttctgtgaaaaatgacattggtattttgatacagatatccttgaatctgtagattgctttgggtagtatgatcattttaacaatgttaattttgatttgtgagcataggatgtcttactatttgtttttgtctttttaaatttctttcatcagtattttgtagttttctttgtagaagtcttccaattccttggttaaattttttcctgggtattttatttttattattgctgttgtaaatgggattgccttcttagtttaagtgatttcattattggtgtatagagatgctattgatttttgtatgttgatttagtatcctgcactttactgaattaaaaaaaatagttctgagagtttattttggattttgggttttctaaatataagatcatgtcatctgcaaagtgggacaatttgacttcatgtttttcaatttggatgccttttatttctccctcttgcctgactggtctgcctaggaatcccagtactgactgcattgagtaggagtggtgaaggtgagcatctttgtcttgtttcagttcttagaggaaaggctttcaattttttcccattcactatgatgttaactgtggatttgtcataatggtctttattttgttgaagtatgttccttctgtgcctagtttgtttagagtttttgtcctgaggaggctttgaattttatcaaatgtttttactgtatcttttgagatgattgtatggtttttgccctttgtttgtccatgtgatgtatcacatactgatttctaaatgttgaaccattcttgcgtctctgggataaatcccacttgatcatggtgtcttatgttttctggttttgtttttgtttgagatagggtcttcctgtgttgcccaggctggagtgcagtggtgcggacatgactcgctgcagcctcaacctgctgggctcaggtgatcctctggcctgcagtggtgcagacatgactcactgcagcctcaacctactgggctcaagtgatcctctggcctgagcctcctgagtagctgggaccacaggtgtgcatcaccacgcctggctaattttttttttttttttttttttgagactgggtcgcactttgttgcacaggctggtctgaaactcctgggcttaagagatccttccaccttggcctcccgaagtgctgagattacaggcatcagccactgcacccagccggtgtcttacctttttgtcaagctattggattcatttgctagtatttcgttgaggatgtttgcatctgtgttcatcaaagacattggcctgtagttttctttctttgttgtgtccttgtctggttttggcttcaaggtaattctggcctcatagaatgagttagggagaattcccaccacttcagtttttgtaataatttgaggagagttggtattatttctcttttatatgtttggaagaatttggcaatgaatccatccagtcctgggcttttctttgttgggagactttaattactgatttaatcttgttactggtctattcaggttttctgtttcagccttggtaggttcagccttggtaggctgtaggtttccaggaatttatccatttcctctagattttccagtttgttattagatagctattaataatagtctttgggggatttttttatatttcttgggtatgagttacaatatttcctttttgtttccgattttgattatttgggccttttctcgtttttttcttggttaatctagcttgtggtttatcaatttgtttatcttttcgtaaaaccgactttttgttttgtgatcccttgcattgtttttttagtctcaatttcatttagttctgctgtgatctttatttttttttccttctactaattttgggtttgttcttccttttctggtttcttgggatgcatgttagattgtttatttgaaatctttttttttatatatgtgtttattgctacaaagtttcctcttagcactgctttggctgtattccataggttttggtatgttgtgtttccattttcatttgtttcaaaaaaatttttttatttccatcttaatttcttgacagagttttcatgtatttgtatagtttccaaagttcctcttggtattgttttctagttttattccaatgtggtctgagaaagtacttacatgattttgatatttaaaaatttgttgatacttattttatggcctaatatacgtctgtccttgagaatgttgcatatgctgatgagcagtatgtatattctactgttttagggtaacatgttctgtgaatgtctgttaagtctgtttggtctaaagttcagttatagccaactttttttgttgattttctgtctatatgatctatgtaatgctgagagtggggtattaaagtcccccactattattatcttggagattgtctttccttttatatctaataatatttgccttaacatatgtgggtgctccagtgttgggtacatatatatttagaattgttatatcctcttgctgaactgatccgtttattattatataatgacttttgtctttttgttttttgtgaggcagagtcttgctctgtcacccaggctggagtgcagtggtgcaatctcagctcactgcaacctccacctcctgggttcaagcaattctcctgcttcagcctcctgagtagctgggactacaggcgcataccaccacatcaccacatccagctaatttttatgtttttagtagaaacggggttttgccattttggccaggctggtctcaaactcctgatctcaggtgatctgcctgccctggcctcgcaaagtgctgggattacatgtgtgagccactgtgcctggcctgtcttttttttttttttttttttttttaacagttctgtcttaaaccgataaatacgttttatttaaatatagctattcttgtttgctttaggtttccatttgcgtggaatgtcttctgtccctttacttttagtcttcgtgtgtctttacaagtgaaggaagtttcttgtaagtgccatatagttagatccattttttaaaaatccattcagtcagtcctttaaggggaaaatttaatctgtttaaataaccttgaaaagttattactgatatgtgagatttcatcctggtcatattgtttgttgttttctggatgttttgtatatcctttgttcctttctttttctcttattgtttatctttttggtttggtggttttctgtagtggtaacatttgaatcctttctcatttgtgtgtttgctctaccagtgagttttatacggtgtgttttcatgacagtagatattgtccttttgcatctaggtttaggactcccttaagcatttcttgtagaattggtctagtggtgatgaacctgtctgggaaaggctttatttttctccttcatttatgaaggataactttgctgggtgtagtattgttggttgacagttttctcttagcactttgagtatatcattccattccctgcaggccagtaaggtttctgctgagaaataatcccgatagtccaatggggtttcccttataaatgactaaatgtttttatcttctgttttcagaactttctcctagtttttgacttttgacagtttgattgctatgtgccatggagaagtcctttttgaactgtatctattttgggttatctgagctttctgtctatcgacgtctaaatcttttgctagacttgggatgttttcagctattattttgttaagtaagttttttatcactgtggttttctctttaccttctgtgacaacaaaaattcaaatatttggttactttatggagttctgtgtgtcatgtaagcttgtttattctttttcattcttttttctttatatttttctgattggcttatttcaaaggacctgtcttcaagttctgaaattgtttgttctgcttgctgtcgtctattgttgaagctcttttttttttttttaattatactttaagttttaggatacatgtgcacattgtgcaggttagttacatatgtatacatgtgccatgctggtgcgctgcacccactaactcgtcatctagcattaggtatatctcccgatgctatccctcccccctcccccccaccccacaacaggccccagagtgtgatattcccctttctgtgtccatgtgatctcattgttcaattcccacctatgagtgagaacatgcagtgttttgttttttgttcttgcgatagtttactgagaatgatgatttccaatttcatccatgtccctacaaaggacatgaactcatcattgtttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgttttttggccgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatgatagtttcttttgctgtgcagaagctctttagtttaattagatcccatttgtcaattttgtcttttgttgccattccttttggtgttttagacatgaagtctttgcccatgcctatgtcctgaatggtaatgcctaggttttcttctagggtttttaaggttttaggtctaacgtttaagtctttaatccatcttgaattgatttttgtataaggtgtaaggaagggatccagtttcagctttctacatacggctagccagttttcccagcaccatttattgaatagggaatcctttccccattgcttgtttttctcaggtttgtcaaagatcagatagttgtagatatgcggcgttatttctgagggctctgttctgttccattgatctatatctctgttttggtactagtaccatgctgctttggttactgtagccttgtagtatagtttgaagtcaagtagtgtgatgcctccagctttgttcttttggcttaggtttgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttttgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaatgggagtggtgagagagggcatccctgtcttgtgccagttttcaaagggaatgcttccagtttttgcccattcagtatgatattggctgtgggtttgtcatagatagctcttattattttgaaataggtcccatcaatacctaatttattgagagtttttagcctgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggagaagctttttgatgtgctgctggattcgttttgccagtattttattgaggatttttgcatcaatgttcatcaaggatattggtctaaaattctctttttttgttgtgtccctgcctggctttggtatcagaatgatgctggcctcataaaatgagttagggagaattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgagagagtgtatgtgtccaggaatttatccatttcttctagattttctagtttatttgcgtagaggtgtttgtagtattctctgatggtagtttgtattgctgtgggatcggtggtgatatcccctttatcatttttttattgtgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcggtttccatgtagttgagcagttttgagtgagattcttaatcctgagttctagtttgattgcactgtggtctgagagatagtttgttataatttctgttcttttacatttgctgaggagagctttacttcccagtatgtggtcaattttggaataggtgttgtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctagttgctcctgtattgggtgcatatatatttaggatagttagctcttcttgttgaattgatccctttaccattatgtcatggccttctttgtctcttttgatctttgttggtttaaagtctgttttatcagagacaaggattgcaacccctgcctttttttgttttccattggcttggtagatcttcctccatccttttattttgggcttatgtgtgtctctgcacgtgagatgggtttcctgaatacagcacactgatgggtcttgactctttatccagtttgccagtctgtgtcttttaattggagcatttagtccatttacatttaaagttaatattgttatgtgtgattttgatcctgtcattttgatgttagctggttattttgctcgttagttgatgcagtttcttcctagtctcgatggtctttacattttggcatgattttgcagcggctggtactggttgttcctttccatgtttagtgcttccttcaggagctcttgtagggcaggcctggtggtgacagaatctctcagcatttgcttgtctgtaaaggattttatttctccttcacttatgaagcttagtttggctggatatgcaattctgggttgaaaattcttttctttaagaatgttgaatattggcccccactctcttctggcttgtagggtttctgctgagagatccgctattagtctgatgggcttccttttgagggtaacccgaccttcctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccatcgctgataccctttcttccagttgatcgtattggctcctgaggcttctgcattcttgagccttggttttcagctccatcagctcctttaagcacttctctgtattggttattctagttatacattcttctaaatttttttcaaagttttcaacctctttgcctttggtttgaatgtcctcccgtagctcagagtaatttgatcgtctgaagccttcttctctcagctcgtcaaagtcattctccatccagctttgttctgttgctggtgaggaactgcgttcctttagaggaggagatgcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggacccttagctgcaggtctgttggaataccctgccgtgtgaggtgtcagtgtgcccctgctggggggtgcctcccagttaggctgctcgggggtcggggtcagggacccacttgaggaggcagtctacccgttctcagatctccagctgcgtgctgggagaaccactgctctcttcaaagctgtcagacagggatatttaagtcttcagaggttactgctgtctttttgtttgtctgtgccctgctcccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagcaatcagcgagactccgtgggcgtaggaccctccgagccaggtgccggatataatctcgtggtgcgccgttttttaagcccgtcggaaaagcgcagtattcgggtgggagtgacccgattttccaggtgctgtccgtcacccctttctttgactcagaaagggaactccctgaccccttgcacttcccaagtgaggcaatgcctcgccctgcttcggctcgcgcacggtgcacgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctgaagctcttaagtgtattttaaaatttcattcagtgaattctttagttccagtatttgtctgattctttttaaaaatgatatgtatctcttttatacatttttcattcataccctggattgtttttctaatttctttgtattgtctatctctgttctcttatatctccctgagcttatttagtgtcattatattgaatcatttttctggtatttcacaaatttctttttcattggaatctgttgctggagagttattgttttcttttggaggtgtcatatttcattgctttttcatgtttaagttctcatgttgatatttgtgcatctgttaataatgtaactgtcatgtctttgaattttttggatttgtttttgtaggagaggactttttccttaagatgtgtttgtgattttggttgggtagagcactttggctttgattcttggtgtatgtagtagtatagtctccatataatttggctggctgtaatcagtgtcagtggtatctgtgatttcttcagtggcttagggtgcagttgttattggaagctgttttgtagttttgctggggatggggatgtcagataagccagttcttgggccctagtgggggcaataacaggccaaacatgcctaacttagggcttcaaggtggcgtatgctggcatttatgttagtgggtccacgtggaccaattcttgggcttccgggtggcctactttggtacgggaatggcagcagtggattggacaggtgggtgggtccgtgggtccctgggcagcagttgtggcctgggcaatgacagtagcattggtgggacaaccctttggatcccagctggtctgaggtggtcttggcgatggctacactgtgttgagtggggcagtcccaggccacaggtggtgtgtcctggtgtatgctactgtggtggcatggcaagctgggtgggctcaccctcaggctccaggaaggagtgctcaggtgccaatgggtatagactgggcagagaaatcctcaggccccaggatagtgtgcttgggcacttgggcagaggcaggggtagtgagccatgccaggcagaactatcctcaggcccttccagtgatgtgtacaggtgctggctgtggtgggtaagggtggggtgatccccagactttcagtgaagtgcttgggtggaggcagcagtggctgtgctgcagtcctgctactgggtaaggcggggattttttcagtggcagcagctgtaggcaggtggctggggagcacacactttgtccctaggtggcggctgctggcaagagagcctgtgctcagtacattttaaaatgtgtagcaatccttctcctggggtggtgggcttgctgctagtgtcttgtgcttggctctggtggcagcaaccagctacagtggcatctgcaggtgggggatgtcaatggggcacaatggatgtggagatgcagaaactgtggggtgggccccagggcaggatgctgcctggtaagggctgtattcttacagaggcaccatgttgtaggtgcataggacttggaaggtgtgtaggatccagtgtgatctccttctttgaagcaatgccatcatgcagtctccatgcagctggttactttcagggcccacaagggttgagaggatctccagctaggattggaggagtccacagtggcaatgtggactgctgggggtcacttacttactttttccccacattcagagcctctttgggctcttatcccagccaagcaggctgcctcacttctctcttcttcttcttcttaggtgtttcctgttccttctctgttgggactccagcgttctctcctagatgatctatacttgctattttggttcttccttatgaagaaggtgactttcagatgcctctcgtcagccatctctgaatgccttcctcagtctttaaatttgatgaagttcaatttgttgatttcctttttacttctgtggactgtgcgtttggtgtcatgtctaagaagtattcactacgccgtaggatctaaaacttttctcatatcttctaaaagttttatggttttgtgttttatttttaagcccatagtctatttgagttaatttttgtatgatggtatgaggtttaggtcgaagttcatttgttttgcctttaggtatcagattgcttcagcaccatattttgaaaagactttgtttctttcattgaattgcttttgcaccttattcaaaaatcagttggctgtacttttatgggactatttctaggttctttattctgttcctttgatctgtgtgtctgtccctttgtcattcctgcactctgttgattactatagatagtattaaaagaaaaacttttgagaatttaaacttagcagagtttatttgagcaaagaatgatcaatgaagtcatcactcctcacaaccagaaaaggttcagagagctgggctctgcaatgtgggcagtgagtacttatagacagaaaatgtgaggtacagaaatcgtttgactggttacagctaggcctttgccttatttggatatggtctggtcagttacctgcctgtgattagtggcggtttggctgcttatgattggccgagacaccactgttattaccttcttaagttaggttttcagtttaagttaggttgtagttcattaagtgggaactgaaagtatggagacagcctcaggccactggcctcctgcttattgattgattgattgagacagagtcttgccctctcacctaggctggagtgtagtggcatgatctcggcccactgcaacctctgcctcctgggttcaagcaattctcctgtctcagtctccctagtggctgggatcataggtgcccgctaccacacccagctaattttttgtgttttgagtggaaataggattttgtcatgttggccaggctagtgttgaactcctgacctcaaatgatccacccaccttggcctcccaaagtgctgggattatgggcctgaaccaccacgcccggctgcctcctgcttatttaatagtagttatccttaatattgggtaaagtgattcttcttttgttctttgtcaaaattgttttagatattttaaggttggtgtctttccatatacattttagaataaacttgtctgtgtttataaaaagtcttgagatatttggttaggagtcgtaataaacttacagattaatttggggagaattgacacctttattatgttgagtccagtgcatgaacatagtagggatgtctccatttgttgaggtctccttcagtatttttcatcagcaatttttaatttaatatacagatactgtatgtgttttttacatttttttaaaaagtgtatacctaagtattttatatttttactgtgattgtaaatggtatgttttaaattccaacttttgcatgggataatatttttgtgattatttcataggaaagtactcaccttgtacttaattctatgagagaaatcttagtgggcattcagatgggagaccaagttaaatttcaaaactacaagtcatttttaaaagttatattaaaacaattttgtatgcatgtaagaataattataattagattggatttggtttagagaaaaatacaagcacaggattcatatatttcagaatcattttatgttaagctttgtttgaagtaaatttagggtacctggaatagtttgtccaaactcattgtaggacttaaaattcagattaacaattggcaaattcatatgtatgtactttgatcaatatgtatagtcctgctcaaggacggtagagagggagacacagggtcatggaattggaatgctgagaaaaatttatttaacatattaaaaaattgattaaattttaagcattcggaaccttgattccacaggacagaagataaaagaatattatcaggcaggtaacacaagaaatacaaattcaaaatcagtgcatacagtgcgcagtcttccaaatgaagagatgaatgttaaaactattcagagaccactggtcattaagttgagcaaaaatcaagacgtattttacagcgtaatattgataggtcttaaaggaaatgttttcagtcatataatatgttgacactgcaaacataagcagagcttttgcggtacagtctggcattaagtattacgagagaaaaacattttgcccagagacacttactggggctctatttgctctggaaactattagagaatgttgtatctatataatagaataatattcattaataagaattatttaaggtttggtttataaacttgggcatacataataatgtcaattaaatggcaatataaaaattgtaaatgttgataactacataaaatttttatgtctgttaaattaatatgatatgaatgacaattatttgaagtttctagctcttttcccttgtgagagttgtcagaatcaaaatgaagtcacttgtattaaattctaacaaaaaataaataaagccaggaggttaagaagggagctctcacacacgtctatcgtaagaactgctacaaagcatctctgaagggctcttctgcacatatgcctgtaataagaacttttgccagcagtccctgcatctctacatccatggagccccattgacattccccacctgcagcggccactgcagctcaaactgcagcttgctacgtgagtcacaaggatagctagctggatgcataagaacatttgactgacacagtctcccctgtatccaatgttctctttgttttcaaacaaattccttatgcttttcccttttgcctttaaaagcttctcctggcttcaacctgtttggatatgcctgtggtccctatagccctcatatgctggatttgcaaatcccctgcacactccagaataaactcagttcaataaactctttgaagaatgcttgttatttaggttgacactcttttgtaaagttgtattcaatacactttgaagaaaaaagaaaagctttggaacaagaggtaggaaccttgagttttagatttgactttgtacttcagccatggtttgtgcagcactcaccatgtactgggtgtgttgctgagtggtttgcatggattattccacctctaggggcagaggactgctatattcgtagtctcagtttacagcagaggaaattgaggcttagagcagtttagtaacttgctcaagattacaccagtagttggcaagtaggttttagattccagggcctgcactctgaagcactgcgctgttctgccctctgttataattagtaattgtccatatgcatcctttgaagatgacttctgtagaatatgggcacaggtctcaactgtatggacagttttacaaagtgcagaataggatagttgctactatctgcataaatgtaagaacatacatatttgcttgaatgtggataaaatacccctggaaagatatgcaagaaactgataacactgattaccttctggaggaagattacaccatgtgaccttattaccttctcaaaaaaagtgtaaagtgtagactttatacattttgtgtaagtggccttgaaagttcttgccttctaaggaccttattttcctcattgtgaagtgtagaagttgaatagatgacatattcctatctttattgttgatactatataatggatgatttctgagtctagtttgaaaagatcaaatttatgttatgcctattttatatttaccaattacaggattcttatactttaatttttgaagatttgtgagtataaatgatatataaaagtttgattgttttatatgttcttggttaaatgagctttttgtgtaatgatcatttaccaggctataaaatgtactaagcatttcatcttactaatgtggtgctggatacagccaggtggatatgtttagctacattttatataaaagaacaaaaatttgaataggtgtaatctctttctgggctccagtgagaatctcattctttattatgtactgtatactgattactcagctggggtgagggttgcctgcataaaagtatctcctcaggttcataattgctgtcttagtcttaaattggatttgacttagtcttaatctattcttggtcttcattgtttactatatatttgctattcatgctttgggcttacgtggataatatttaaatttaggcagttttccatgagatccaaatataaaaaagcaacgataaatttaaatagtcatttcatataacttagatcatttaatttgtctttgagctgtcagttactcttaatcagtgcatacaatcatttgttagttcagtgagcatttgagtgcatgttctttgcaaagaagctagtctctgccttccaagaaatgatactagagtaagaattaatcaggcaaatatgatatatgataagtgtgtgattgagtcctctgggaacatatggaagggtcatctaacttaactgggggaggaagggtctggattcaagaagggcattcctaaaggaggttacttgcttgaaatctgaattttaaaaggatgcatccgtgtaagcaaggtgggtaggaggaccatccagggcaaaggtgagagcctgtgtaagaatcagaggcaagcatgtgcctgtcatttaggaaatgtccagtaagctggagtatgagactcttgacaggcatgtgggggatcgtgattataaggaggacattatatagtgccaggaattggctctttatggccattgaaggtttatgttggaagtattatgaacagttttttgcttagcgtgatcgactggttgctctgaagaatggattggaataagacaaggggagaagcagagagtctgctaaatgagactgttgcagtaaataagtaatccaagtgtaaccttacagtggtcaaagagtaggctaatgtaggtggggtagacgtttaggaggtcggctctagagagattcattggttggggtgataggaaaaaaaggaattatgatatccaggtttctggattgttcaaattgtccatgctattccctgagatagtccagagaaaaatcatttaggggagagggacaggtagagaaaatatgactgtcttatttctataaaaacttcctggttctcactaacttgttttatgtaataatttgtaatctgtgaattcttcccttttatctcaaatccaacatactttcctaagtgcagtttaaactcatctattcttggtcttcattgtttactatatctttgctattcatgctttgggcttacgtggataatatttaaatttaggcagtgttccatgagatccaaatataattggatcaattatatttaattcaatttaaatagtcctttcatataactgtatttttttactttgacagagcagaaacttgcattttgattgtgagaaaccatatattaggtaaataatggtgccaattgcaatttaatttttaaatcaagtataaacctttggtaagacatttgataaactctcctttggtagtctgtggatctgtatcaattgtaaacaattcaaactaacataattatatctattatacatcaaaataactgtcatcattttttttccatctttaattctttaatgcagaaaggatcattatattgtttcaggatagctaactcagaaataaccaaagtttcggctgggtgaggtggctcacgcctgtaatcccagcactttgggaggtcaaggtgggcagatcacctgagctcaggagtttgagaccagcctggccaacatggcgaaaccctgtctccactaaaaacacaaaaattagctgggcatgttggcacacgcctgtaatcccagctactcaggaagctgaggcaggagaattgcttgaacctgggagggaaaggttgcagtgagctgagattgcaccactatactccagcctgggtgacagagccagactccgtctcaaaacaaacaaacaaacaaacaaaaaaacccaaagttttaaaagaatactcaaagtattgtgaactgagaataaaggagaatggtacttttaagtcataaagtcattttggttataatttaaagatagcactttatgctatgattcagataactgttctggtttttattggttcagatttaatactggatcacatactgtaattcaccaactgtaaggagctatcaattataagacaaattattttatgtactactagaagaataaatgctgccaattaaagccatcttataacaatatttttaatttatgcttatggaaagaactgtttgagacttagatatgcatttttgttatatcatactgctgtattcattgccttcctgcatacattaatttcttgaagattttaagtggaatttaaactcagcatgtgtagtaagtaccaaaaatgcccataacacaaatgaagtgtgctagaccattcttgtgtatgtatgatcatgctgactggctgatggtaagactccatcaatttttagattcatccctctttgagagagattcaaatgtgttttcttatcagcttgctgagatatgggccaaagggaaagaggaaggggtgagcctaaaagatgccagcagtaaaatggagtaagactctattacatcaggaaaagagggaactactgacttttaggattcatggcttaaatgataaagtagagccattgattgaagagattgatggggagggatagcaatgggttgaagatgggaaacagaattccactttgtccctgttactgagatgccatttaggtgatggattggagacatctaaatgtgaagtaggtagctgcctgcctgatattggatgtgtacataagagggttctggaaacagctatctgagtcacagcataaagtgctatctttaaaacccacagtttcagccaggtgcagtggctcacacctgtaatcccagcactttgtgaggccgaggcaggcggatcatcaggtcaggagattgacaccatcctggccaacaagatgaaactctgtctgtactaaaaatacaaaaaaattagctgggcgtggtggcccatgcctgtagtcccagctactcgggaggctgaggcaggagaattgcttgaacctgggcaggtggaggttgtagtgagcctctaattagtgttttaaagatagcactttatgctgtgactcagatagctgtttccagtagtcctcttatgtacacatccaatatcaggcaggcagctgcctacttgacatttagatgtctccaatcgaacgcctaaatggcatctcagtaacagggacaatgtggaattccgtttcccgtcttcgacccattgctacccctctcccatcaatctcttcaataaatggctgcactccagcctggtgacagtgcaagaccctgtctcaaaaaaaaaaaaaaaaaaaaaacccagaaaacaaaccccacagtttactcctgtatagaagggagataatctgatctgccctttaaggttttaggtttagcttagagtagtgcctggagcacagaaagctctcaataagtgttttctgctgtcatgattgatctccatcgtcatctatagcatgggctttagagatagagaccttagtttgaatttaagcaagacttacagcaagttatataattattcaattttttttttttttgagatggagttttggtctgttgcccaggctggagtgcagtggtgtgatctctgcttactgcaacctctgcctcccaggttcaagcaattctcatgcctcagcctcctaagtagctgggattacagacctgcgccaccactcccagctaatttttgtattttttagtagaaatgatgtttctccatgttggccaggctggtctcaaactcctggcctccagtattccacccacctcagcctcccaaagtgctgggattacaggcctgagcccccacacctggcccaattattcaatttgtctgtaaactggaaatagtaaaaccaagctcatgggtagtattcttagtactagatgaaaaagaaaagcaaggaagcatctctagtgggaagttatctgtagtaagtatacaaaatagacttaagacatatattctagggccagttgaggaggctcacacctgtaatcccagcactttggaaggccaaggtgggaggattgcagcttgagaccaacctaggcaacatagtgaggccatgtctctacagaaaataaaataattaactgggtatggtgacacatacctgtagtcctagctacttgggaggtggaggcaggaggatcacttgaacccagggctctgaggtttacagtgagctctgatcatgctcctgcactccagccagagtgacagagggagaccctgtctaatttaacgaaaaagacatatattctgctctttagcaatttacactttagttgcaggaaataagtcctaaacatgtatgtgcaagatgaacaatacagagaaacttgtgagaagttgacatatgagctgtctaggtaacaagataagattgagaactacataggagacccacttcagtttttctcttgattaactgtgtgatgttgggccagttgtttactgtctgtgagactcaggattttcacttataatgtgagagttaattggacaagatgatttcttaggatacctccattttgaagggtttcttaaagtgatataaatatttagaggaaaggcgattactccagaaagcttggaggaggtgggacttgagaaaacagagtggtttgattaaaaactacaagatggcacaagagtcttttggaatttttgaaggtatctgttttatgtgttacaattaggagacattagctgtattagtctgttctcatgctgctaataaagacatacccgacactgggtaatttataaaggaaagaggtttaatagactcacagtttcacatggctggggaggcctcacaatcatggtggaaggtgaaggaggagcaaagggacttcttaaatggcagcagtcaagagagcatgtgcaggtgaactgccctttataaaaccatcagatcatgaaacttatttactatcatgagaacagcatgggagggacccactcccgtgatacaattacctcccaccaggtccctcccatgacacatgagaattatgggagctacaattcaagatgagatttgggtggggacacagccaaaccacatcaattagctatatccttacattttcctgcttcattagttatgaattaatcaactatttgagctcatcctctgtgtccgttttccttgtgcagggtgtgtctaggacagtggttcttgggattggcctcaggatctcattatagtgttaattactgaggtcaccaaagagctttgtttatcggtatttactatattagaaataaatttgagaaattaaaataacttaatgaaaagttactacatgttaatgtattttttgtgtaaaaataacttttcaaaaaccaaattttattattaagagtagtatttgtttcacatatttgcaaattttgttaatatctgtcttaattgaagataacaattctcatatctgcttctatattcaatctgttgtgatttgtgctttggttgaagtatattgaagatactatggcctcacagatatgcaggtagaaaaggaagaatgtttttgtattctttttagataattacgagtattcttctttgatgttccacaaaactccactcgcgattatataggttagttacatatggactctgaatccttattaattaacttacagcactctctgttataataaaatgcattggtttatcttgccctttgaatgggttctttatcttttatccatacatgcttttgtactcacagacccctgaaagggcactaaggaatcccaggggttcctaggtcacactttgagaatcactgctacagtgttatctgcctcagagagtggttactactttaaggttatgggtatttttagcgtggcagagaaatttggcctgtcctgttaagtggttatgtgaatttatattcccaccagcagcataggggagttctaggtatgccacttcttcaacacttcatgtgaacagatagtgtgaattttgctaacctgttaatgtgagaaaggccctttgaggtctcttgtgtatatttctgttgggttctagttatccaactatttcttttccattcgtccatcctccttcttcttccctcctgctctctccccacccctaatggatttagctgcttcttccttagtctgttctttccgtatggttgtacatgctgtgtgtttttctcatactcgttacctcaggaattttaatatgcatgtttaacaaggtaatcaaaacacaaggattttagaatgctttaattcagtcgctcaccccctgacttgtatactattgtttccaaaaacagttctttatgtttttttctttttcttttttttggacattcaaattagtgttatttttatatagttcttttaacaaagactgcagaaagaatatgtgaaggcaaattctagaagtcactgcagaatgtaatgttgcatatacctcaagtgttacatatttttctatgttatcaaataatatcaaatgaaaatttaaatttttgctacttatcccaaaacattaattaaatagaattagaaatattaatttcttgaggaattagcaattcattgaatatattttatgccaaagtctaattttattttgaattcagagaagtcaaagaaaggttctattattctaggaccttaatcactgtaactttaatacaagggacccagtttaagtgggctaatatctaatgcaatggaaaataaattgagcatctttttaaagtgtgtattagcactttttggagtacttgctatgtgttacatagagtatcttcttaatctctcagtgactgccctacaggatattggtattattatccctcttttattggtaaagaaaatgcagaaaacacataggtaattactgattgccaggaatggggtttaattaattcattcatctagactttatttaaaagcaatatctgtttggaaatattcacagcccggtcactgagaaatggtaaaacttccacactgtgttactcctgtgttggctatctgctgctagataacacattatccaacgttagcagcttaagtaacacacatttatatgatttcacagtttatggggttaggaatctggccatggtgtagcagggtctgctgcttactgcagggtcatggcctacagtcaagatgtgagatgggctgcaatagtagctgagggcttggccagtaaacgatccgcccctaaacttactcagctggcagggtttagttcctcttgaggtgtttgactgttggccaaagtcttcccttggttgcttctcacacgggcctctcacatgtcacaacatggcagcttgctttatcagagccagcaagtgagaaggtgagagggagtgctagcaccatggaagtcagttttttgtgacctaatcaaggacgtgacagcttatcactttggtcatactctgttttttaacaaacttttatactgcaaaacaataggcctaggttcatacctctcttaccttatagtaggataaattcaaaatgcatcaaagatttaaatgtaaaaaaaaaaggccaggcatgggctgggtgcagtggctcacgcctgtaatcccagcacattgggaggccaaggtgggaggatcacatgagtccaggaggacaacatagtgagaacctgtctctactgaaaacagaaaaaattagccgggttattctgtttgttaaaaggagttaccaggtccacctcatgctccagaaaggcatgaataccatgaggcgaggatcactgggggccatcttagaaggctgcttaccacaactgccaacctggtgtttttatttgaggcgccagaagtagaggtgcagtcatacagaaggcagatcatctctttgaacaagcccccatcccgtagctattacgggttatttttccagaagctcagtgaccaggatacatagtgagaagtaaaaaatataaaatattgttacaggaagggatttggcagaaagagtcagaaatgtgaaagccctaaggaagagaaaggatgtcaagaaacatgaaaaagggaagaatgagggaattgtcagcaagggccattctctacatgcaggtgtagagaaaacaagggggtgattgagaggagtcaacagcctcatggtaataataaaaatcttcatctcagacgggcacagtggctcatatgtgtaatcccgtgctttggaaggctgagacaggaggatcacctgaggcccggagttggagaccagcctaggcaacatagtgagacaaccctgtctctacaaaaaataataaaaaattagctggctgtagtggcatgcacctgtagttgcagctacttgggaggctgaggctggaggattgcttgaactgaggagctggagattgcagtgagctaagaacatgccactacactccagcctgggagacagagcaagaccctgtcccctgtctctttaaagaataaaaaaatgggcctggctcagtggctcacgcctgtaatcccagcactttgggaggctgaggcgggcggatcacaaggtcaggagttcgagaccaccctggccaatatggtgaaacaccatctctactaaaaatacaaaaattagccgggcatggtggcggatgcctgtagtcccagctactcaggaggctgaggcaggagaattgcatgaacccaggagacggaggttgcagtgacctgagattgcaccactgcactccagcctaggtgacagagcgagacgccgtctcaaaaaaaaaaaaaaaaaaaaaaaaaaaaagaataaaaaaaaatcccccaaaaccctaatttcatctggcttgactctctttgaaactctcaggcttctaaggaagcccctcgtttctccaactcctttcttacttccttggaagaatcctctctccctcttccccacctctcttctggcctcacagaggcctagatgacctgagctcactccctctttcctgtttccattacctgagccctccagcctctgtcccgagatttagggcttctcctctcaccttccaacaagaaaaattgtgtggaagaaattagactccaatgtttgagaggaaaaaaaggtgcaaatacgatcctgaagaggcagtcagtctttgatacattctatctaagagggtcagtagtgtactcataggaaacacgttatcaataaacttttacccagagcaaagtgacagtgcacacacattcatactctctccgatggggtttatccgaagtattcaagaccaccctaaggatgataaaacagacagagacaagcatgtctgactccaaacaacacccttaaactggatgatgcaatcattccgggaaaccctcccccagagtgagtggaggttaccaattcctagttaccaatgagtacttcaagtcctgttcttcacaagtcaagggttaaaacagacaaaatagaatagctaaaatagaatagctaaaatatcctaaaacacaaaatggacaagtataaaacccttaccaagaaataatattgataaagtttctcatttggagtgttctgtcccaccaggttggtagtgggagtatattttaaaaattaatccactgaaaggaggaatatgattgactcattgaggagggagatttctagaattaactttcccttgtctgtacctaacccaaaattggaaccctttagttatagtttgcatcttagtaagaatattaagatttcaaaaattattaaatataaactacaatcttaacctcccctccctcaggcttaaaaaaatgtagctacctggttttctgagataattattttttgtctggaggaagaaattgttaagagtccctgtgcacagggctggggttgggagtggggatgaactgtaagtaaaaacaagggatcttactggggtgatggaaatggtctaaaactgtggtgatggctgcacaacttggtaaatttattttttaaaaaatcatagaattgtacatttgaaatgagcaattttatgctatataaattatgtctttataaagttattttaaaaagaggcagtgtgcagatctcttaaagccacatcatgcaccttttagtaaggtattactcttatttccttctaaattctttcttgtactttaacccttttggtatcagatctttttttaaatcttacaacctctaaaaaagctggccccttctttcagtttccctatgtgtttcattattttggttattttatacttaaaaaaatacttaggaactataagtagaaggcaaaataaataaaactcaagttaatttattctgcagagctatatgtaagaaagtgaaaaacgtgctttccttcctccgttcttctctgtcctttcacgtgcctacatgtatttgcttcccggtaagtttttgggacccaggtcttctgagtctagatctgttgttcatgctcatggaccatatcggtagaaatcaagggccttccctgctgcatccagtcatcagacaagccagtttttccagtatctctttaccctttttacccaatgaacttaagtatttggaatggtttacccttgtgtatattacaggtatcagatttaagagattaaaaactctgcttagttttttattttccttatagctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtaagtttcttagatactgcagttgaccagcctgacacttattgtaaggcacatttatatacttcgacatgtcacataccacaaagacctagacaggagaaaatcaggttggtccttgggcttttgcctcttaagtataaaatagtgttcctagacaacaaaatttggactgaagttttcagtaaatgtactgaatgtgctgtggcatgagagttaaatatgtttataaattgcttgctttgctattttagttgattttgtatttttttgggaagaaaactctagcggttagataatgggataaaagatgaaaaagatggttggagtaaaaggaaaaatgatgttcgggaggaaagaggaatgtttagagaaaaatttctagagaataaggcagataaagagttgatagtatgtgcctgtagtcctagttacttgggagctgaggctggaggatcacttgagcccaagaatttgtcgctgcagtgagctgtgattgctccactgtaccccagcctgggcgacagaatgggaccctgcctctaaaaatattaataattggctgggtgtggtggctcatgcctgtaatcccagcactttgggaggtcgaggtgggtggatcacttgaggccaggagtttgagactagcctggccaacatggcaaaatcctgtgtctaaaaaaaaaaaaaagaaaattagctgggtgtggtgtgcatgcttgtgatcccagctactcgggaggctgaggcgctcgaacctgagaagcagaggttgcagtgagccactacactgtagcctgggccacagagtgagactccgtctcaaaaaaaaaaaaaaaagttaataataataatggttgataggatccagagagttctagctagggaaacctgagtctaggtttccttgcctctgaaggatttaatgacaactgatttccgaaggaagtctactgaaatattcaaatggaagcagtcgtaattcacatttatttgtgattttcacagtattttgatatacagtttcatttaattttggctctaaacttatgatgtatgtagaatgggcaatttgttgataattttacagaagatattgtgatatggtccagtagaattcatgttttactgggttattttgtttatgcttttttaaggaaatatagtttacatttttacattcccatagactatccattttgaacttagttcattgtccatgatatttatgtataatgttggttttgatatttttgtatatgtgaaaagtcgatacgactttagagcagctctaagaaatatgcaaagatacttccaccagccttattgatgagctcttgggtttatgatttgaagaatactattgtgtttcctaaacccttatggactttttgataaaataggaatggtgaagcctcaacctcctgccctctcacggtattttttctttctttctttctttttcttgatatgaggatttacttttaaggcggtgacatttacagaagataatttcttaaaaaaggtttttgtttagagactgggtctctctctgttacctagactggagtgcagtggtgcgattgtagctcactgtaaccttgaactcctggactcaagtgatcctcccatctcagcctcctgagtagctgggaccactggtgtgttccaccacacccagttaataattttaaactttttatagagatgagatcttgctttgctgcctaagctggtctggaattacaggcatgagtcaatgtgcccagctaagaacataatgtggttattagcagaaaaaagtattttgccaatgtagaacctaggttttatttttttgactacaaattagaattgttgattaagtataaaaatctgataacagaatattctcttcaaatatgcttcactaggaacaaccctccaatagtaaatgctatgttttcttattttcagtgtcttagaattatataatcgaaggaggtaagaaaagggccttgttattatatatatctcttcccccattagaattcatttacaacatttttggagaaactattttgtcacatcagttttgtcacatttaaattgtatcagattttaaaataatatttgcactatataagtcatcacatcaattgagaatgttttatgttgataaatacgtagataaaaaatacgtggaatgcaacaatgaatgtgcataatttattctttcttaaagtctagttcttttgttcctcaaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcaggtcagttctagtgacacacatgtctgatcttttttaattgttggcagtaagattacctcatcttgttttaacattttaatattaaattaataagatgatggtagttaaggctgtttttatattgtatatccatttatatattttgtgttattcccaagttactttaattccacatagtttgttttcatgaagctgcttattaaacaggaaggctcttatatttatagaaacaaaatggaatgtttactatataatgctagtaagtcattttaatttgaattaacaaatgtatgcatggtacaatgccacgtataaatgtatatagtaaattataagtctcagtatggtttttgtttaatcgttgcaaacaaaaaatacttttattgtgatttctgtggaaaactactcattgattgttttgacatggagtattttccttttttaaatacatgaacagtgaagttcgggaatgtcttaaacttgaccaggatcataaaaggtgttttgcacactataaacaagtaaagaaacttaataagctgattgagtcagctgaagagctcatcagagatggcaggtgagaatatggttgttccaactgtccagccattccttatgtgcggggctgtgggcacaagtgaactacagaactgctcttttacttctcagccattgagggtggggtattctagatagccctgggccttagcaaaactaccagaattggacatttttggaatagggaagaatataaataatagtaactgtgtagtatccttaccagcagaattacttgtactataccaaatatttattatctcctatatcaggctgagctatgtactgagggtgcagacttaaacttgacaatagtttttgttcttaagaagtttatagcattgcgtgggagacaaatatatgaattgattattaaaagacaatatgataccaaagtgatagaatgtacataggataattggagtaccaaagaggagtatttactccaaaccaggatggtaaaggcaaggagtaaaagaggagcttttttttttagagaaggtgatagatatttaaatcctaatcctaaagaataagtaaaagtggacagaagtaagaggctgtgtctgtgtgagtgttgtttgtagggggtttataggctgggcaggaggactgaaaagagtagagggcactgcagacaaaactgcctaatagaaaataggctccaattcctctacttttagtagctttgtaagttgccatcatgagaatgcttcactcggtttcccccaacatcttgcagactataacgccttgcaaaactatagtacattgtcacaatcaggatattgacgtgggtgcagtcaagatacagaataattccatcccaacaaggacacctcatgttgcccttatagccacacctacttccctcttgttcctatcccttccttagcttgtggcaaccactaatctattcacttgtagaattctgtcattttaagaatgttacataaatagaatcatacaatgtataaacttttgggattggctttttttttttttgagacaatctcactatgttgcccacctgttcacagatacagtcatagtacactcaagtgatccttctgcctcagccttctgagtagctgggacttcagatgcatgctaccacagctggcaggatgggcttttttccccctcattcgaattgtctggagatttatccatattgtatcaataattcctccttgtttactgttgagtagtttccatggtatggatttactgcagtttgtttaaccatttatccattgaaggacctgaggttgggagtttgagaccagcctgaccaacacggagaaaccctgtctctactaaaaatacaaaattagccgggcgtggtggcgcatgcctgtaatcccagctactgcggaggctgaggtgggagaatcgcttgaacccgggaagttgaggttgcggtgagccgagattgtgccattacactccagcctgggcaacaagagcgaaactccgtctctaaaaaaaatgttttctgtttgcaagtctgtccttttcaggtcctctggctagacagagcagacttctgcaggtttttgttattgtcgttctgtacctgttggcgtttctgcattgctggaatcttcagctccaagtctgggatatatgaaacaaaaaaaaagaacccagggaacgtcttaccatgttttcctcaggtcctgagtcactagctagtctgtctcttttcctcctttgaaagttttctattttaaaaaatatacatataatctctagggttttttagttgtgcttagctggagcacttgggacaaatacatctattccactttcccagaagctggcttttttgttttcttctttaagttccaggatgtatgtgcagaatgtggaggtttgttacataggtaaacgtgtgccatggtggtttgctgcacctatcaacccattacttaggtattaagccccacatgcattagctatttgtcctgatgctctccctccccttgctgcctgccccacacaggcctccgtgtgtgatgttcccctccctgtgtccatgtgttctcattgttcagctcccacttatgagtgagaatatgcagtgctttgttttctgttcctgcgttagtttgctgaggatgatagagaagctggcttttattttaaatgttttagttaagcctgtgttttaatacattggcatatttacatatgaagattgtagcactttgggaatagtgtgccaccatggcatagaaacatattttttactttactattgttgagggaaataactgagtatataacaggattagtactttttactggtttaaagaaaatgctgaaatagcttttattcttagaaagcttatacagttgggaatttaatcaggtaccttttgtgtgaactacgttgtactttgttgtaaatactgacattaattatataaaatggcacgtaatgggttccattattttcatggaagtgtttactgaccaagaaataaaacttgatctctgtattgttcaaggtgctcagtgtaagtcagacttcaacagggtgttttactcaggtttggaattctgagcaatgtttctgtaaggaaattcttctggtttgattggtacttatactcacaggtatgctttgttctgtccatctgcatctcctatggtcatatgtttttatttcctaactcttaattatggagtgtaccttctatgggactctagattaataagggaaaagccgaatctgaagccatgggctcatccaattggattgattaagcaacacatggtgaagaggggaggagcctttctacagctctggaaatcaaatgtcatcatttcttatcatgatttgctcatttcttagatacacagatgctaccagcaaatatgaatctgtcatgaaaacagagccaagcattgctgaatatacagttcgttcaaaggagaggatttgccactgcttttctaaggtaacagttgacttgttcccagaaatgtgaaaactcaacatgtggaataccaaccataaatccttgtctcacatttccttttaggacgagaagcctgttgaagctattagggtttgttctgaagttttacagatggaacctgacaatgtgaatgccctgaaagatcgagcagaggcctatttgatagaggaaatgtatgatgaaggtaaatctttaaggatttgatttgcagtaccgaagtgttgattaggaaattatcacattttaagcttccttttccttaaaacaaatttaccagagtacctggaaatgttgacaattttagaaaaatggcagagaacttgaaaattactcttccatagtggaacctgaaaggtataccatgtgaggaaagagttctgccattgaaaccagttcagtacaatagaaaaataaatattttagctttttttgtagaaaggaaaaaaaataacaaaatagaaaatttaaattgtagctctcatgttatccggaagtaatcactgttcattttgcatttatcttttccagcttttatctatgcacatatattactctatattttatgcacatatacatattctctctctctctctctctctctctctctatatatatatatatatatactcggtgtgtataaaacataaatacagaaagcatacatacatgtcatatatccctaatataaaatgatcctctgtgaccccaagctgtttagtaacataggacagctgctaccctattttgttcaagccaaatgaaataacaagagattcctgccagatgttgtgaggtccttggataaaagcagtgtcctgtttttggaagataactacggcgtatacagtaatatacagtttttgaaaaatagaatccatatatatatatatatatatatatatatatatatatatacacacacacacatatatatatacatatatatatacacatatatatatatacatatataatacatgtatatatatacatatatatatatagttttgtgccttttttcatgtgacactatgttatgaacatttaaatgatacaggtttttaaaaaaataaatgagccttataagcccttattgcaaatattttgtttcaaattcaggtaaagcattttaaatcaaaaacagtaattttctcttacagttaaatgaagggttcgaatggtaaaatttggtttgtgatactctttttaaggcaaaactggtcaatctctttttccctgctttcctcaattagaaaagaatcttgctcctaagcaagttcccagtttccagggaatgatgacaacctggtcactactatttgtgggacatcttgtgggggattcagaccttgaggtctctgaatgaggcttgaaatgaatgcagtcaaaatgacactttaatatttataagcatgcttcaataaggcatgtagtccacatagaaaatccctttagcatactcgttttctttccttttgagctaccgtgtctactcggtgagatggttttactctaggatttgcattccagttagcttttggaactctttatcaaagatacttttgtcatctgtatgtaaacccttagctctcactgcgaaattagagaagctacagaagaatataaagagcttagctgttaaaaaaaaaaaaaaaggctaaatcttgtagaatgctaagtgtaatttgaaagatgcatttggaacttgaatgttaaactgacttgctttttggggaaacctgatggcttaattctggaagaaaaagatgcttagtgctaatttaatataattgatctgtttttttttttttttttttttggaaatggagtcttggtctgttacccaggctggagtgcagtggcacaatcttggctcactgcaacctccacctcccaattgcaaccaattcttctgcctcagcctcctgagtagctgggattacaggtgtgcaccaccacgcctggctcatttttgtacttctagtagtgatggggtttcaccatgttggccaggctggtcctgaactcctgacctcaggtgatctgcctgccttggcctcccaaagtgctaggatcaattggccctgcccaattgatatgtctttgaagtctgttgtttcctggaaaaaattcttttctataggaatttattaaagagagagagagaatagttgccagctgtctacatttgcaaaagaaagaaagaaaggaaaagagcctgtataactgaaactgataggtattacctgacttgtttggactggaatcagaggtttagtataaatgatgtaaataaataataatcttacttagctaaataacagtatgtcttcagttgaaatcttgagttagaaatatgctttccatattcttctgcttcctggttttacctttcttagataagcaatttaaagtgatggcaggtacataataaagaatgaataggtttaggttagtgaataatggaacatggacatttattaatttggggcttatgatagaattatcaggaaacaggggattccactcaatagaaagcaagtaaagtaagactgttatttgaggatgcctctgagatcttgaaaaatcaagggaaactcttcagatcgctacatgtctctgttttaatagcttttgagaggaaaaaactgacattgaagcagtactaaaatattggcaaagtttctttgaatataggggtaactcaggtgtccttatgaaatgatcagttatatttgctagaacttaagctgtgtgagggcagagacctgtggctgttatattaactgatgcagtcctggtgcttgtgctggcactcatctttgctgaatgaatgaaggtaatttatttattatacaaaagtcatagtggagagtatggaatttagaattagtcctgcctttgagtctggctttgtgcagttattctattttttttttttttgagatggagtcttgctctatagcccaggctggagtgcagtggcatgatctcggttcactgcaacttccgccttccgggtcccggttcaagcaattctcctgcctcagcctcctgagtagctgggattacaggaactgtgccaccatgcctggctaatttttgtgtttttaatagagacagggtttcaccatgttggccaggctggtcttgaactcctgacctcgtgatctgcctgccttggcctcccaaagtgctggtattacaggcatgagccaccacgcctggccagttattccattttttatttttaattgtggtaaaagatacagtataaaatttaccatcttaaccatttttacatgtataatttagtagagttaaatatgctcacattgctgtgaaaaagatcttcagaactttttcatcgtgcaaatctgatctctgtatcccttaaacagccgctcctttttacctctccctcggcccctgggaaccaccattctactttctgtcactatgaatttgactatgctagatcctcacataatgggaatcatatactgtttgtcttattgtgcttggcatgtttcacttagcatagtatcctccaggttcatccatgttgtagcatgtgacaggatttctttttcttttaaggctgaatagtattccattgtatggatatcccacattttgtttattaattcatccactgatgaacgtttgtgttgtttctgccttttggctattggagtagtgtagccatggatatgggtgtgcaaatatctctgagatcccgctttcaattcttttggatatctacctagaagtgggattgcaaaatcattatgctagttcttttttaattttttgaggaacctccacactggtttttgtcatggttacaccattttacaattttaccagcagtgtattaaagattctgattcttccacatcctcgtcaacagttttttgggttttttttttttttttgagacagagtcttgctctgtcgcccaggctgaagtgcagtggtgcaatatgggctcactgcaacctccatctcctgggttcagctgattctcctgcctcagcctccttagtagctgggattgcatgtgtgcaccaccacacctggcttttttttttcttttttttttccgtatttttagtagagatagggtttcaccatgttggccaggctggtcttgaactcctgacctcatgcgatccacccgcctcagcctcccaaagtgatgggattacaggcgtgagctacactgctcagctggtcaacattttagattttctgttttttcaatagtagccatcttaatgggcttgaggtggtacctggttttggttttgatttatatttccctaatgattagtgatgttgagcatcttttcatatgccatttgtatattttctttggagtatgccatttattttttgctatatggtttcaatcaagtcatttaatttactttttactctacttatctgtaaaataggaataagaatagtacttatctcctagaattgtggtggctattaaataagatgatgctcagaaaatgctcagcaacatctaaatccgtggtttccactgtactcattttcaggttgtttggaacttgcattgacttttctgtataaacaatattgtgtgggatatctagctagcttcttggactaacctgtgactgctgcatgaactccatttgacacagctgttattgaagtgttactagtaatatcaataattctgtgaatagggccaagtagattgctttctctggatgaaggctggcctgggcaaaattgtgaaagaggtaaagtttatcttttgattccctagggtgttatcctgtttgcagattcttgtgccctcttgcttatcctgggactccaccctgttatactacctaggcccaccctatcccgcagaagtattctgtgttcaaaatttataccggccaggcacggtggctcatgcctgtaatcccagcactttgggaggccgaggtgggtggatcacctgaggtcaggagttcgagaccagcctggtcaacatggtgaaaccctgtctctactaaaaatgcaaaaattagccaggcatggtggtatgcatctgtaatcccagctactccggaggctgaggcaggagaatcacttgaactcaggaagcagaacttgcagtgagccgagatcacgccattgcattccagcctgggcaacatgagcaaaactcagtctccaaaaaattatctatatctatatctatatctatatctatatctatatctatatctaatctatatctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgctttttttcaaggttgttaaccaggggttcctggcttctgtttatgtggaggacaaggggtagagattggtctttgttggaagatgctgattgtatttaagatcctaactaaatgtgactttataagttggaggctgcttatatattgccattctttatacaacatcataataaccatggacacatgtaatcagaatctataaagcagatgcttctgaaacttccacctcttgaaataagtgcatctaccttagctcagctaattagttggaagcaggtggttagaataaatggctagtcctttgcaaagacagtcagtgggatatggcatgtagattgatgaagttctttggctgtacatttcctgaactgtaaagtcatgcttgcagtttttattcacactcgggcctctcagccacagctgcagacttctcatttcttttgaaaagtgtgtggttacaaggaaaactacatagctacctgctggtttgggattagcacatttgctgaccatatcagctgggtaaaacattgtactccctctggtgccaactctgtgaacccatgagcgtaatatgtaggtgaggaagtaggaaacagttacaatagtcaagcagtattattcagaaaaagatacaaggcagatttccaaattatgaaaagcttaaagtgttggaagtaaaaagtgctaaggaaaaaggatcaagaaggtcactgcaggtgcatagctgggacagacgcttagaaagctgtggaggggtcctttgcctctcccagcagtgacaagacacatttgatttagtgcagagggtaggtttgaatagagaaagacagtcatagatacatgttcattttggctttttgttaattgacaagactgtaatttcctatgactaatgagtgtgatctcaagtaatgaagaggcttctttaagaaaggaaaaaaaaaaacaagatttttcatcatcttaaatagaaacagactaagtatatgaacgaaggcctatatttgtatctgcctactctagtgctttgaatagagttggtgatatttcttaagtgttgataaagtacagcacaatatttaaaatctcataattcaacagaactgcaattattttctttgtattttactgttagcacttttatctcttttcccctataaaaatgttaacagtgcctcatatgtaatagatgctaaaaataaagtcaacaaaacagatgtatagagcatgttagcgtatcagattcagttagtgtgcaggacaaattacgtcccctgtatatagaattaaacatactatctctcttcattgtttaaatcggcctaaaatataatggctagacttgccctcagatttgatgttagaatgtgatctagtgtaggaagtagttacctcagtgggagaagctgactttaaattgttcagccctctttactgagctcacagctctcgtacacttctgggctcataacgaggctgtatcctaagtgttcttagatataagatctttccctttgttgtcttaaggatgaatatgcataaaacgtagtagtaggaaattttttattttcattgtttatattatgacagtctcacagcaggtaaaccctccccccaacattttattatgagaaatttcaaataaagagaaaagttgaaagaatttcacaatgaacacccaagtcctcaccatacagatactgaagttaacagtttactatgccttatcacatttatctgtctctagccctccatttatccatcagttcatctttttatgatgcatttaaaaaaaggtatttggtttacttttcccccagatacttcaacttgtatatcattaacttgaatttgtttactgtcttacattttttctttctttagggataattttagatacggtaaaatgcacaagtcttagggataccattcctaaggtctgatacccatgcgacatgttaaagcaagaaatcattaatgactcttgttaaagacagtaagtcagactttattcaagggggactatggtgacaggtagaggggccactgcagtggggtcttgtactggggagagagattgggtttgactctgactccagcaaggacaaatggggatttataaccaaggagcagagttgggggtcagtgggtgggattcttgctagttaaggtcaacagactatgtgttgaaggcaggccagggtcatatggagagtggagggtgaggagtgtgacagatattggtggggaggggtttccctaaactgatttagcaggattcttgctcaagctggattccacaggaacagagagggaagcctagggtctggatctagtcagaaagaagactcagaggagctgaccaaatttctggtcaaaggagacaatctttgtttaacccaactcctgtcaagatatagaacattttattatcctcttgtctcttaccaatcagttcccatcccacccccccacaggcaactctgttctgattttctccatcatggattagcttggccaattctagatcttcatataaatacagccatgtatagtatgttctctcttgtataaagcttcattccttcagcatgtttttgagatttatttatgttattacatgttttcgcagtttattcctttttattgatgaagagaagttggcagacttttcctataaagagccaaatagtaaatagagaccctgcgcaccatgtggtctctgttgcaactactcagctctgccattgcagtgcaaatgtgaccatagataatacgcaaatgaataggcatggctgtgttccaataaaactttattttgaaaaacaggtggtgggctggtagcactgttatcacttttccactataaaaaagcagaaaagcattcagtgtttcgccaataatcctatccttgatgaaggatatttcatttcatgcatatatcacactttatctactgtcatattaccagacacttcagctgacttttttagttattaaaaagagctgctatgaacattattctaacgggcttttttttagacatatgtttttgtttatctgcaagcagaattgctgtcatagtgtacggtgcttgctcagttttaaaagaaactgccagactctttctaaggtaatatataatttatacagctacaataaagtatgagagttctagttgctctgcatccttgcaaacattttgtgttctcattctttttagttttatccattttggtgtgtgttagtatctattgtggttttaatgtttgtttccttgatgactaaggttgttgaatacttttcatgtgttgtttctgtgtttaaatatcttactttgtgaagtaagcattctgcacatgcttacccacttaaaaatatttgctgtttctttttgttacagagttgaacttatttatatatttatgttttcccctttattccattaatgtggtaaattaaactgacatttctaaagttaaatcaacctttaattattgggataaactcttcttggacaggaatttagatattgctggatttgatttgctaacattttaagaagtgtgcacctatgttcatgagggataattgctctgtaactttttttggtaatgtctttgtcagagttcagtgttaaggatgtactggactcaaacagttcaaaattgtccctcctctattttctgaaagagtcatataagattggtgtcatctcttctttaaagtttgagagaattcaccagtaaaaccatcttggtcttggaagttggtttttgatttttttttttttttttggtaggatggtttttgacaaatttagttttttttttttttttcattttgtttttgctttttttgagacaaggtcttgctgtgtcacccaggctggaatgtagtggcacaattatgactcactgcagcctcgacctcccaggctaagtgatcctcctacctcagcctcccaagtagctgggactacaggtgcatgccaccacacctggctagtttttgtattttttgtagagatgatgttttgccatgctgcccaggctagtctcaaactcctgggatcaagtgatctgcccacctaggcctcccaaagtgctgggactacaggcgttaagtcactgcacctggccttatttagttttattcagtataaggctattaatattttctgtttcatctgtgttagtttttgtaagttacatcttttaaggaatgtttctatttcttgacattgctgaatttgttggcatgaagttcataatattatcttattatttaatgtctataaggtctgtaagattattcctgctttgtttctaatattaataatttgtattttctttttttcctgttgatcattgtagacaaagtttggtcaattttgttggtcttttttttttttttttttttttttgagacagaatcttgctctgtcgccaggctggagtacagtggagcgatcttagctcactgcaacctctacctcctgggttcaagtgattccactgcctcagcctcctgagtagctgggactacaggtgtgcaccaccacacccagctaatattttgtattttagtagagacggggtttcaccatgttggccaggatggtctcgatctcctgacctcgtgatccacccgccttggcctcccaaagtgctgggattacaggcgtgagccacggtgcctggccttgttggtctttttaaggaaccaacttcgggatttgttaatggtttctatggcttttctttattactttattgatttctgctctttagttccttagacttactttggttgtaccttgtgcttttgctagaacagtcattgattttaggcctttctttctttttaaatataagcatttaaagttgcacctttcacattttgttttactttcattataacttggcttgaagtgtattctaatttcccttctgacttctttgatgcatggattatgtataggtgttctaattttcaaatagttgatggtttcttaggtactttattatttattttgaatttaattccattgtggtcagagaacatactaggtgtgatttccttccttttaaatttatttaggcttgttttgtggtccagcatggtatctaccttgatgaatattctatgtacacttgaaaataaggtgtattctgcaattgttgggtgtaatatttgttagtttttccatcaggtataaggtgagagttgttaagatctttgataatctgttgtggaaattgtgaactttcctgtctgtctttaatattgtcaatatttccttcaagcatttggaagctctgctattagcagcctacatatttatgactgtcaagtgttctcctgatgaatttttacttttattcttactcagtgttcctgttgatcactggcaatactctttttcttgaagttttatatgatattaatagaatcacctctgccttcttgatcttattgtttgcatggtgtgtctgtcttcattcatttactttgagtgtctttgtgcctttataagtatgtctcttatagacatcatgtagttggaacttgctttgtttctgtcaatttttataattataatctgtgtttgaagtgtttacttgatcaatattactgtgattattgatatggttgtatgtaggtctgccattttactattgttttctttttgtccttttgtttttgaattttttgttcctctctttctgttgtcatttagattatttgaatatttctagtatcccctctggggtgcagtggttattcacaggtgtgattatattgcattgtagtcttaaacccctggcctcaagcagtcctcctgcctcagcctcccaagtagctgggactgtaggtgcatgtcctgcacttgactgtaacgacgttttaaataaatttctaatattagtttaatagtttctaattattagttaccactataattgaaattaaaatatgtcttcctctagctcttgatttatcaattttaggcagtatcccttgtctgcctgctacagaagaggaagaactgagtagacctcactagttccttttgttctttctcaccttcagttttagttgagtatttgatcttttgcttatatttacagctttaatgtaatataaataagttttaatatacccaagtttctttcttaccctgtcacctttagatagcatctcgattgtatactactgataataaggaaattagtatatttccatcttacctttcagctacattttaagtatgtgttagtatacttttataatgtttgtagtatgtagattatttcctgtaactataattgtgtatagtaaggaaatgaaagccatttagtagattaatgtattgtatagctgcaggatcaagtcatgtgtttgaatccttagagaaggagatgcaatcatttcaccaaccagggtcagatacatggagtctcttgttcacagatggccacacttttagtatgcttctcatttggagcaggattttttggaaagcgtcaccccgagttagagttactgtctctctgccagaagaaacctatgcctctgtcttactaagaacatcttgagatttttaatgacagtttgtatgaatgagatccgctctctgtgaagatactctttttatatatatatatatactttttttttcttttcactctgaagatattctttagccctataactcctggctgtgcctggcctgctgcacatcttttgccccagaactcctttcactgcctttctgggtttttctgtcttctttttaaaaatttaatataatgtcttcatctttcttggattctttttttattttgcttaaagtgcatcctcaaaaagtgatatgaatgcgtctgatgctggaagggagtattgcagcttctcagaaattcagaggaaaaatgaattttaacacagacttttatgtatagtaaactattaattagggtaaggattcagtgcaattgtttagaagttttcttttttcagtgttctggagacactggaatcacctgtggtgtaaaagtttggaacaatctctggaaagactgctgctttactgggaggtggcttagtgacagctttctctgtgaaaatgttttgtgtgggctttcctttttgagccaatgaaattcttttaaataggttagtttagcacatttgcattgatcgatatgacagatgtttggtcaacattctatcattctgttttgctgaaatctttttgcgatttggcctgtattttgtatacgctcctgatatttaggaaagtttgtatttttgtacttttaaaaatagttttattaacactattttggcaacatccattagtttcctactgtgagggaaaatttagtgtacttcctcctcttcctcactgttcttccacctcttaataatttgttgaggaaattttttaggatttgcctttgtaatattactcaatttatcagtggctgatgttttctgattgcttcagctgatgtaggtgggaatgaatgaacttactccctcatcatccttcccctttcttttcccatgtttcgtcagctgtatcccttctgcaccatcagggcacacgctctgctctgtcgctgttagtcccctgctttgtgttagtcttggttctacgtgaaattcagtgtctactggttttcctttggccatggtttcttcagccatcacttggtgagttcatcttatagtagtttcctcagggaggtcctaagagaattttccctgctttcttctatgttcaatacagattgtacttgtaccttttatatctgaatgatagcgtggctggataataaagtccttccctcacccctgtgccatgtatctcgtagttattgttctgttcttttctgggactaatgttatggaaaacctggggccaggttttttgtttttggcctggccgtccaaagagcccttatcttcaagtctgaattatgctaggatatgtcttcttgttgcccattctcagccaggctgccctggcacccagtgcaccttttcagtctagatccatctttcacttcaggaacattttcttaatctgttttggtctcttctatttgtttctttttcagcttagttttctgcatacaggttatacatgaattgtatttcctttgccttgtcatcattagctataattttttctcagccttttaaaaaagtattttatataatttagttaagtcaaaattcacaagagacaaagtaggacattaaattataataaaaaggttcattcattgagaatctatgaatatatctgacatcagttttcccaaacacataaagcaaatattgacagaattgaagcaaaaaatagacagcaatataataatggtaggatacttcagtatcccactttcagtaatgaataataaagcaagatagaatattaagaagggaacaaaaaacttgaatgcactataaaacaattacacctaacaaatgtattcagacagcagagtacacattcttttcaatagctcatgaaacattttcctagatagaccacgtgtgacaccacaagtcttaacaaatttttttaaattgaaattttatagactatgatttatggcccaaatggaataaaactagaagtcagtaacagaaggaaaattgaaaaattcacaaaatatgaaaattaaacatgctcttgagcatgcttttgctcaagggttggaagacataatattgtgaagatggccatgctgcccagagtgagccacacatgcagcacacctttcaattcccaattttacttttctgaaaatagaaaaaaacccacaaaattacatgaaacctcaagggaccatgaaaagtctgacaatcttaaaagatgaaaaatattggagacattacacttaataatgtccaaacaccaaacaaagctacggtaaccaaagccctttggtactggtataaaggctgaacaccaaagcagtgaagcagaatgcagcacagacagcaactctggcaacatgctcaggtgagttatttgcacgccatttattgaagcattatccacaaaagccaataggcgaaagcaatttaaacttcccttaccaaatgaatggatacatataaattggaatacaaaaaaaatggaatattactcagcttttaaaaagcaggaggttttctaatatctaccataagacaaattttgaagacattttgctaaatttaataacccagccacacacagaaaaatactgtatgaatctacttacatggaatatctaaagtagttaacacccttaaaaagagaaaatagaatgatgtttgtacagtaaaaacattgaattgaaaaacaccaaaatgtgtgccctttatgaatgtgcagtcatagttgagaattgtagctatttagaattattttttagtaatacactgtgtttattcagtatttttttgtgaaattttgttctgccaatttatattcctgtgtcatgttttatggtaggttatgtcacattgtgtttttagtttttatttatgtattataattttgtatgccaatatttgactctgtaaacattaagacagtgtttggacagaagtcagatatgaatcagccatacatctagagccaatataattatttctgtgtttgtttgcctgtataaatattacccctattttatgatttgtatatttcctttttttggttgttttatttttaattgtaaaaaatacataacggaatttataatctttgatattttcttctttctttttttttttttttttttttttgagacggagtctcactctgtcgcccaggctggagtgcagtggcatgatttcagctcaatgcaagctccgcctcccgggttcacccattctcctgcctcagcctcctgagtagctgggactacaggcgcccgccaccatacccggctaattttttctattttttagtagagacggggtttcaccgtgttagccaggatggtctcgatctcctgacctcgtgatctgcccactgcggcctcccaaagtgctgggattacaggcatgagccatcgcgcccggcctaatattttcaattatatagttaagaatattgacattgttagcaacatagctctagaacatttttatttttgtgaaagtaatatgcaatacacatgaatctcaggcttttaaaactctctatttccatttccttttgttagatccttcatttttatcttctcccttgtcctctttcttgttttgtcttcatgtctatgatagttttgatttgttcttatttttcttgagtcctgattgctcacatttttacctcctcgtcatctggtctctttcctgagttctgattctgccttgtgattactcttaatggaagtgattggattaagttacataatttgtctatgatgcttgcccagaatttcctctggttttgtttttctgatggctattcagaaaatagtatgctttggctatgtttttctgatgaacattcattagataagttttacatgttcttttcctgatttttaaaatatctttgaagtgatattgtgccagttaaaaaaaaattattactcatcataaaatgagttggagttcactgccctagctatttgtggggctagtcctctggatgtcagttttgtttttttgttttctgcatgtaaggcgtgctggggccagggcagccttctgtagttaacagtcgcagtactctctgcttcactgtttccacagacattctgcttcccgctaaaatgattttgctgtatagccctgccctctctacttctctgcaccaaaccatggccaggaggtcatctgccaccagccccacttgcccctgtaccccattcctttgctacaccaaaggggtgtgtgttttgcacttcaggatgagcatagagttgctgttctctgggatctgccgcacaggctgtttcactgttccctctcactgtattctcttctttacctctgtcttgccccagtaagccctctgctttatctccactatgtgtgctctagatttcctggttcctgcaatatgcaagggatacaggttgtcacttcagggtaagcgcatactcatagaaggtgtattttgtcagcattttctgtgatcttttaccatttggctttctcactatttgcttcccccttcgtcttaggttcatggctgatattagcacctgtcagcagcccttgtacagtttctttgtattgttttgctgaaaatggaatttggagctgcaccctgtctgtttaccttgtttcttttgtgtgatatgtttcttttgtgtgataggcagcaggagaatgttggtgttccatgggacatgtttatattggaggtctgatatactatattctttcaaaggatttctttgcattgagagtagacttttaggggaatagggtggaagctgggaacacctgttaggaaactgttttaatgattcaggtgaatggtggcccgcgtcacagtgctaactatggaaatgctgagaagtggttaaactgtggctatattgtgaaggaaagctgatttggaacttgctaatgaattggtagggtgagagagggagtcgcttgtagctgtgtgcacctgtctttcaaatgctggtctgtgctggggagctcagggcaggctgtaagtaaataggacctgttcactggagaacgtccccagtggcacttgcccagctgccccagtgagccctgcttcactcattttactgatcgggggtcagtaaaatgatctatttaactttggtctgggtgggaccgctttttgtttgttccaggtttgttgtagaggtttgcgtgtcctacaggggccctccacaggcacacctttcactctgcttatagtagggattaatgctgcagccagtggctccatatacaggggccagagcctgcccagccatcccatagtcatctcacggactatcctgacagttgccttatagctacttcagcttgccaaagtgagggtcctcggccaaagataatggcttccagatctgctagggcctcttatagtgtgtgcttgcattgtggttctctctacttaggtttattactaatgtgctcctgcttcctatcttccagaaatttatcaaagttgctggtctgctgttgtcttcagtgctactatgattatattacttttcgtcacttcggtggcaaggagggtaggcaaacgtgtgtgcttacgtctcccatcctaagctggtgatttgcattgctcctcaagaatgtgaagggaatatagaagaaaagtaatttgggataagattttttagattcagaagttagaaaatgaattggctaatacgcaacatggtattctttatctagggctgatatatgtctggcttattctatttttcatagctgttcagtaatggtgggataaacattggatgtgtgtgtgtgtttttttttttttactttaagttctgggatacatgtgcagaatgtacaggtttgttacataggtatacacatgctatggtgatttgctgcacccatcaacccatcatctacattaggtatttctcctaatgctatccctcccccagccccctacctccccacgggccctggtgtgtgatgttcccctccctgtgtccacatgttcccattgttcagttcccacttatgagtgagaacatgcagtgtttggttttctgttcctgtgttagtttgctgagaacaatggtttccagcttcatccatgttcctgtgaaggacttgaactcaccttttttatggctgcatagtattccatggtgtatatgtggcacattttctttatccagtctatcattgatagacatttgggttggttccaagtctttgctattgtgaacagtgctgcaataaacatacctgtgcatgtgtctttatagtagaatgatttataatcctttgggtatgtacccagtaatgggattgctgggtcaaatggtatttctggttgtagatccttgaggaatcaccacactgtcttctacaatggttgaactaatttactctcccaccaacagtgtaaaagccttcctatttctctacatcctctccagcatctgttgtttcctgactgtttaatgatcgccattctaactggtgtcagatagtacctcattgtggttttgatttgcatttctctaatgaccagtgatgatgagctttttttcatatgtctgttggctgcatacatgtcttcttttgagaagtgtctgttcatatccttcgcccactttttgatagggttgttttcttgtaaatttgtttaagttccctgtggattctggatgttagccctttgtcagatggatagatcgcaaaaattttctcccattcatggcaacaaaattctcccgtgtaggttgcctgttcactctgatgatagtttcttttgctgtggagaagctctttagtttaattagatcccatttgtcaattttggcgtttgttgccattgcttttgatgtttcatgaagtctttgcccatgcctgtgtcctgaatggtattgcctaggttttcttctagggtttttatggttttatgtcttacgtttaagtctttagtccacctcgagttaatttttgtataaggtgtaaggaaggggtccagtttcagttttccacatatggctagccagttttccaacaccatttattaaatagggaatcctttccccattgcttgttttttgtctattgggtgttttgttttgttttgtttttttagatgctctcttagagtgtggagtctgagaaagtataacttaaaatggtctgtctagttatatctgtgggaagtcttacatcatccatacttaggtttctaattagttttctgcaattgtgtgaatataggaaacaacctataattttacatttttgtcttatgttgggaaaaatgtgttcaccttaaattttaatacaaatacgatacaaaagactgctttggggagataactctgaaatgtaagaatgaaaacatgttttaaatatagagtctgcacaagtagcaaaatcatgtatattgaaacatcttcctattgtattccttcaaggtctgtttccttactaagctatgtgttgtgttatgggtgttcattgtaaagttaaaccttactactgtttatgatggttttgtttttatactaaactgggagaagttttttatgtccctgtgggttgggctatagtaacatttaatgtaatgatgcactgatgcgagaattcactttaggataaaagattgaagggtccccttccccagtgccacagggccaaaggtggtggtggttcgtttctgtacgtagtgtgtagcctgtcaaaatctgttagtcttgttgtaggactctttccttagttcagctaaagacagggggtccttgtcacacggccacgaaaaatgaggctcacagacaatttgaagagggcaggacttattgggtgaaaaggaaaagagggaaacaggactctctacaaggccagagtcccagctagtgtgcttcccaccttgcagattgaatcccaggttccatccaggaagaggagggaggggccaggcttcttcccgaggctccaccccagtgcacactcctcccagcgtgcaggccagttggagtttttctgggaacccctttgcatttggctgtctcagtcttaggccaatatctttctcattttaatctgtccaaggtgccttacattccctccatgtttagctgttgcgaagatgagtgttcacatgtcttttatcctagtgaaatgcattttcataaaaacaagaattttatcccagcaatctattattggaattatctatgcagggagaatattgagaaaaatttgagtgggggcttccctagactatccccagatttggtgatctggtaagaagacacacaggactcagcatatagttgtactcagggctttcattccagtgaaaaagcaaagtcagcacagggaaaaggtgcaagggtgaaaatctggaggaaaccaggcagaagattccaggacttctctccctgtgacgtcataaagaacaagcttaatttttccagtaatgagaaattctacaatgtgtgaaatgttgtctaccagggaagctcgttatagacactgcacccagagtttttttggggaactagtcactagacacgttctgtctggcctgcaccaaaatcccagactcccagaaggaaagatgtttaccataaactgtatttttcatacaaacagttcaggcatgagtcattcttaccatggaatgttgggaacactcctgaaatctggcttcccaaacgtcagcagtaagccaaccttgtcagcaaacttttctaaggatagttgtctcaggactgctgtgttgactctcttctgcatattagatacccagatgccttgtattttctaagtatttaaaatactgctgggcgtggtggtgcgtgcctgtagtcccagctacttcatgggcctgaggcaggaggatggcttgtgcctgggaggtcgaggatgcagtcagccaaagtgacagagaccctgtctcttaaaatttttaaaaaaaaatactgtgtaataaaataaaagatgtaatgtggatagtcagcagacttcctatactgggactatatgtattttgtattttgattgacacttaggtttgtaatagtgttaaagcctgtgggttactgagtcattcggattgtggacagttccttctgttccctttctttctacaaattttttttttctagcttcccattggccaaacccacctcctgatccctttctaaatgtctaattcttctggactgttgtcaatccatagctgaccaggccgattttctttatcactgtctttctttcctgtgtaacaaccacttagtcttaatggtggtaagattgctctggataaagtgctgatattaacatatttacccagagggtatggggagataatgcgggagggtgggcaagtaaacagcagtacattttgttgaatgagaataataaactacctaaactcagttttcattattatgccttttaaaccttttttttttttttttttttttttgagacggaatctcactctgtcacccaggctggagtgcagtggtgcgatgtcggccactgcaaacctccgcctcccaagttcaagcggttttcctgcctcagcctcccgagtagctgggactacaggcgtgcaccaccatgcccggctaatttttgtgtttttttttttagtagagacggggtttcattgtgttggccaggctggttttgaactcctgaccctcatgatccgcccacctcgacctcccaaagtgatgggatcacaggcatgagcccctgtgcccggcctcttaaatattcttgatcaaagttactaacggggtatcacttaaggtttttggcaataatggccaaagagtgaaggggttgggggatgacgactttagcatcaattttacaggataagaaaaggcaataaattataatttgccttaacaatattatcttaaacatattttgacagctattcaggattatgaaactgctcaggaacacaatgaaaatgatcagcagattcgagaaggtctagagaaagcacaaagattattgaaacagtcgcagaaacgagattattataaaatcttgggagtaaaaaggtgaattattaatttaaaatttactttgctatttttaatcaactctgtttcaaagctaatcattgctctttttcctctctgattcattttctttacttatgtaatttcagtcatatggattaaaccttaacagtctttaacattagaaagctactttgagtattttataggcaagtttctttgatagagaccaataatgcaacaacagaattagtagttggcaacaaagatgacactgtagcatgaatgggtcctaagcctagattttttaagaagggtaaaggggtaggagtgagattccttttggtggggatggaggaggagacggaatgagtaaagaaaaagccttctctaggcctaaaaataaagtagtgctttcagaattaagtctgaaattaagatctaccttatataaaagtacatactaagtaaatgatacacctcccagtgcctgtgggtgaattctgaaattaagtaaatgatatacctcccagtggttcgctgagtaaaccatcaatttttcaaaatttggaatctttgtgcttactattaagtaagctaatgcagaagcataattgaaagtggcattcagagtcaaatattttttaataccaagaattgaattatggtaacttggaaattcagaaagttaaaaaattcattgatgtaccttttttaaaaaagggaaagttctaaagatcaggagtgctttattctcagtaatcttagtgagcgagtatccaaggaagcctgatgtcagctttaatgatcatccagaactgtgtatgcagatctttggcctgtgataccattggaactattttataaaaccagttttgttaattgccagtaggatcttaatcagctcttctgatttttatgatagtatgttagacacttttccactaatgattatttattttaccacccctcagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccaggtattattagcttttattcctttgactcatcctagaggtggtgttagaagcgagggtggaacatgtggtgggttctccacgtggggctgtataggcagtgacgggtcctgagcccagttccagaggtccagttttatgcctgccctcattcagccctcttatgttgggcaccctcctgttgcagggtacagtggaaagactatcaaatgtggaatcagagggcctgaatttgaatcttttttctactcaaagaagttatcagaactttttggtctcagttttttcaacactgagcataagaggatctctcaggttccctctaacctcaaaggtcaatgatgaattttctccaccaagcttacaggagcttgatgaggaaaccagcttgccaggctggattacatggagtgggagaagaacagctgtctggcctagggcctgctttgccccatatgtgttcaccaggaatcttgccctgaatcataggatcattagattcacaggcttatatgtgttttttttttttttaatttttattttttgtagaaatgggatctcactgtgttgcccaggctggtctttaactcctgggctaaagtgatcttcccaaagttctgagattacaggtgtgagcctctgcacctggccacatgtgttcttttgccatacagtaatatggcctggaaatttcgttaagagggagacaggctaagcattgaggtaatactgaacaatgctttgctgctgccagagaatttcatgttaagcttatactgcttttttgtggccttccatgtcagtgggaacagcagctgtgatctgagctaaacaaacaaaagagaggaaagttttatgtttgtcaaatcttttttgagtacttacttatgcagtggaattgaaagtaaatgatcctttgttttcaagtaatttataatccagtaaaggagacagaaatgtacttgcagtggaattgaaagtaaatgatccttcgttttcaagtaatttataatccagtaaaggagacagaaatgtacttcccttatcaagtagtgttggatacatactgtcctgttacttagcaaatactgagtggctacaacctgccttaagcagttcaatcctcttagtttgtgcagtgcacaggtgtgatagtgtatcagactgggagtcaggatcttcttatgtgagagggactttgtgctacgttttaaggtaccagggagccaaccaaggggatgggtgtccctgcacagaggcatgcactgaggaaagagctgcaggtcctttttcttacctcctgttcttctgttcaggatgaactatcttttcttttaaagactttaaagttttttactatgcatatatcaagacgtgtcatatttaggaatatgtttagtagaatcacatgatgtatgccaatctgaaacttaattttcacttgaaataaatcttggctatagttttttctcattgaaaaatggttacctcattctttgagatgtatgcagaccactccactgaatttttaagtaattacataatgtgaatatagctgaattcacttccccttccattcacagcatcctttctctggggccattatcacccccacccctacggagagttcactactgttctaagtgctaacaccctagattaattttgcctgtgagatatcaaagatatggggcctgagtctaactgcattagcttttataaaacaaagctgagtttcagatcacctacaatacccgcttagttattaacactcagcataagaaccctcagttttactggtgggtttcctcctcctaaatatgtggcttcagattaacctcccagaatgaagtaaactggcttttctctaagtatctttgaacccctaaaggacaagttactgtgagagagcaaagcgagacttgggattatttttatatttgcatttttttctgcattctctattttccatttattaaaaaacctagctatatgctaagtctttttattttttttttgtaagttcaggggtacatgtgcaggtttgttacataggtaaatgtgtgttatgggggtttgttgtacagattatttcatcacccaggtattaagtctagaacccattagttattattcctgatcctctccctcctcccacccttcaccctccaataggccccagtgtgtgttgttcccctttatgcatccatgagttctcatcatttagctcccacttgtgagaatatgtggtatttggttttctgttcctgcattagtttgctaaggatagtggcctccagctccatccatgcccctgcaagaggacatgatctcattcttttttatggctgcatagtattccatggtgtagatgtaccacattttctttatccagtctatcattgatgggcatttaggttgattccatgtcttttctattgtgaatagagctgcaataaactgatatgtgcatgtgtctttataatggaacaatttatattcttttgggtgtatacccagtaatgagattgctgagttgaatggtatttctttctttaaggaattgccacactgtcttccacaatggctgaatgaatttacactgccaccaatagtgtataagcgttcctttttcaccacaaccttggcagcatctattttttttactttttaataatagccattttttatttgcaataatgatctaattatttgctctagtgatcagtgatgttgagctttttttcatatgattgttggccgcatatatgtcttcttttgagaagtgtctgttcatgtcctttgcccactttttaatggggttgttttcttgtacatttaagttctttgtagacctttgtcagttgcatagtttgcaaaaattttctcccattctgtaggttgtctgtttactctgttgatagtttcttttgctgtgtagaagctctttagtttaattagatctcatttgtcaatttttgcttttgttgcaatttcatgatggaaacaccaaaagcaatctttgctcatacctatgtcctgaatagtatttgcctaggttgtcttccagggtttttctaatgactctgaggacatgagctctttcttcctatccctgcaatattcctctttattgccttctcccatgtctctgcattgatctctctctgttcggggctcagaggccccgctgtgggggcaccaattgcatgggagggaaaggtgaacctcctggagttgtatgttatggaggccccgctcccctcatgtctgaggagccttagtgctagaatgctcattagatgcttgatgaggtcattgccttacagactttattttggggattagggtggtgagctggctgtttcattagaattgtagactcttggaagtttctcttgaattatttttttccaaataatttcattgggtagttatcaagcttgggtggcttcttctggagtgagatttaggggcctgaatctcaataaatacctattatcaaccctgaacctcaccctccttgtggcaaatttctctagtctgtttcttcagggtgggaatgggagagcctggatttgaatgtcaggcacaactcttgataaccgaaaagtaagtagctcctcaagcccacccaccctcctctgcccaaagaaaacattccccctgcccctataccttagatattatctggttcttaattttctgatttctttctagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctccc

SEQ ID NO: 15526 - DNA, 37215 bp, Human
  misc_feature (1)...(37215): n = A,T,C or G
gggaggccgaggtgggcggatctcaaggtcaggagatcgagaccagcctggctaacacggtgaaaccccatctctactaaaaatacaaaaagttagccgggcgtggtggcgggtgcctgcagtcccagcaactcgggaggctgaggcaggagaatggcgtgaacccgggaggcggagcttgcagtgagccgagatcacgcccaggcactccagcctgggtgacagagcgagactccatctcaaaaaaaaaaaaaaaagaaaaaagaaaaaaactgaggcttagagagcattgcagtaacttactcaaggtcatacaattagtgatggagtcagaatacaatccaggccaggtgcagtggctcattcctgtaatcccagcactttgggaggccatggcgggaggactacttaagtccaggggttcgagactagcctgggcaatacaatgagaccctgtccccacacacaccgaaaaaataaaaaatcagccaggtggctgggtgcagtggctcacgcctgtaatcccagcactttgggaggctgaggcaggcagatcgtgaggttaggagattgagatcatcctgaccaacatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggtgagggactgacgggacggcgggccctgggcggggtgagggccgcggaactcccagcctggctggctggtcctcgagagcggaccctcgggggtcgtgggcagagggctgggtgaccgtggcaggggcccgccggctgctcgggctcgctctcacccggggagcaggagtgtgggggaggaggagccgcggaccgaggccccggggtgtgcctggggagggcagccgcggggaaggggaactgcttcggccccagggtggggctggctcccgggccaggcgcaagggtagggcagggcaaggcaacgtggggacaaagagctgagggagatgttggcactgcgggggcatcacttggcagcggcgcccagaatgaatccgataatcctacaagtggcttttaggctggaaacgtttcctgccgtgttggagagccgggtttggccgtgctcccctggtggcctttggtaggaagtcaccacatactggccgggagggatggagacaccctcaggaaaccggtcaattttttcctttcttgggcatttttccaaaatctttgtaccgttctcttcccccgtggaggacgaaggtggtgaactaagtgctagaagaaatagtggtagcagaaagccttcagtgaccagcccaacccagtttaaggcgatgcctggctatgtgcaagagatctaagcgtccagaagactgtccgccgttagagagttctggttttcaaagtgtttagtggaggaaagacattttattccacaaaataaaccagaagtgaggcaatggaaacagacccttccctgtaagtgactggaacttcattttccttggacttaaacattgtcggtgtgtacttcagggcgtcaccttgctcagtaagatggggctgcgggctgagtcttcctggatattgggaacagactctacgccaagaacataaattacctgcgctgggttttccttgccagggagggatccctgagattgactgtcttaccgatgccgttggagttgatttgggactgttttaagggaatacatagatgcccttagtactggagatttgtgaggtacaaagtaattctggggttctcattgtatgtgtacctgtgtaacagcatcaggagtcctcgtgccttcacgctgttgccaagtcgaagcagtttcttcttggccagctgagaatgggttcagactagtctcatatgaatcaggaagctcttgagccgtcctttgtagacttgcccttgtagaatagttctaatttagatttactcgctccggccagaaatagagaattggataggcagtctctttgttaacacacaccaatttttattttactcttttctaagacggagtcttgctctgtcacccacgctggagcacagtggcgcaatctcggctcacagcgattctcctgtctcagtctcccaagtagctgggattacaggcacccgccaccataaccagctaatgttgtatttttcgtagagacgaagtttcaccaggttggccaggctggtctcgaactcctgacctcaggtgatccaccagcctcggcctcccaaagtgctgggattacaggcaagagccaccgcgcctggccaacacataccaattttttaaaaatttttcttatttatttcttacttatttatttattttgagacggagtctctctgtcgcccaggctggagtgcagtggcgcgatcttggctcactgcaacctttgccttttgggttcaagtgattctgcctcagcctcctgagtagctgggattgctggtgtgcatcaccaccacgcccagctaattttttgtatttttagtagagatggggttttaccaggttggccagattggtcttgaactcctgatctcaggtgatccactcgcctttgcctcccaaaatgctgggattacaggcgtgggccaccgcacccagctttgtttgtttgaggcggagtttcgcttttgttgcccaggctggagtgcgatggtgcaatctcagctcactgcaatctctacctccccgggttcaaaggattctcctgtctcagcctccctagtagctgggattacaggcacactccactacgcctggctagtttttgtatttttagtagggttggggtttcgccaagttgaccaggctggtctcgaactcctgacctcaggtgatctgcccacctcagactcccaaagtgttgggattacaggcgtgagccaccacacccagtctaacacaaccattttttaaaaatgagtatggggtctataagctcacaaattatcctagatctttctcattgtggcctgtttaatagtattatgagatgggaatattgatgtacctgtgttggccctgaaccagatatattctactttgatgccacctgcatagtatctggggttttgcattatatgtcgtcacatgatggcaaactgtcattgaaactcacttttcagccttttgtttgtgtttgttggttgccaaagttgaaaatggcagcaggcaggtttgttagtttgatattttttcatatcttagcataacgattttatgtctcaacacttaccgtgataatcgagcaccaccttttcaaaacagataagaactcagttccttggctgaggaaagacggtgaagattgccaaagtttatggatggggtgtggaaaattcacgagtattgtgataattctttctgccatgttgtaccccattttctacgattcagttgctgtctttttctctcttctgagacagagcctctgtcacccaagctggagtgcagtggcatgaacacagctcactgcagccttgacctcctgggctcaagccatcctcccacttcatcctcctgagtagctgggactccaggcgtatccaccatgcctggttaactgttgaaaatttttttgtagagatgaggggtctcacggtattgtccaggctggtctcaaattcctgatctcaatagacttcatgcttcaggctcccaaagttttggaactgcaggtgtgagccactgtgcctggtcagttgctgtctttttttttttttttctttttgagaccgagtttttactcttgtctcccacgctggagcgcaatggcgcgatattggcccactgcaacctctgccttctaggtttaatcaattctcctgcctcagcctcctgagtagctggaattacaggcgcccaccaccatgctcagctaatttttgtatttttttagtagagatggggtttcaccatgttggccaggctggtctcgaactgctgaactctgatcatccacccacctcggcctcccaaagtgctgggattacagacgtgagccaccagcgcctggcctgtctgtataacctcagaattactttgtacctcacaaatctcaagtactaagtactgaatctttgttctccccctcaccaagtccttttgaagtcacacagagaaatttcttgaattttttagagaggcgtatagaatattaataactaatgtttattgactggttattctgtgccaggtactttgagtactttatgtaccttatttcacttactgtctaggacaatctagtgagataagtaatatggtctccatttattaaaatattcccattttatacaggaggaaacactcatagattcagtaacttgcttaaggtcacacaactaataaatgactttcagaagttgaacctaggcattctgacctgagagctgacccttttacactacactctcaaagccagcgttcttttggcatctcagcagtgcacatagaggtccgtatcctcaatatcctcaatactttgcctctgccctggagtctaagacttggtgttttttgttttgttgtttttggatggagtttcgctcttgccccccgggctgctacagtgcagtggtgcagtctcggctcactgaaacctctgcttcccaggttcaagtgattctcctgcctcagcctcccgagtagctgggattacaggcatgtgccaccgtgcccagctaatttttttttttgtatttttagtagacacggggtttcaccatgttggccaggctggtctcgaactcctgacctcaggtgatccgcccacctcggccttgtgttttttgtttttttttccccccactatgttgcccaaactggagtgcagtggctgttgacaggcacagtcatagtgcactacagcccttaactttggggcaggcagcccttctgactcaggctgtgagtagctgggactacaggcacatacagccgcatccagcccaggttttttaaagaccagaattaaagaatggcaagaagaggccgggcgcagtggctcatgcctgtaattccagcactttgagaggccaaggagggtggatcacttgaggtcaagagttcgagaccagcctgaccaacatggtgaaaccttgtttctactaaaaaatacaaaaattagctgggcgtggtggcggacgcctgtaatcctagctgctggagaggctaaggcacgagaatcgcttgaaccccggaggcggaggttgcagtgagctgagatcgtgccactggctttattattcagacaatacacatctgctatctaaagtcaatgatgaagaagctttttaaaannnnnnnnnnnnnnnnnnnntgaaaactaagcttatgccccggttttaattgacaccccggggcaaggttttaatcctgccgggatactcccacggggccccttattcggcaaggtcccaaaggtttggaaaagcaatgttgaaccaatttttctaaaaagttactggctttttttttttttttttttttgagacagttctcgctctgtcaccgaggctggagtatagtggcacgacctcggctcactgcaagctccgccccgtggggttcatgccattctcctacctcagcctcccgagtagctgggactacaggcgcccgccaccacgcccggctaattttttgtatttttagtggagatggggtttcaccgtgttagccaggatggtctcgatctcctgaccttgtgatctgcctgcctcggcctcctaaagtgctgggattacaggtgtgagccaccgcgcccggcctatttgttttgttttgttttgtttgagagggagtttcgctcttgttgccccgtctggagtgcagtggcgcgatctcagctcactgtaccctccacctcctgggttcaagcagttctcctgccttagtctcccaaatagctgggattacaggcatgcgccaccatgcccagccaatttttttgtatttttagtacagacggggttttgccacgttgtccaggctggtcttgaactcctggcctcaagtgatccgctcgcctcggcttcccgaaagtgctgggattacaggtgtgagccatcgcatctagcctacagagtatattttgtttacacagtgcataggtgaaaattatatggaatggcttaggtgtcatttttatgttttttttttctttttttgagacagaatctcgctctgtcgcccacgccgggccggagtgcagtggcgcgatctcggctcactgaaagctccgcctgccgggttcacgtcattctcctccctcagcctcccgagcagctgggactacaggcgcccgccactatgcccggctaattttttgtatttttagtagagaggtgtttcaccgtgttagccaggatggtcttgagctcctgacctcgtgatccgcccaccttggcctcccaaagtgctgggattacaggcctgagccaccgcgccttattttttaaactttatttatgttttgagacagagtcttgctctgttgcccaggctggagtgcagtgggacgatctcagctcactgcaacctccccctcccgggtcaagccattctcctgcctcagcctcttgagtaggtagctgggattacaggcatgcgccaccactcccagctaatttttttgtatttttagtagagatgggggtttcaccatgttggccaggctggtctcgatctcctgacctcaagtaatccacctgccttgacctcccaaagtgttaggattacaggcgtgagccaccgtgcgcagctgggtattatttttaaaggcatgggtacagaatgggccagtgattctcagccttttccgttgaacctgtttttaacttgtcttgggtcctcagcttgcataggcttcctgtggtgccatagcttgggagttccctggggccataaggaagggcttggccaagtctactggtcacattctgtcaggttgggcttcaagatggacctccttggaatgcttgcaagaaactagttttttttctcttgaacagctaaacctttcaggttgacacagctgaaggagtgtgagttaggagagtcgttataagcttgagctgtggatcctgggttgggccttatttacctaccacttactgcttgtgtaactttgggcaaattgtttaacttttccctgcttcagtttcctcatctgtgaaggagggaaatagtaatactgatctcatagggttgttggaatgatactccatattcagtactggcatactaagtactccataagcatttcatgtatacgaatcttaataacataactgaggtgtgggggcttttgaagcaaaatggaaaacttcttatctttgagaggctgtggaattcatgctgtggatggtaggaactggtgaaacagtttgtcttggggagtaggtgcctgggtggagtgcatccgtaagtgtgaaaggacctcgggtccagcacttggaaataagatggtgcctcctgttacctgctcatccgacctgttgcgctagtgggtggaggggggcataaaacgtgcttcattttgaaggcgtgggacagaagctagggtggtaatagtttgtgatactccctcgaggtagtgaagagctacatgccaggctggcagctgggccaagccacttctggaggtagcgtgagactgctgatggccctgttgctcaggctggtgtgcagtggctccgtcatagctcactacagcctcactgtatgacccaggctgggcttgcactcctggcctcaacagatgtctccctaaagattggttaatcagtttttaaaaatagagaaaaaaataaagagatcctcctgcctcagcctcccaaagtgctgagattacaggtgtgagccaccgcacctgcctgaccacagaacttttgagaagcatcttgagatcctgtggaattttctctgggaaacggtccagtgggctctggatttgaggatgaattgaaaattgctgaaggaatttggagaattggttgctttttattgagcacctataatgtacgagccacttttttttttttttttttttttgagatggagtcttgctctcacccaggctggagtgcaatggcatattctcggctcactgcaagctctgcctcccaggttcaggcagttctcctgcctcagcctccccagcagctgggactacaggcgtgcaccaccatgcccagctaatttttgcatttttagtagagatgggtttcaccatgttgatcaggctggtcttgaactcctgacctcagtgatttgcctggctctgccacccaaagtactgggattacaggcgtgaacccccacgcccagcctctagccactttaggaactttatttattagataggtatttgaccccattttgcagagtcgggggtgaggcacacagaagttaggtaactcagacagctagaaaatgagagccacaatgcaccaaacctgcaaaggaccgtcctcatacccaccatctttagaacattctatttgcttaggagaccatatatcttctcagatggaaaccagtggccttctgtcgcccaggctggagtgcagtggcgcgatctctgctcactgcaagttccgcctcccgggttcaagcgattctcctgcctcagcctcccgagccagtggcctttttagcgttttgtattggtgggtatttatctaagcaacccctgtaaataccacaggcagagaaggaagggagggagcaagaattgaggaaaaaagggaaaagagggccgggtgtggtggctcgcgcctgtaatcccagcactttgggaggctgaggctggctgatcacttgaggtcaggagttcgagaccagcctggccaacatggcaaaaccctgtctttcctaaaaatacaagaattagccaggtgtggtggtgggcgcctgtaatcccagctactcgagaggctaaggaagggagaattgcttgaacccaggaggcaggaggcagaggttgcagtgagctgagatcgcaccactgtactccagcctgggcaacagagggagactccgtctcaaaaaaaaaaaaaaaaaaaggaaaagagaaagtgctgtgagatcaaggagagcctggcccgctcttgtagacccgtcagaagtgattgggcctattttagcccacagagccctcaggtgttcttcatgaaaccttcagggagggagtggccttgtaaaaatggtcgtaacctgaggcttgaaatgcttggaaggcttagaagtaacgggctgagcaggtaccgagaagctgaaaggatatcctctccttgcattgattttgatttccgtttgtgtgacttcctaactccacgttcagaatccagcacagggtgatgtagaacaagtcattgaggttttccaagtcccagatagctatgagaatcctgtcgttgcttctgttctctagactggctgactgtgcctccttcctttcccgcccttctatttcctgcctttggctgtttgtggttggaaggagaggaaagagaaaaggagccggaacacacagccatggtgaggtttgggcttatctgggacttatgtgtgttctgttctcctcccttccttctggagtttggatcaatgaagcttgatggcccccagcagttcacagaaacgggcatttctctgtgaaattattacagtgtcagaatagaaaaataatttataagtaaagtacatcaaaggttttccgtggcgttttgcttacgtttctgtgtctattgggattgccaaacaaaaagaaagtcacggccgggcgtggtggctcacgcctgtaatcccagcactttgggaggccgaggcgggcggatcacgaggtcaggagatcgagaccatcctggttaacacggtgaaaccccgtctctactagaaatacagaaaaaaaaacccgggcgtggtggcgggcacctgtagtcccagctgctcgggaggctgaggcaggagaatggcgtgaacccaggaagcggagcttgcagtgagccgagatggcgccactgcagtccagcctaggcgaaagagcgagactccgcctcaaaaaaaaaaaaaaaaaaagtcatagtgagcccagttcacgctattgtggcatttgaccaagaagagaattaaacctgcttcctacctttgcgccagatgatctgccaagttttctctcactcatctttcagagcgacttggcttagtagtctcatttgttctttccccgccaaaatgtatttcgctcggcctgctatggtaacagtggctggcagggggtggttaccttccttcttccagtggagagagtaccttggaagtgttcacagatggtcgtagttgctcatggcgattctgttgtatctcaggacacagtgcgttattccaactgtctttagcaggaacatagatccaggtgaaggtgaaagccgggtgggaggttgtcttcctaagacgtgccgctttctccttgttcaccagccacactgtgcttgctgtgttatctccaacaatgctgtgaacttctctgagcttctccagtctaggaaggcattgtgcttagcttctttccatcacttcagagttaggcttattaagataatatctggctgggcgcggtggctcatgcctgtcatcccagtactttgggaggccgaggcaggcagatcacaaggtcaagagatcaagaccatcctggccaacatggtgaaaccccatctcttctaaaaatataaaaattagcaacacttaactgagcactgacctgccaaccactgtcccaaaaggacaactaatagaacaccttggcatgtagttgggtaaaccttagcaagggagcttttctccacccagctgtgatcagaaccatttctaagccatgggtgcccaggtggcctccttaccactctgccctagagttttcttgaccaggcagtgctaagtaggtccctatgcgctcacactgaccctgtcctaaacagtttctccataggcctgaaagatcacccagaattagcctaatggtgataggcaaggtagccatgaatctccttgactaccagacttgaataggaattattctccatcagtgatcctcctcaataaagagaatctccagaatatagcacctccgtgctctgctacagtcataaccaaaatcccctctccagtcctgccctcggaacttttgcgatcatcttctattggtgcatgaggagtgtttgccatagaggacagtcctggcactcgcacccctttcagtgtcttaaattggagagacagccagtattcctgagtctgggctgttcactgttttaagctgacagctgtgaattccacaggtggactttgggtaatatgaaaaatgtacggctctccttcagatggtctcatcattcatttggatggaaagagaaggcactcatcagtactctttctaccggaaggacttttcattggcttccaaagttaacattgtgtcttattacctctctccaatagtggaatgatttttttttttttttgacggtgtctcgctctgtcgcccaggctggagtacagtggcgcgatcttggctcactgcaagctctgcctcccaggttcatgccattctcctgcctcagcctcccgagtagctgggactacaggcgcccgccaccgtgcccggctaattttttgtatttttagtagagacagggtttcaccatgttagccagggtggtctggatctcctgacctcgtgatccgcctgcctcggcctcccagagtgctgggattacaggcatgagccatcgtgcctggcccctatgccattctttttttttttttttcttttgagatggagttctgctcttgttgcccaggctggagtgcaatggtgcgatctcagctcaccgcagcctccacctcccgggttccagcgattctcctgcctcagcctcccaagtagctgggattacaggcatgagactcacgcctggctaattttgtatttttttttttagtaaagacggggtttctccatgttggtcaggctgctctcgaactcccgatctcaggtgatccccccccccgcttcggcttcccaaagtgctgggattacaggcctgagccaccacgcccagctttttttatttttttaattgagacaggctctccctctgttacccaggctggagggcagtggcgcagtcttgactcactgcaggctccgcctcccaggttcaagcaatccacctcagcctccgaagtagctgggactaaaggcgcgcaccaccctgcctggcgtttgtatttttttcggtagagatggggtcttactgtgtgttagccaggatgtttctaacattgaacgaaataattaggtctttagctgggcgtggtggtgcacacctatggtcccagctacccaggagtctgaggcaggaggatgactccaggccaggagtacaaggccacagtgtgcagtgatggtgtctgtgcatagctactgcagtttagcttgggcagcaaaaacctgctctcaaaattaacaagaccaggcacggtggctcatgcctataatcccaacactttgggaggccaagggggaagaggattactttgagctcaggagatcaagacctgcctgggcgacatggcaaaaccccgttattaaaaaaaaaaaataggccaggcggggtggctcacgcctgtaatcccagcactttgggaggccgaggcgggcggatcacaaggtcaggagttcaagaccagcctggccaatatggtgaaactccatctctactaaaaatacaaaaaaattagccgggcgtggtggcgggtgcctataatcccagctacttgggaggctgaggcaggagaattgcatgaacccaggaggcagaggttgcattgagccgagatcctgccactgcactccagcctgggcaacagaaagagactccatctcaaaaaataaaaaaaagtggggctgggcgcggtggctcacgcctgtaattccagcactttaggaggccgaggtgggtggatcacgaggtcaggagatcgaaaccatcctggctaacatggtgaaaccccgtctctactaaaaaatacaaaaaaaaattagccgggcgtggtggcgggcgcctgtagtcccagctacttgggaggctgaggcaggagaatggcgtgaacctgggaggcagagcttgcagtgagccaagattgcaccactgccctccatcctgggcaacagtgagactctgtctcaaaaaaatgataataaagtaaaaataaaaaatacaaaaattagctgtgtgttggtgggtggcttgtgcctatagtcccagctatttgggaggctgagactgtagaattgcttaagcctagaaagtggaggctgcggccgggtgcagtggctcacacctgtaatcccaacactttgagaggctgaagtcggtgggatcacctgaggtcaggagttcgagaccagccttgccaacgtggtgaaacccccatctctactaaaaatataaaaaattaccttggtgtcgtggtggccgcctgtaatctcagttacttgggaagctgaggcaagagaatcacttgaacccaggagagagaggttgcagtgagccaggatcgcaccactgcactccagcctgggcaacagagcaagagtccgtctcaaaaaaaaaaaagaaagaaagggaggttgctgtgagctgagtttgcgccactgcactccagcctggacagcagagtgagaccctgtcacataccaggcacagtggctcacgcctgtcatcccagcacttttggaggccaaggcggtcagatcacttgaggtcaggagtttgagaccagccaggccaacatggtgaaactgtgtctctactgaaattacaaaaattagccaggcatggtggcacacacctgtatcccagctacttggggcgctgaggcagaagaattgcttgaacacagagggtggaggttgcagtgagccgacatccagccactgcactccagcttgggagacagagcaagactctgtcttcaaaaaaaaaaaaaaaaaaagaccctttcacacacaagaaaaatcccaataagcaaataattaaaattaataatggctggatgcagtggctcacatataattaaaattaataataggctggatgcagtggctcacatctgtaatctcagtacggcactggctcacatctgcaatctcagtactgcagtggtgcacatctgcaatctcagtactctgggaggccaaggtgggccgatcacttgagcccaggagtttgagaccagcgtgggcaacatagcaaaaccccatctccacaaaaaatacaaaaactggccaggtgtggtgtgcgcctatagtcccagttgctcaggaggctgaggtgggaggattactagagcctaggaagtggaggctgcagtgagctgagattatgccactgcacccctgcctgggtgacagaacaagaccctgtctcaaaaaaaaaaaaacaggccgggcgccctggctcacacctctaaacccagcactttcggaggcagaggcaagtggatctctggagctcaggagttcaagaccagcctgggcaacatggtgaaaccctgtctctacaaaaaatacaaaaattaactgggcatggtagtgcatgcctgtagtcccagcgacttgggaggctgaggtgaaagaatggcttgagcccaggaagtggaggtttcagtgagccaagatcatgccactgcactccagcctgggccacagagccagaccctatctcagaaaacaaaaacaaaaccgcagcctgggcagtaaagcaagacactgtctctataaaaaaaatttcaaaatcagctgggtgaagggccgggcacagtggctcacgcctgtaatcccagcactttgggaggccgaggtggatggatcacgaggtcaggagttgtagaccagcctggccaagatggtgaaaccttgtctctactaaaaatacaaaaattagccgggtgtggtggcgcgggcctgtagtcccagctactcgggaggctgaggcaggagagttgcttgaacccgggaggtggaggttgccgtgagccaagatggctccagtgcactccagcctgggtgacaagaatgtgactccatctcaaaaaaaaaaatcagctgggtgcaatgccacccgcacctttagtcccagctactcagaaggctgaggtgggagaatatcttgagcccaggagtttgagactgcggtgagctgtgatcacactactgcactccagcttggacaacagagttagaccctgtctctaaaaagaaataacaaaatcatgtactcaggagactaaggtgagaggatcgctggacccaggagtttaagatgagcctgggccacatagggagtctcctgtctcaaaaaacaaagccaaggccaggcgtggtggctcacgcctgtaatactagcactttgggaggccaaggcagatggataacttgagctcaggaattcgagactggcttgggcaacatggcgaaatcccattactacaaaaaattagttgggcgtggtgatgcgtgcctgtaggcccagctactcaggaggctgaggtaagaggatggcttcagcctgggaggtagaggttgcactcagctgaggtctgcactcccgcctgggtgacagagccagaccactctgtcacaagacaacaacaaagccaaaaactcacaaaactcatttggattttaggttttttgagacaaggtctcgctcttttgcccaggctggaatgcagtggcatgatcacgactcacggtagccttgactccctgggctcaggcgattctcccacctcagcttctcgagaagctgggactaacagacatgcaccaccttgcctggctaatggtttttttgtttgtttgtttgtttgtttttgagacgaagtctcgctctcctgtcctcatgatccacccgcctcggcctcccaaagtgctgggattacaggtgtgagccacgtgcccggcttgttttttgtttttttaggagattgggtctcactttattgcccaggctggtcttgaactactggcctcaatcagtcctcctgccttggcctcccaaagtgctgggattacagacgtaaaccactgtgcccagtcattttttttcaaacatttattttttctttttttaagagtcaaggtcttgctcggtcccccaggctggagtgcgttgacacgatcatggctcagtgtactcacaaactcctaggctcaagcgatctctcacctcagcctcccaagtagctgcaactgcaggcatgcaccactatgcctggctaattttttttttttttttgagacagagtcccgctctgtcgcccaggctggagtgcagtggcgcgatctcggctcaccgcaagctctgcctcctgggttcatgccattctcctgcctcagcctccctagcagctgggactacaggtgcccaccaccacgcccagctaattttttgtatttttagtagagacggggtttcaccgtgttagccaggatggtcttgatctcctgaccttgtgatccacctgcctcagcctcccaaagtgctgggattacaggcgtgagccaccgcgcctgtccaacctggctaatttttaaataatttttgtagtgatgaggtcttggctgtgttgcctacgctggtctcaaaatcctgcacttaagtgatcctcccacctcagcctcctaaagttctaggattacaggtgtgaggcaccacgcccaacaaaattcattttcttttttttgtttgtttgacacagagtcttgctctgttgcccaggctggagtgcagtggcgtgatcatggctcactgtagccttgaccttccaggctcaagccatccccctacctgagtgtcctgagtagctgggactacaaaagtgtgccaccatgcccagctaattttttaagttttttgcagtgacagccatgttgcccgggttggtcttgaactcctgagctccagggatccacctgcctcagcttccctaagtgctggggttagagatgtgagcaaccgtgcccagctaaaactcattctctatggagaatgtttactagttgttattattagagagttgtttattacttcttcaggaaaccataatgtgaaaaatccaatgaaaatagtttgctgttttgggtgcttagccgagtgggagttaaaggtttgcattcctaattagaaactttgtggccgggtgcagtggcccacacctgtaatcaatcccagcactttgggaggccgaggcgggtggatcactaggtcaggagatcgagaccatcctggctaacacggtaaaaccccgtctctattaaaaatacaaaaaaaattagccaggcatggtggcgggtgcctgtagtcccagctactcgggaggctgaggcaggagaatgacgtgaacccgggaggcgaagcttgcactgagtcgagattgtgccactgcacgccagcctgggggacagagcgagactccgtcgtggtgtcccacacctatgatcccaaaacttggggaagccgaaatcctaacaatcccgggagttcaccagtctgggcaacgtggtgaaaccccatctctacaaaaaatacaaaaattagccgggcgtggtggcgtgtgcctgtatttgaagctattcgtgaggctgggtgggaggcttgcttgaggctgaggctgcagttagctatgatcatgccactgcactccagcctgcgtgacacagcaaaaccctgactcatttttttttttttaaagaaactttgactcttgtttgaatttactcgttttgtttgactgtgttcatttattttccttgagttttagaatctcagcatagaataaatccattctgaactatggtatgtagggccaccatacacactcgtgtcttaggaattttaagcgtttgtaatatgttctttctctggatcctcagtgtgttatcagatgttgagtgttttaaccctttatttccccaagcattttttttttaatgacctgtttgcttcatagcgaacagtctagtttctgttttatttacgatctcgggaattgatttttaagcagttagccccttagtttttcagttcagcttcttggttcttttaccttttagctgtcaaagataaaattgagatcacctatcttagatttaaaaagataccagaggccaggcactgtggctcatccctgtaatcccaacactttggaaggttgaggccgaaggattgcttgagcccaggtgtttgagactagcctgggcaacatagtgaaaccccatctctacaaaatatttaaaaattacccagatatggttgagcgtgcctgtagtcccagctgctcaggaggctgaagtgggaggattacttgagcctgggaggtcaaggctgcagtaagctgtgattgtgccactgcactccagcttgagcgacacagcgagactctgtcccaaaaacaacgaaaaccacaacaagagatagtttttcttcttcggaattatacattctagatgtgaagagaaaaaatgtgtgagctcagtgcagacacaagctctctccaccttctgaacagcagcagggacccatgaaaaacaagagcttgctacatttcctgaggttgaaaagtagatgcaggccaggcgcagtagctcacacctgtaatcccagcactttgggaggctgaggtgggtggatcacctgagatcaggagtttgagaccagcctggccaacatggtgaaaccccgtctctactaaaaatacaaaaaaaaaaaaaaaaattagcttgtcatggtggtgggagcctgtaatcctagctactcaggaggctgagacgggagaatcgcttgaacccgggaggcagaggttgcagtgagcagagatcacgccactacactccagcctgggcgacacagtgagatttggtctcaaaaaaaaaaaaacatgcaacagaaccttgaggcttacactgctctgtaaatggggtagcgacagaacatatttggagaatgcagtgaaagcccccgtcgttgatcaagtatgagagcacgtcctgatcagcctagtctcctggcctcctcatccttccctggggctgtagtgatgggcatctttcttcccaggggatgtttcagcttccaaatgtgatgttggtgtgctgtgaagagaaggggttattttttctagagttttttttgctgattaaatcttgactaaatgtgtatgaggcatgcatgaaagctccatttcggccaggcacagtggtgggctcctgtagtcccagctactcaggagtttgtggtgagaggatcacttgagccccggaggtcaagaccagcctgggtaacatagtgagatcccaactctaaaaaaaataaaaataaaatctgcatttcatttccagtgtagtacatcattaaataacagcctgctctgttttttccaggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtacataacgtgcacaatgtagaaagaagagatctgctgcagggtctcctctcggtcctcttagagctttgtagcaatgctgactacagcattgggatgttgtagatggcaagccgctaagcactgatgttggcattgaatgttgggttttctcttcttcatagaaaacctgtttgggaatgagtaagcttaaaactgtataactgaatgttcttaattgatctactaaacacacttggactactttaataacaccacctgaattcacaggaattaacctcaaatgtttttcctcatctacatcctcatctgtttcttgctttctgtttgtcgttgtctaaaagaaggtgggttcagatggatttgagtgtaataagtggtctctatcaaagcacttaaatggaattttcccgcaaaaacttgtttttgcttcaggggacttgaagttccttaccactaatgttcattgagtagaatccgggaggaaataggcctagtagaggtttgaagagatgcacacccagaagtcctcattccgaggagtggcaggtgcacgggtctttctaaatcattcaaaaagccagttcttcctcaggaattaatttttgcctttactgatgaaatatctttggcagcccacttccttctggccagccattacatggtgttaattcctttattcctctcttccacgctcacaccttgctctcctacctccttcctttcttcttccttcctccctctctcccttcctttcttttcagaagaattgatggttcagtgtaaaagctagtacagactgggcacagtggctcacacttgtaatcctagtgctctgggaggctaaggcaggaagaccacttgagaccaggtgttcaagaccagtctgggaaacatagacctcagctttttttaacaaaaagtgaaaaaaaaaaatcaccaggcgtggtggcatgcacctgcagtcctggcttgaatgagaaatggaatgtatgttgtcagagttatcactgcctcttgttcccattccctgtttggaggaaaatagatttctaccctcaggtcttcctgtgagttcagatgacggtaacatctggcatggtgctgtgtgtatgatggatcttactcctttttattttctttttttttttcctctctgcttttttttatttttatctggccttactgagtcactagatgtaactcttgacatttattacagactttattagcactgggttgaagtaagtatgaaaacatggaacaaaggctgggcgtgtggctcatacctgtaatcccagcaccttgggaggccgaggtgggcagatcacttgagctcaggagttggagaccggcctaggcaacatggcaaaacaccatctctacaaaaaattagctgggcatggtggcacgtgcctgtggtcccagctacttgggaggctgaggagggaggatcacctgagcctgaaaggtcatggctgaagtgagctgagatcatgacactgcactccagcctgggcgacagggtgagactctgtctcaaaaaaagaaaaagaaaaaaagccatggaacaagccagctgacccaggagaaaccagttatcatgtgaattttgcttctatttgcatttcctttctcagagatttaatcatgcctgccttaattagaggctttactgctcaaaaaaatggttgagcttctctacctgctgtgaaacacaaatctcattaaataaagatttgagtagaaaactagttttatgattttagtaagttttcctttttgatttgggtattgggtttttttggatttttttttttttttttttgggtctttttgagacgaaatctcgctccatcgcccaggctggggtgcaatggcacgatctcggctcactgcaacctccgcctcccaggttcaagtgattcccctgcctcagtctcctgagtagttgagattacaggcataccccattgtgcctggctaatttttgtatttttagtagagacagggtttcaccttgttggccaggctggtctcaaactcctgacctcaggtgatccacccgcctcagcctcccaaagtgctgggattacaggtgtgagctgtcgtgcctggccaatttctagaaatgtctttatgttgagctaaaacatatgtactatgtgtggtcaccgctcatcaagggtatggggagcttagcttcaggcattatcagttgagctagagatctttgtgactcacaccagaaccagggtaaggcctatctcccaggattctgtgggatgttttttctgttcatgtggactgttaaatctcaaacactggcagctttccaccaatactacccatgccagtttcagtccatctctgatgcaggtgaattgttaaggctgaattgtcctcatttgtttccatcaatttgaaagactgtcgatgggccctagatacactacctgttacttagatcaggggtctgcaaaccttttctgtaaaggtttttgagggccttaaattctgtgtcccaactctgccattgtagcaagaaggaaatcatagataaaacaacagatgagcttgctgtgttccaataaagctgcaaaaacaacaggctgatgtttggccaggtgctgtgacttacgcctgtaatcccagcactttcggaggctgaggtgggaggatcgcttgagtccaggtgtttgaaaccagcctgggcaacatggtgagatccggtctctacaaaaaatgtttttaaaaattagccaggtgatctaaaaaaaaaaaaaaaaaaaaaccatacatgctgggtgcggtggctcacgcctgtaatctcagcactttggaaggctgaggcaggcagatcacctgagatcaggagtttgagaccagcctgaccgatatgatgaaaccctgtctgtactaaaaatacaaaaattagccaggcgtggtggtgggcgcctgtaattccagctactcgggaggctaagacaggagaatcacttgaacccgggaggcagagatttcagtgagctgagatcgtgccatagcacttcagcctgggcaacaagagtgaaactccatctcaaaaaaaaaaaaaaaaaaatccaggcgtggtggtgtgcacctgtggtctcagctgcttgggaggctgaggtaggaaaactgcttgagcctaggaggttggaagagaaggctcctgtgctgcctctctgtacttgctcttccctggttttgtgtgtatgaatttgtgtgtgcttcctgccctgagctcactgaaagcaagtctggatcaaggcatgttagcagtcagtgatgtgctgctggttggtagtagggacctagaaaagcagtcacctgggtttgcgccagcaaagaaaaccagttctgtgatgtcccctgtgtagtgaattccaaacattgataccatttgggttctgattttgttctcattatctctggaacgcattgatcagctgggtaatcttttgttcctgtaccaattctagatctgattgcaccaggatcgattagccttgaaaacgacacagagctagggaatagccagtgtttgttacgttccttgggagcaaagaaactgtagtaaccacattcagtcttctttatgaatgactccatgatacagccgggacttgcttcctaaaaaagtgaagatgaaaggatgcttgttatattttagtcaacttttctaggtgttttgtggattgtggttctttaggatatagtcttaagtccaccattctacttgatagcaaactctgtttaaatacctcaatcttatattgtctttgttcttcttttcttttttttttttttttgagacggagtctcgctttgttgcccaggctggagtgcagtggcgtgatctcggcgcactgcaagctccgcctcctgggctcatgccattctcctgcctcagccccccaagtagctgggactacaggcgcccgccaccacgcctggctaattttttatatttttagtagagatgaggtttcaccgtgttagccaggatggtctcgacctcctgacctcgtgatccacctgccttcgcctcccaaagtgctgggattacaggcgtgagccaccgcgcctggcctttttttttttttttttttaagacaaggtctcactctgtcacccaggctggagtacagtggcgtgatctcactctgcctcctgggttcaagtgattctcgtgcctcaacctcccgggtagctgggattacaggcatccaccaccacgcctggctaatttttttatttttagtagagatgggatttcgccacattggccaggctagtctcaaactcctggcctcaagcgatgcgcctgcctcagcctcccaaagtgctgggattataggcatgagccaccctgcctggcctatgttgtctttattcttaaacattcagagtgcagtctcaaatcccatcccacagagctgtaagaagctcctaagaatgtgttacaggatgaggaggctgaggaccagcctggacagtaaaacagttcctctgtggtgagactcatcagtctctttgctgtagtgaggtctccctcttggaaagaaaggttaactaccttgtagtacttcaagtcctgtatgaagtctttgttgttcattggtaattcatattaggatttttctttcctatttataacttgaattttgaaatcagtagtgttagaactactgttattactacattcactgattagtacattcctttgtattgtcagattgtaacagttctggggcaagcactcggtttcacctttgtatttgaagtagtacaccctagtctggtcaacatggtgaaacccatcattacaagaattagccaagtgtggtgcacatgcctgtagtcccagatactctagtgactgagatgggaggatggcttgagcctgggaggtcaaggctggagtgagctatgattgcgctactgcagtccaggctaggcgacagagtgagactctgcctcaaaaaaaactagtacaccaagtttcttttttttttcttttgtatttttagtagagatggggtttcactgtgttagccaggatggtctcgatctcctgacctcgtgacccactcccctctgcctcccaaagtgctgagattacaggcgtgagccaccgccccggtatgatacccctcaccttccctgatctgatctttgggaattatgctttagtgaattaacaggtggaagcacagttctgactttgtttctgaattggaggaagaactgcatttactggagcaaaatgttcttagaatgccccaccccctccggccttcttcctctgccctcctccagccagagtcagcagccactccttcctccagactgttaaagacctaaggccacatgtggcaccacaggaagacctggtctctaaatatcatcatagtgcctttgggacctcaggagcattttcatgtgctctaaacgtttcaggagaaaggccccaaaaagcacaaagggttaatttgtttgtttgtttgtttgtttgttttgagacggagtctcactctgtcgcccaggctggagtgcagtgcgtgatctcggctcactgcgagctccgcctccagggttcacgctattctcctgcctcagcctccctagcagctgggactacaggcgcctgctaccacgcccggttaatttttttgtatttttagtagagacagggtttcaccatgttagccaggatggtctcgatctgctgacctcgtgatccgcccgcctcggcctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttgggaggccaggcgggcggatcacgaggtcaggaaatggagaccatcctggctaatactgtgaaatcccatctctactaaaaaaaaaaaaaatacaaaaaattagccggacgtggtggcgggcatctgcagtcccaggtactcgggaggctgaggcaggagaatggcgtgaacccgggaggcggagcttgcagtgagccgagatcgcagccactgcactccagcctgggcgacagagcgagactctgtctcaaaaaataatactaataatcagaatgagcccaggtacagtggttcacgcctgtaatcccagcactttgggaggtcgaggtgggtgaactcttcacctgaggtcaggaattcgagaccagcctgactaacattttgaaactccatttctatgaaaaagacaaaattagccaggcgtgggggcacacgcctgtaatcccaactacgtgggaggctgaggcaggagaatcacttgaacccgggaggtggaggttgcagtgagctgagattgtgccactgcactccagcctgggcaacaaaagcgaaactctgtctttaaaaaaaaaaaaaaatcatttgagttatggcatagccattatctcatctccgtatatttgaacctgtctgccaaaaacctaatcatctgtaaagaaaagattcgtgtttttggttgtttttctcttttttttttttgagatcaggctttgctctgttccccaagcaagggtgcccagttgtagctcactgcagccccaaactcctgggcttgtgatccccctacctcagcctcccaagtagctgggactacaggcacattccactgtacctggctaatgttgtacttttaattttgtagaaatggagtcttgctttgtaacctagactgatcttgaactcctggcttcaggcaatcttcctcctgctcgggcctcacaaagcactgggattataggtgtgagccactgcgtctggcctctttttttttttttaagagagacagagtttcactgtgctgctgaggaaggcctcaaactcctgggctcagctgggcaaggtggcccatgcctataatcccagcactttgggaggccgagttgggcaaatcacttgaagtcaggagttgcataccagactgtccaatgtggtgaaacctggtctccactaaaaatacaaaaattaactgagcatggtggcgggcgcctataatcccaggtccttgggagcctaaggcacaagactccaggaggcggagtttgcaatgagacaagattgtgccactgcactccagcctgggtgagagatcaatacagtgtctcaaaaagaaaaaaaaaccctggactcaagggttcctctcccctcagtctcccaagtagctgggactacaggtgcaggccagcgtacccggtgtaaaaaaaaaagttttagattttggcatggttttcctctgcagggtagatccaagagaatctggctgggcacggtggctcacacctgtaatcccagcactttgggaggccaaggtgggcggatcacctgaggtcaggagttggagaccagcctggccaacatggtgaaaccccatctctactaaaaatgcgaaaaaattagccggacgtggtggcgtgcgccagtaatcccagctactcaggaggctgaggcaggagaatcgcttgaacccaggaggcggaggttgcagtgagctgagattgcgccactggactccagcctgggtgacaagagtgaggctccatctaaaaaaaaaagagagagaatctgtacattaaagatagttctgagccgggcgtggtggctcacgcctgtaatcccagcactttgggaggctgaggtgagcagatcacgaggtcaggagttcaagaccagcctggccaatatggtgaaaccccatctctactataaatacaaaaattagcagggcgtggtggcacatgcctgtagtcccagctactcaggaggctgaggcaggagaatcacttgaacctgggaggcagaggttgcagtgagctgagatcatgccactgtactctagccagggcaacagagtgagacgctgtctcaaaaaaaaaaaaaaaaaaaagatctgatatggtccaaaggtctaatttacacatagttcctttccccaataacatcttgcctcatagaaatccctactcatttatcccttagaagtctgaaagaagggctggcacggtggctcacacctgtaatcccagcacattgggaggccgaggtaggcagatcacgaagtcaggagatcgagaccatcctgcccaccatggtgaaaccccatctctactaaaaatacaaaaatcagctgggcgtggtggcgggcgcctgtagtcccagctactcgggaggctgaggcaggagaatcatttgaatcctggaggcggaggttgcagtgagccagcatcgtaccactgcactccagcctgggtgacaagagcaaaaactccattaaaaaaaaaaaaaaaaaagtctgaaagaaaagatctggaggcacatcagcaggttttgccccacattttgagaaattggtatggttctgtgttaacagcaaggggtggggctggtccacttttcaacctacccttcacctcttagagctttgtgggatgtgatttgagactgcagtatgaatgcttaagaataaagacaatataggctgggcgcggtggctgatgcctgtaattccagcactttgggaagccgaggtgggcgggtcatgaggtcaggagttcgagacaagcctgcccagcatggtgagaccccgtctctactaaaaatacgaaaaaagtactggctgggcatggtggcttgtgcttgtcgtcccagctacttgagagcctgaggcaggagaattgtttgaacctggcaggtggaggttgcagtgagccaagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtgcagtggtgcacttggcttgctacagctcaaactcccaggctcaagtgatcctcctgcctcagcctcctgagtaactggaactacaggtgcatacgatgataccttactaatttttttttttttttcaagagacacagtcttgctattgttgcctagcctggctggggcatgtcagaatcctttttttttttttttttttttggagacagttttgctctgtcgcccaggctggagtgcactggtactatcttggctcactgcaatctctgcctcccgggctcaagtgatcctcccatgtcagcctcttgagtagctgggaccacaggcgcacactactatgcctggctaatttatttatttattttattttttgagacagagtgtaactctgttggccaggctggagtgcagtggcacagtctcggctcactgcaacctcgtcttcccaggttcaagcagttcactgcctcagcctcgcaagtagctgggattacaggcgcctgccaccacacctggctaatttttgtattttagtagagacggggtttcaccaatttggccaggctggtcttgaactcctgacgtcgtgattcactcacctcgacctcccaaagtgctgagattataggcgtgcgccaccacgcccagccaatttttttattttttgtagaaatgaggtttcactatggtgcccaggctggtcttgaactcctgagctcaagtgatcctcctacctcgcctcccaaagtgctgggattaaagacgtgagccccacagcaccctgcccagatgtgagaaacgttgaattctaaaattgctggcaggccaggtgtggtgagagtcctggtgacagcaacctgtgaggattgttacctgtgtgtaaggataggcatgccatcatcccttcctccccttcctccacacttgtgctcagctggcatcgtcacgacacaggctgggccatcatcccttcctctccttcctccacacgtgtgctcagccggcattgtcacgacacaggctgggttagctgcttggttttctctttttttgcagacagggtcttgttgcccaggctagggggcagccttgacctcccaggaggctcaggtgacctcctacctcagcctcccaagtaactgggaccacaggcgcacaccagcacgcttggccacgcttggccacacttggctttttaaatttttttgtagagacaagatctcactcttttgccagggctgctctcaaaatcatgggctcaagccatccccccacctcagtttcccaaagtgctgggattacaggcatgagccactgcaccaagcctgctgctatttttttctcaacctctgtgtcttatgtgtctctctatccccttctttctgtccctccttttctcagcatcctatgacccatacagtgacttcaggcctctgtaatttttagagagttcttcaggaaacaacagaggggccaataggcaagctgttccatctgtaagtgaggtcaggctgggcctggaagaggccctgcggctggacttacgttggctttggccagtagatgtgcctgcgtacatttttagggaacccagtacaagcccagatgcataatttgaaagttcctgatactgtatgaaatgcataaatggtgtggaggctcatgcctgtaattagctgggcatggtggcgtgcacctgtagtctcagctactcgggaggctaaggttggaggatcccatgagcccaagagttacaggctgcagtgagccatgatggtgtcagtgctctccagcctgagtgacagagtgagaccctgtctcaaaaacaaaagataaaaagatggccaggcgtggtggctcacacctgtaatcatagcactttgggaggccgaggcgggcggatcacgaggtcaggagatcgagaccatcttggctaacatggtgaaaccccatctctactaaacaaaatacaaaaaattagctgggcgtggtggcgggcggctgtagtcccagctactagggaggctgaggcaggagaatggcgtgaacccgggaggcagagcttgcagtgagctgagatagcgccactgcactccagcctgggcaacagatcgagactctgtcttaaaaaaacaaacaaaaaaaaactttatatttcattttgcaacaagagacattttataaataaatgccaaaacataaggtttttttttgtttttagaggcaggatctggctctgttgcccaggctggagtgcagtgatgtgatctcggctcactgcaacctctgcctcctgggctcaagcagtcctcccacctcagcctcccgagtagctggttctatgagcagccaccaccacacccagctaatttttgtattttttgtagagacggtttcaccatgttgctcaggctggtctcaaaaactcctgagctgaagcaatccatccacctgtgtcaggctcaccaagtgctgggattgcaggcgtcagccactgcgcccggccatggttggtttttttgacccctcattgggtaatgatcaggtaacaagcggctttgagggagcagcaaggtctgtccgatggtgggatttgggggctgggcaggcagtggcttgtgaagtagagcttactgaatgaggtgggggttttctgggagctaattggacctggagttttggcctctacctgcccatatgggaaaaggcttgcctgggtcaggaggtgataggaacacttgattctctaggaccaagtgacctatgcttgccatgatcgctttctgctgtgcaagcagtaacaggccaggtcgtgtgcgagtgggctgggggattgtgctgctgccatatgctaaagcggggagaaggcggccaggcacagtggctcacgcctgtaatccaagcactttgggaggccaaggcaggtggatcacaaggtcaggagttcgagaccagcctggccaagatggtgaaactccatctctactaaaaatacaaaaattagctgggcacggtggcaggcgcctgtagtcccagctactcgggaggctgtggcaggaaaattgctcgaacctgggaggcagagcttgcagtgagctgagatcacgccactgtcatccagcctgggtgacagagactccgtctcaaaaaaaaaaaaaaaaaaaaacggagaaagctgcttctcctcggacagggcctgcggagcaggcagaaagctgagggtagtgagtacaaagaaagggaatagtagctaactcactgaagttgggattgctcatgcagagacagctgagatttccaataattatcactttccttttttaatcaaaaagtatcattatctggaatcccttttactttctgtattctctgtttttccacactgctaaaaacacttttccttctgcctgcattaaccacaagtaatcagtctggtggctggggctggggaggcagcaaatggccatttctgtaatatccctagagcagtcacatgggcagggtgtgcctaaccagagaatggagttgttcagcttgcattcctacctggaaataaagtgctctccttattctcctcctgcaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacat

SEQ ID NO: 15527 - DNA, 38206 bp, Human
tctatatctaaacctttttggcctggcacggtggctcacgcttgaaatcccagcaatttgggaggctgaggtaggcagattacttgagctcagtagttcgagaccagcctgacaaacatggagaaacgccatctctacgaaaaatacaaaattagccgggtgtggtggcacatgcctgtaaccccagctactcaggaggctgaggcaggagaatcgcttgaatcctggaggcagaggttgcagtgagccgagattgtgacactgcactccagcctgggcgacagagtgagactctgcctcaaaaaacaaaaaacaaaccaaaacccccactttttttctatgaaaccagcctcgctctgtcacccaggctggagtgcagtggtgccatcatgatcctcccacctcagcctcccgagtagctgggactacaggcatgtaccactatgcctggttaatatttttattatttgtagagatgagggtctcagtatgttgcccaggctagtcttaaactcatgagtttaaccaatcctctcgccgctgcctcccaacgtgctaggattacaggtatgagtcacggtgcccggcttctttcttaactctttctagtagttctaccacttgggattacctttttccttcctctccatttacctttatgaaatcctcacatccatccatctccatcaaatctttaacaattctcctctgtcttttttgactgtagggacctttagaacacccagcattaaaaaatagatttcaggccgggcatgggggctcacgcctgtaatcccagcactttgggagggccgaggcaggaggatttcgtaaggtcaggagtttgagaccagcctggccaacatagtgaaaccctgtctctactaaaaatccaaaacttagccggcagtagtggcgcgtgcctgtaatccagctactctggagactgaggcaggagaattgcttgatcctgggaggtggaggttgtgatgaattgagatcgcgccattgcactccagtctgggcaacagagtgagaccctgtctcaaaaaaacaaaaggaatattttttaaatttttaccgttctgaaagcacattgacatcctttgaatttttttctaattatttcactttgatttgtaaattctcaactagattcaggggctgtatgggttacaattcctctgcaccctccacggaatttcagacttttttttttcccccgagacagagtctcgctctgtcacccaggctggagtgcagtggcgcgatcttggctcactgcaacctccccctcccgggttcaagcgattctcctgcctcagcctcccgagtagctgggactacaggcgcccgccaccacgcccggctaatgtttgtatttttagtagagacggggtttcaccatgttggccaggctggcctcgaacttctggctttaagtgatccgcctgcctcggcctcccaaagtgctgcgattccaggcgtgagccaccgcgcccggccaaggtcttaattcttgcctgcctttctgctcccctgtgaactctactggttgtcttttttcctgctttatccctcgtcctcggtagacagtgatggttaaatgaatgaatgcatgaacaaatgactgtccaggagctagtactgcattgcatgtacacattgatgacaacagacatcgtacaatgcgcaatcttggcaaatttattcaaaccctttagacttcggtctctcacagtgcgacgccaggagcccatcacacgctgaggtctgtcagaggccccagaaacagcctcggaaatggaggaggcggggcctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgcgcgcgcaggcgggtggggaccctccccgtttgggcagctcctgaggtgtcagctcccttgttatttccagttagtttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattagggggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttggggtaaggaacatcctgaaataatttcatttggaatttggcccttttcccttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcggtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtgagtgatagatggagatactacacctgggaggagttctggaaatgcagaaggagtcctgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaatgatattaacaagattatcatccggcagcctatccgcactgagtacaagattgcttttccttacttgtacaacaatcttccacaccatgtccacctcacctggtaagagacctggaacacaacatttggaaaggagaaggctgctgtttaggttgggccagggcgggaaaactttggctgactcttcctttcattttaggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcacgttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggaggaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgcttgggatcgtagggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagccgggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggcgtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagtagtgttcgtgttaaactgaggaaaagcccatagtcaaagcaatccaaatgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctacttgggaggctgaggcaggagaatcacttgaacccgggaagtggaggttgcagtgagctgagattgcgccagtgcactctcagcctgggtgactgagcacaactccgcctcgggagtggaaaaaagtagaatttgctgaggggagaacaaaagaggttaactctggagaatcctggggcatggctcacattcttaagaattgtagttctttctttctaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttcctggattcctagccttgcagggtactgaggcatgtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgagattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggtctggtgtaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgagtggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacagggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcggccgggcacggtggctcacgcctgtaatcccagcactttgggaggccgaggctggtggatcacctgaggtcaggagtttgagaccagcctgtccagtgtggttctgaaacctcgtctctgctaaaaatacaaaaattaaccgggcctggtggccggcgcctgtaatcgcagctacttgggaggctcaggcaggagaattgcttgaacccaggaggcggacgttgctgtgagtcgagatcgtaccattgcactctagcctgggcgacagagcaaaaactctatctcaaaatacaaacaaacaaaaaaaagttaccttactctggtttccattagagtaactcttagctataacatttttcttgcattccgaccttcatatctctaaatgtgcggcatttgcatgcgcagaatgttttctgttttttagttaagtctgttaaggatacgttctgttatgttttagaactattgcattacggttgagtttcctttatccaaaatgcttgggaccagaaatgttttggatttcagattttcttttttaatattttcattatttttattagagacagggtctcactgtcacttaggctgaagggcagtggcgctatcatagctcactgcagctcaagtgatcctcacacctcagcctcccaagtatctgggaccacaggtgcatacgccaccatgcctggctaatttttaatttttttttttttttttttttttttgagatggagtcttgctctgtcacccaggctgcagtgcagtggcgcagtcttggctcaccgcaagctccgcctcccaggttcacgccattctcctgcctcagcctcctgagtagctgggactacaggcgcctgccaccacgcccggctaagtttttgtatttttggtagagaaggggtttcaccgtgttagccaggatggtctcgaactcctgaccttgtgatccgcctgcctcagcctcccaaagtactgggattacaggcgtgagccaccacacccggcctgatttttaaattttttgtagagctgggatctcactctcttgtccaggctggtctcagactctggattcaagcagtcctcctgccttagcctctctaatgctggattataggtgtgagtcaccgtgcccagccttgaaatattttcattatacttacaggttcagcatccctaatccaaaatttgaaatgccccaatgagcatttcctttgagcgtcatgttggtgctcagaatgttgggactcagaaagtttcagctttttgtgagcattttgggttttagattaacctgtatgtgggaatctgtgagagcactagagttagtgattgctctagcccagtctggaagtggaagaggaaaggattcctgaaagaagtagcatgtgatgagacaggtgagggagagcattcctttagccagaagtgtggcgatgtaactagcttgtgtacatgggaccatggaaagttcaaggtttgctggagtaaattgtggaattgggaatgttaagagatgaggctggataaatagtggagagccatatcatggagggcatcgcacaccttaggaagaatcatataagggtcttaagcacagagtgactttgtcagatgtgtttttcttcttttttttttttggcttcccacactacagatgcagactttgtcaaatttctgtgttagatgattcactcttgcagctgtgagaaagatggacctgaaaggataggatgggagaccaggtttggggaccactgaagaagtccagataaaaatgatgagagcaggccaggcgcgggggctcacgcctgtaatcccagcactttgggaggcccaggcaggtggatcacctgaggtcaggagtttgagaccagcctgaccaacatggggaaaccccatctctacttaaaatatgaaaattagccgggcgtggtggtgcacacctgtaatcccagctacacaggaggctgaggcaggagaatcgctggaacccgggaggcggaggttgcagtgagccgagatcccaccagtgcactccagcctggcaacagggtgagactctgtctccaaaaaaatacataaatcaataaaaatgatgagagcactgaaagtagaggtaggaagaggggaacagatttgataagaagttagcagataaaatcagcagaactttgtggtcctgggatgctcaaagaaaagtcaaaaatgatgtgcagattttggcatgggtgactaggtgggtgttagtgccaccaactggaagaccacatgaacaagaacaggtttaggatcgaagataaagaaatctagtttaggatatataaagtttgaagttcctgagaacattcagatggagatttccccaggtatttatttataccttatttcttcagttccaagatacatatttaagtacatatatacacatgtgtagattcctgattccttctgctcccttagtggtgcctctttaattgatgatctgttagatttgatttaaaaagtatgagtgagacattccagggagagaaatgaaactagaaaggtaagagcagtcagggatagcttagaggttcctaggtgagaagcaatctgaagaaacatggagaacaggtctggattaaagatgtagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtgggagggtgccgggtcttggaaccaaggccttcaggaacacgtgtccagaattggggtgatgctgagcagtgtcagttgcctaagagcatttcagttagatgaggactgaaaagtatccattggatttgacagttaggacgtcattggtgaccttagcaggagctgttacagaaatagtagggatggaagccagatggcagtgggtgaggcttcatgggaagtgagtgagtggagacagcaaggacaatctgtttgtcagttgaagagaaggaaggacatcagatgccacctagagggagctgtaagtcagtgcaggtgtttttgaatgacagtgacttgagcgtgttttaattaaggagcccagtagcagttgagtgtacaagagaaaagtgtggaattggctggacacagtggctcacgcccgtaatcccagcactttgggaggccaaggtgggtgaatcaccaagtcaggagttcgagaccagcctggccaacatggtgaaaccccgtctctactaaaaatacaaaaattagccaggcgcggtggcgggtgcctgtaatctcagctactcgggaggctgaggcaggagaattgcttgaacccgggaggtagaggttgcagtgagccaagatcgtgccactgcaccccagcctcggcgacagagcaagactccgtctcgaagaaaagaaaagtaggtaattgatgagcagaggtgcagagggtctccctagggatagaataaagagcaagcagaggaaaaatcctctgaacctgacaggaaagaggtctggaaagatgtggatatagatgaggttagtgggaagctataacaggattttgagtttttcagcttttcttgggctgcagttaggggaaagagttgtgcatagtgaatttcatggtattagggtatgatgattgctgaagaaactgagagggattggaaggtgtgttgggagctcagctgggttttgggaagacaactctgagcatttgtttttcccagaatcacccagctactcagtgacagggatgcagaaggtggatagattacactggtgattaaggaatagagctctgttagaagacagttgtagagtggtaaggcattgaatgcaagggaatcaagagtgcgggacccagccggccgcggtggctcatacctgtaatcccagcactttgggaggccgaggcgggtggatcacgagttcaggagattgagaccatcctggctaacgcggtgaaaccccgtctctactaaaaatacaaaaaattagctggatgtcgtggcgggcgcctgtggtcccagctactcaggggggctgatgcaggagaatggcaggaacctgggaggcagagcttgcagtgaaccgagatcgcgacactgcactccagcctgggtgacagagcaagactctgtctcaaaaaaaaaaaaaaaaaaaaaaaaagaatgctagaccccattgagatactggaagaggggagaggagagagagcagaagaggccattggcctgggaaagaattgtaggcatcagggaactggatatcagaagttagaggctgaggagtggaggagtgtctgagagggtaaggatgcagttgactctagtggttagaagcacaggctctggagtcagatggggttcacatcatatctttgtcatattactagttgggatcttgggaatattgcccatgctgggcctcaattccctcatctgtaaaatagggatactgataggacctaggtcagacggcttttgtgagaattaaatgaaacggggtatttagtaagccatattacttggtaaattgcatgataaagctgggcatggtggcttatgcctgcaatcccagcacttttggaagccgaggtgggaggactgcttgagcccaggaatttgagaccagcttaggcaacatagcaagatcctgtttatatttaaaaataaataaataggccgggtgcggtggctcacgcctgtaatcccagcactttgggaggccgaggtaggtggatcacgaggtcaggagttcaggaccagcctggccaatatggtgaaaccccatctctactaaaaatacaaaaattagccaggcgtggtggcacatgtctgtagtcccagctactctggagactgaagcaggagaaccacttgagccccggaggtggaggttgcggtgagctgagattgcgccactgcactccagcctgggtgacaaagtgagactccatctcaaaaaaaaaaaaaaaaaaaaaaagctatgtcatgggcaagttctataacttgttttttatgaagacataagaggtataacatatataaatttcttaccatggtacctagtacacgtagacctgagtaaatattattttccttcttgcctccccttatcccccaggaatttctgctatttagtaaaggaacactgggctcctcaggaatttatgcctcctccccttcagggatagagcactgttaactacaacagaaatactgtgttccattacacacatcagcaattccaagtgcagtccaagaatttactaaacctaatgggaatcatccacttgcctttaccccagtatctagcctatcctggcccctggccctcctttttttttttgagagggagtcttgctctattgcccaggctggagtgcagtggcacaatttcagctcactgcgacccccgcctcccgggtttaagtaattctcctgcctcagcctcctgagtagctgggattacaggtgcctgccaccatgcccggctaatttttgtatttttagtagagacagggtttcaccatgttggtcaggctggtctcaaactcctgacctcatgatccaaccgcctcggcctcccaaagtgctgggattacaggcatgagccaccgcacccggcccccctcctttctgtagatctgcctggttgtctcatcctgtggacatgcgagatgctcagtctagctttcatagtagggtttgagctgttatctcacctgcagtcttttctccttgcttgtctgaataccatttgctcaaggcagattactatagtaactccagccaacgcactctttcacctcaataattgttcagaagacattttttgccttaaagtcttgactatatcatttggtattttgtggtttgctatcttgttttattcagcttttcaaagaaacagctttggtttcattaatttttatcgtttttctcttttttgttgcattgattttttttttttttgagatggggtctctatgacccaggttggtgtgcagtgtcgcagtctcagctcactgtaacctctgcctcccaggctcaggagaccctcccaccttagcctcccaagtagctgggaccacaggcacatgccaccatgcctggctgatttttctttgtattttggatacagacagtttcgccatgttgcccaggctggtcttgaattcctgagctcaggtaatccacccccctgggctcccaaagtgctgggattgtaggtgtgagccaccacgcctggccttgttgcattgatttcttctcttatcattgccatccctttgctagtttgttaaggtaaaaggttagattatcaattttggacctttctctttttttttttttgagacagagtctcgccctgtcactcaggttggagtgcagtggcgcgatctctgctcactgcaagctccgtctcccgggttcacgccattctcctgcttcagctcccaagtagctgggactacaggtgcccaccaccacacccggctaatatttttttttgtatttttactacagacgcggtttcaccgtgtttgcgaggatggtctcgatctcctgaccaccacctgatcagcttgcctcggcctcccaaagtgttgggattataggtgtgagccaccgcacctggcctggacctttctctttttctttttttttttttttgagatggagtctcactctctcacccaggctggagtgcagtggcgcgatctcagctcactgcaacctccgccctctgagttcaagcgattctcctgcctcagtctcccgagtagctaggattacagatgcctgccaccgcacccggctaatttttttgtgtgtttttagtagagacagggtttcaccatcttggccaggctggtcttgaactcttgacctcgtgatccacctgcctcgtcctcccaaagtgctgggattacaggcgtgagccaccgtgcccagctgacctttctcgtttttttttgtttgagacggagtcttgctctgtcgcccaggctggagtgcagtggcgcaatcttggctcactgcaacttccgcctcctgggtttgtgtcattctcctgcctcagcctcctgagtagctgggactatagtcgcctgccaccatgctcagctaattttttgtatttgtagtagagacgggtttcaccgtgttagctgggatggtcttgatctcctgacctcgtgatccacccacctcagcctcccaaagtgctgggattacaggggtgagccaccgtgcctggccaacctttctctttttctaatagtattattcacttctgtaaattttcctctcagcattgctttagctgcattcctccctttttttttttttttttttttgaggcagagtctcacattttcgcccgggctagagtgcagtggcacgatctcggctcactgcaacctccgcctaccctgttcaagcgattctcctgcctcagcctcccaagtagctgggattacaggtgcccgccaccacacccagctaatttttttttgtatttttagtagagacaggtttttaccatgttggccaggctggtcttgaactcgtgacctcgtgattcacccgccttggcttcccaaagtgctgggcttacagatatgagccatcgtgcccggccccattcctcacattttaatatgttgtgttttcatttttatttagttaaaagtatattctaatttcccttatgagttcatatttcaccttaggttgtttcaaattatgctgtttacatatttgggggtttcccttattagtttctgctttgattccattatgattaggaaacatgttgtatatgatcttagttttaaaaaatgtatcaagattttttttttaataattaattcatttagaggtgggatctcactcttgcctaggttggacccaaactcctgggcgcaagcgatcctcctgcctcagccttccaaagagttgggattacgggcatgagctactgcacctggctgaggctgactttttgatgtcctagcgtacagtctctcttggtgcctgtcctatgtgtgctggaaaatatctgttaatctgtattctgctattgttaggttgagtgttttacaaacattaggtccagtcagttggttacattgcttaagtcttctatatccttagtgatattttttgtatacttctatcgattactgaggagtattagaaatctctagtaatcccagcagtttgggaggctgaggctggtggattgcttgagcacaggagttcgagaccagcctgggcaacatagcgaaaccccatttctacaaaaaaaatacaaaaattagctgggtgtggtggtacacgcctgtagtcccaggtgcttgggaggctgaggcgggagagtctcctgagcctgggaggtggaggctgcaatgagtggagatggtgccattgcactctagcctgggcaacagagcaagaccctgtcttgcttgagagaaagatccaactacagctgtgagtttattgtctttcaggtccatcatttttgaaattctgttattagttacataatgtatttaggattattaggtcttctgaacgagttgactactttatcgtatcaaatatccctctgtattcctgataacattccatggtctgaagtctttgtcttaatcagtagtgccactccagctttgttttgtgtttgcatgggtgtatttttccatctttttactgttaatctgtgtctttgtaactaaagtttatttcctatagacagcatatagttggctctttttttttttttttttttttttttttttgagatggagtctcttccttggttgcccaggctggagtgcagtggcatgatcttggctcagtgcaacctctgcctcccgagttcaagcgattcttctacctcagcctcccaagaaactgagactacaggcgcgtgccaccacgctcagctaatttttgtatttttagtagagacgggggtctcaccatgctgtccaggctggtttcgaactcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgtgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttacttttttttctactacctttagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgttttcctgttcttctagccctgcaactttaggaattgtcctgtctgcctttgtttcaaacttggagccagtgctacgcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgagttgaggctcaggaccatgtattttcaggccaggcgcagtggctcacacctgtaatcccagcactttgggaggccgcggtgggcagattgtctgagctcaggagtttgagaccagtctgggcaacatggtgaaaccctgtctctaccaaaatacaaaaaattagctgggcgtggtggtccacgcctgtagtcccagctactcagaaggttgaggtgggagaattacttgaacccgggaggcggagcttgcagtgaaccgagattgcgccactgcactccagcctgggcgacagagtgagactccatctcaaagaaaaataataataataataaataaataaataatccgtgtattttccattagctccatactttaacgtagtcatacttttttactttacctaagtgagaggaagtggcccattcctcctatgggtcactgattctcttctccagcctgtatgtacacatgagcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactctgtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgttgcctcttattcttggggtggacttggtaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacgccattctcctgcctcagcctcccgagtagctgggactacaggtgcccgccaccacgcccggctaaattttttgtatttttagtagagacggggtttcaccatgttggccaggatggtctcaatctcctgacctcgtgatccgcccgccttggcctctcaaagtgctgggattacaggcttgagccaccgtgcccggcccagcaacgcatattcttgaaacatccactttgaccaaatctcttctctacctcacaactcttgctgaattaactcttctttagcttcctagacgttcaacatctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggctgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggtatgaacctcgggaagagaagatcgctggaggaggagcgggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtcccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggccggcagggccgaagcctgagacccgggtctccccagctgcaggtgtcggcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggacgcagcgtccagccctcggtgggcactcaagcaaggtttgcatgctgcacagcaggtcggccaggaagcggggaggtggcagacagatctgcgcccccggccggcctcggcccccgctctcagctggagcactg

SEQ ID NO: 15528 - DNA, 14261 bp, Human
  misc_feature (1)...(14261): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcctgtaatcccagtactttgggaggccgaggcaggaggtatcacctgaggtcgggagtttaagaccagcctgactaacacagagaaaccccgtttctactaagaaatacagaattagccaggcgtggtggtgcatgcctgtaatcccagctattcgggaggctgaagcaggagaatcgcttgaacctgggaggtggaggttgcggtgagccgagatcctgccactgcactccagcctggtcaacgagagcgaaactccgtctcaaaaaataaacaacaaaaaatcccaaaaagacggtcttattttggtcctcaccatgcatgtgagaagagtgagggacttgtgccaccgttttacaaggtaaggccaagcctggtggagttacgggaaatgccgaggtcctttggcaagaggtagcctggattcagacacagatctgattcacagcgcagggccttgtagaatgagaacgtttttgatttggtatctccctcctattcaccaaaacaccctcagtgcatgaaatgcatgaaatatgaaacaccagaaactaaaaagggggagaagccagggcggatgtcccagctgcaggagtgggagccgctgctcgtgtgtttggggtctgttctgattctggagcctgcttcttccccttggcaatcatgacccaggacttggcgttatctgtgatcgcgtgggtaggattccctggcgggcgtggggatgtgagatgggaacagagctttctgtccctgccacaggaacatggcgctgctctgggggctcctggtgctcagctggtcctgcctgcaaggcccctgctccgtggtgaggctgggctgaagtcaaggtggggtggggtggaggggcaaaaaaaaacacgttgcaaaggagcaagagcgtggcgccaaggccaccacataggctcatacctttctccacagttctcccctgtgagcgccatggagcccttgcgccggcaggtactggggagtgaggagcctgtgatggggggaaggtcccgggggtctcacttggtggcttgggcagggaggggggcctgtgggaagggtcggtctccatctgcttgctcctttccgcagctaactagcgggccgaaccaggagcaggtgtccccacttaccctcctcaagttgggcaaccaggtacaaccaggtggggctggggaagagtgggcggggctagagggaggagggcccatcggcaggggtcggggggtgggggcgcgtgctgaggctgaggctctggagtccagaggccagaagggagagagggtggggaggaccgaaggtgggcgccaggccccagaatgccagtgccctccgtctgacgctccctcttccctggggctgggacaaggccctgctgtcctcaggcacaggggctgtgacaaggccttcaacacagaacctggagctgaccccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccaatggttctccgcgggcggttcctccaccagggtcacgtggctgtttggtaaaaatgcagattcctaggccggggcggtggctcacgcctgtaatcccagcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagttggaggttacagtgagccgagatggcgccactgcactccagcctgggtgacagagcaagattccgtctcaaacaacaacaacaacaaatgcagattcctgggcccccacccatctgtctatgtgaatcagatctcagggactgggccggggaatctgcttatttacaagtcctcctggtgattttttttttttttttgagacagagtcttgctctgtcacccaggctagagtgcagtggtgtgatctcagctcactgcaacctctgtctcccaggttcaagcaattctcctgcctcagcctcccaaatagctgggatcacaggcaccagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgtggggggtgaggtcacccagcctgtcagccacaggggtgagagccacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggtaggcgctgatggcagggagctccctcagtcctgccctgggtggaggagggtgagagcaaggggctgggcctctggtagcgagtaggggcgtgtctggctgtggagcctggagccctgggaacagcttgtgctgcctccgtgcaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtgcgctcctcctcctctcagatcccccaccctgtaggctgagctgggacgtgcaggcctttttgttttttgagacaagtctcgctctgtcacccagggtggagcgcagtggcgcgatctcggctccctgcaacctccgcctcccggattgaagcgattctcctggctcagcctccccagtagctgggattacaggcatctgccaccacacccagctaatttttgtattttagtagagacagggtttcaccatgttggccaggctggccttgaactcctgacctcaggtgatccacccacctcggcctcccaaagtgctgggattacaggcgtgagccaccgcgcccggccatgcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggtctgaaaagatgcaggaggggctgggcgcggtggctcacgcctgtaatcccaacactttgggaggccgaggcgggcagatcatgaggtcaggagatggagtcccatcctggctaacacggtgaaacccccgtctctgctaaaaatacaaaaaaattagctgggcgtagtggcgggcacctgtagtcccagctactcgggaggctgacgcaggagaatggcgtgaacccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctcagatcaattggatgccagctagcattccctggggtcttggcctccaccgctgtctcatccttgaatggattctgggtgggacaggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtcacccttggttgtccagcaggctgggcctgaggctgggaggtggggaagggagtggacaggctgtggagcaggcacagggatgggtggaggctgtctcgccttccttgcctccacgtcccctaggcaggcaactgcaaaaggtcccatgatcccccatcctacctggcaggaggactgaggctccaggctctttgaggtttagtaattcagtgaaaatatactgggcatttgctgtgttccagatactgttctaagcactagggtttttgtggagcatgagggaggccaggtctctgctcttaggaaggaggatacacagtgcaacagtgaatggacatcaacacaggaattccagacgctgggaagcgctgtggagggaaagctgaaaaagaaggtgattttggccgggagcggtggctcacgcctgtaatcccagcactttgggtggcccaggcaggtggatcataaggtcaggagtttgagaccagcctggccaagatttgaaaccccgtttctactaaaaatacaaaaattagccaggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggcgcctgtaatcccagatactctggaggctgaggcaggagaatcacttgaacccgggagacggaggctgcagtgggctgagatcgcaccactgcactccagcctgggagacagattgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagggcccatggactttggggcagcacagggaccaccccacggccatgtagccactcagggtctctgcagcccccagcctgggagattccacggggcgctcacacagtgctccttagaaaggaggatctgattggattggatttctcagcatcttgcgtggaacattctgattggataaacttcttttttttttttttgagacagagtcttgctctgtcaccccaggctggagtgcagtggcacgatctcggctcactgcagcctctgcctcctgggttcaagccactctcctgcctcaacctctcgagtagctggaactacaggcatgcaccaccacgcctggctaattttgttcgtttgtttgtttgtttttgagacggagtttctctctatcgcccagactggagtgcagtggtgcaatctcggttcactgcaatctctacctcccgggttcaagggattctcctgcctcagcctcccgagtagcttggactacaggcgcccgccaccatgcccagctaatttttgtatttttagtagagacggggtttcaccatattggccaggatggtctcaatctcctgacctcgtgatccgcctgcctcagcctcccaacgtgctgggattacaggtgtgagccaccgcgcccggccaatttttgtattttttttttttagtagagacaggtttcaccatgttggccaggctgatctcaaactcctgacctcaagtgatccgcccgccttggcctcccaaagtgctgggattataggcaggagccactgcgcccagctctgattggataaaattccgtgccaggctgtctcaggtgtggcctctcttgcttctagcctaaatgtggtccccttggcctgggtattgatccccgggccagacagctgtggctgagatggctgtatttgttagcttcccaaggcaagtgtgacacagagcacagccgcttctgcagggaggagccagaagccacttgggcagccctcctgggagggggctgtgggtgaggctggcccgggaacgcgtcctggcttccctgcagctcattctgaaaggccagtctgatccacctccccgaggctcccctttcctgcttcccctttcctccaggctgtgtcctgcgtactcttccttcatccttcgtctcctttccttaggccccgtcagcctttcttgtcctcaggccctctgcagacaggcccaaacagccagaacccggggcttatcctcccacgggcaggggttctccacacgggtactctgcctggaacccaaggagtcacagctgcaggaggccctcgagccctgtggtgtccacactgcttttgctgcagaatcccttcaaatcaaatcttaatggctgggcacggtggctcacgcctgtaatcccagcactgtgggaggctgaggcaggtggatcacctgaggtctggagtttgagaccagcctggcccacatggtgaaaccccgtctctactaaaaatacatcaattggccaggtgagatggtgagcgcctgtagtcccagctactcgggaggctgaggcaggagaatcacttgaacccgggtggcagaggttgcagtgagccaagatcatgccactgcactccagcctggacaataagagtgaaactctgtcttgaaaaaaaaaaaaaaagaggctgggtgtggtttacaggctcatgcctgtaatcccagcactttgggaggccaaggcaggtggatcacgaggtcaggagattgagaccatcctggctaacacggtgaaaccccatctcttctaaaaatacaaaaaattagccgggcgtagtggcgggcacctgtaatcccagctactcgggaggctgaggcagaagaatggcgtgaatccacgaggcggaggttgcggtgagccgagattgcgccactgcactccagcctgggcgacagtgcgagactccaactcaaaagaaaagaaaaaaaaagaaatcttaagccaaatcacaatatatttacacagctggcaaagtcacaagagggaggtgagggagggtggggcgggcagcactcggcagtggctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaacctctgcctcccgggttcaagcaattctcctgcctcagcctcccgagttgctgcgattacaagcgcccgtcaccacagaagcccagctcatttttgtatttttagtagagatgaggttttgccatgttggtcaggctggtcttgaactcctgacctcaggtgatctgcctgcctcggcctcccaaagtgctaggattacaggcgtgagcccccatgcccggccacactgctagaaactttaaaagcatctcattcggttacgtgtccgcctgcagtgggacaggtagtatgactccaccccactgtgaggaagtggaggagcagtggggtcagtcacacgcctggcaggatggccaggagccccattgtctgccttaggagcacctgctggccccacccccacttagcttcggggctttctgtcctcatgctcttcccttcccttttctgtaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggtaaggaggagggtgcgggcgagcccccgaggtcaggctgggcagggcgggtaaggaggaagcgtctggctggcagtggagctgagtcagagctgtcctgtgtcctgctcttttccagggcttcgggagcggggagagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgctgggtggagtggctcatgcctgtaatcccagcacgttgggaagctgaagtgggtggattgcttgagcccgggagtccgacaccagcctgtgcaacacattgaaactccgtccctacaaaaaatacaaaaattagccaggtgtggtgcatgctactggggaggttgaggtgggaggccctcttgaccccaggtggctgaggctgcagtgagccataattgtgccactgcactccagcctcagcaaaagaactaagaccttgtctcaaaaataaaaataaaggccgggcatggtggctcacgtctgtaatcctagcactttgggaggccaaagagggtggatcacctgaggtcatgagtttgagaccagcctggccaacatggccaaacccgtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggcaccgggagcccaccatgtacaaacagctgagtctaatggggtgggcagacgagcaatcacatacttactacagcataagcgataagacagagagggcttctctccagctcacctgggagaacactgaaaatgtaccttggttggactttagagctggggatcagggaaggcttcctggaggaggtggtgtttaagctgagtcttggaaaccggataggaatgaagcaggtatctgtgagttcaagctgttccctggccaggatctcagacaccctcccaagcagctccaggagcctgtgaggccaagggcagctctgaccagccatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggctggtttgatgtcaccgttctgggcatgggtggggacaagtgaggatggtggggaaggcagggaggcggccgcagggtggactgtgctgaggaaccctgggcccagcaggggtggcagcccgcgcagtgccacgtttggcctctggccgctcgccaggcatcctccaccccgtggtcccctctgacctcgccagccctcccccgggacacctccacgccagcctggctctgctcctggcttcttcttctctctatgcctcaggcagccggcaacagggcggctcagaacagcgccagcctcctggtttgggagaagaactggcaattagggagtttgtggagcttctaattacacaccagcccctctgccaggagctggtgcccgccagccgggggcaggctgccgggagtacccagctccagctggagacagtcagtgcctgaggatttgggggaagcaggtggggaaaccttggcacagggctgacaccttcctctgtgccagagcccaggagctggggcagcgtgggtgaccatgtgggtgggcacgcttccctgctgggggtgcagggggtccacgtggcagcggccacctggagccctaatgtgcagcggttaagagcaagcccctggaagtcagagaggcctggcatggagtcttgcttcttgcaaacgagccgtgtggagagagagatagtaaatcaacaaagggaaatacatggtctgtccgaggatgagctgccggagagcaatggtgaaagtgaagtgggggagggggcggggctgggaggaaaagccttgtgagaaggtgacacgagagcacggccttgaaggggaagaaggagggcactatggaggtcccggcgaagcgtggcctggccgaggaacggcatgtgcagaggtcctgccgaggagctcaagacaagtaggggacggtggggctggagtggagagagtgagtgggaggaggagtaggagtcagagaggagctcaggacagatcctttaggctctagggacacgataaacacagtgttttttgtcttgtcaagtgtgtcctttttatttttttgaaagagtctcgctctgtagcccaggctggagtgcagcggtgcgacctcggctcactgcaacctctgcctcccgggtccaagcaattctcctgcctcagcctcccgagtagctgggattacaggcacccgccaccacgcactgctaatttttgtattttagtagagaccgggttttgccatgttggtcaggctggtctcgaactcctgacctcaggtgatccgcccgcctcggcctcccagagtggtgtgagccactatgccctgcagcacttgtcaagtctttctcagcgttcccctcctctccactgcagctcccagtgccccagtctgggcctcgtcttcacttcctgggatccctgacattgcctgctaggctctccctgtctctggtctggctgccttcactgtaacctccacccagcaggtacctcttcagcacctcccatgaacccagcagaataccaagccctggggatgcagcaacgaacaggtagacgctgcactccagcctgggcgacagagcaagactccgcctgaagaaaaaaaaaaggaccaggccgggcgcggtggctcacgcctgtaatcccagcactttgggaggccgaggtgggtggatcatgaggtcaggagttcaagaccagcctggccaaaatggtgaaaccccgtctctactgaaaaatacaaaaattagctgggtgcagtggcgggcgcctgtagtctcagctactcaggaggctgaggcaggataattgcttgaccccaggaggcagaggttgcagtgaaccgagatcacgccactgcactccagcctgggcgacagagcaagactctgcctcaaaaaaaagaataaaaataaaaaaaaggaccagatacagaaaacagaaggagacgtactatgaaggaaattggagagcttttgggata

SEQ ID NO: 15529 - DNA, 9052 bp, Human
acagaggcactcacagaggacgggcgttcctcctgctcgctgaggttgcccggctctggcacagagtcatttcccataaacttgctttcactgtgctctgtgagtcaccttgaattctttcccgtgtgagatctaagaacccattcttggggtctggactgggaccctcttttccgacaacacttcccccacgcactgttcttgcagctttgttaaaggtctgttgttgttgtgtgtgagtccatgtttggactctctatttcccattgatctatgtgtccatttctctgccaataccacaatctcttggtgactattgataatagtgcttgtaaacttgggtagactaactctttatactttattcttcttcaaaatggctttagcaattgtagctcctttgccttgacatgtaaattttagaaaaaaaaatttctctatatatctacatatggtggggtgtggtggctcacacctataattccagcactttgggaggccgaggtgagcagatcacttgaggtcagcagttcgagaccagcttggccaaaatagtgaaaacccctctctactaaaaatacaaacattagccaggtgtggtggtgggcgcctataatcccagctactctggaggctgaagcagcaggattacttgaacctgggatgcagaggttgcagtgagtcaagatcgtaccactgcactccaccctgggcaacagagcaagacttggcctcaaaaaaatatatatatgtatatatgtgtgtgtgtgtgtgtatacacacacacacacacacatgtctatagctacctacaaaatatcttgctgagaatttgataggaattgcattaaatctctaggttgagttgaggagagctaacacctttgctgtgttgaagcttccagcccatgaacacattgtgcctgtcctttaccttaggtctttgatttcccttccttgggttcagagtttaagtcctgtccatatttggtgagatttttgcctacatgctgtgtgtgtgattacaaatcctgaatttccagtttcgggttctgtctactccttgacactgtgtgggaacacggtggatttttgtgcgattgaccttgctgacctcactcggttctaggaggggttttgtagagttcttgcaattttgtacctgggcaatgatgttatatgcgaatagagacaggtatacctcccccttcccaatctgcctgcctttagttaccatttcttgcctagctgctctggccggaatgacctgctctgatggatgggggagtgggagtggacacccgtgtcttgcctcaggactcaagtgctctccagggagtgagatgcgggctcgattgtaagttataaagtgatgcttccctgtgggaaaaagtacatccaatatagactgtaggacaaagtctgaaagtccactgcctcccatttccacccagtcttgcctgtgagtcagagagaaacagtgctaacaggcagtgtgcacctgtccagaggctggctgtttgagggacacaggtgtgcacacctggggatgtctgagtggaaggtacaggtcaggattatgaccgtgcagtcagtcacccactggcatgatgtctgtggcatcctggggcagccatggggctctcaggccctctgcctgccccacaggccatacccctgccctggacacagctgtcctcagtgctggcctctgacccaacattgtccaggagccccaacccagaaggtgctcccgccgctgccagcctggacccgacccaggcccctcccgcctgaggccctgccaagaactgcccagcccggacacagaggaggttcccgcgtggacgcagggaagagcctcccattgccccagtggaggaagctgcccaggggccaaggatgagtcacaggttcgaggaatcacatggcgaggctgtgggcggggatcttgtctgccctcctcctacataaggccccctgagcccacactgcctcagcatccctctggctccagagctcagagccacccacagccgcagccatgctgtgcctcctgctcaccctgggcgtggccctggtctgtggtgtcccggccatggacatcccccagaccaagcaggacctggagctcccaaaggtttgaggctgggggagcgggcactttactgtgggaggcctggggcgggtgggagctgcgggcaggcgggaagcccaggatctcagaaacctacaggaagcacagaatggacgccatgacgtcaggaagccctcagccctgctctccatctttagggtggcctctctggtttcccagcatcctaggtgactcattatttggactttggaacactcctgagttagcacacactggtcattttaagtacaggaaatttcatagcccaggatctggtagatagcagacaaccatccaatgctcactgtacccatcccagttagactcagccccgtctgcaccgggtgcaacgagagccatggtggggtgggaccgccgtgcagcccaaggccccctcagttggcagggacctggcactccatggccatggcgaccaacaacatctccctcatggcgacactgaaggcccctctgagggtccacatcacctcactgttgcccacccccgaggacaacctggagatcgttctgcacagatggtgggtttctcatcattgagacgggctgggcgggggctcagtctcccccctcaggggtccaggactgggtgggttgggcggagctggacttagccccaggcattttctgacagccaggggcttcactgtggcccttccatgagggtggggtggaaaaccagggctccagacgttccctgtccccttggatcccctgccccaggctctgggccaacagccaaccacacagtgcagccccaggtcagactgaggagaaggtctgggcggctgcgggctgcggtgctccttggacccggggaagttcccgtggtgacctgattttaggagtgacagtgaaggcaactccaattcaagtggccactcatcctattgtcaccacctttcagggagaacaacagctgtgttgagaagaaggtccttggagagaagactgagaatccaaagaagttcaagatcaactgtgagtgtccccaggccccaagggctggctcagtgctggcatgctagccacgctctcccagaggcggctctgctggggcatgagggagtggggcctggcctgtccccactctctctgcttcagggagtcagagtgtttactccggtcaacctgatgctgaccccagaggcatcttttacctggagggcaggggaagcactaattcttggcatgacatgactggatgtgggtctgcactgtgcccaggcacaggggacaggtgctttgttgcactgttcactctggcctcacaaaaggccagggaggctgcaggcgagcaggtgggcaggtgggcaggtgggtaggtgggtaggtggatatgtatacaggtgggcaggagggtaggtgaacaggtgggtaggtgggcaggtggctaggtgagtaagtggttaggtgaacaggtgggcaggtgagcaggtggttaggtgaacaggtgggcaggtggataggtgaacaggtgggcaggtgggtaggtgggtaggtatacaggtggacaggtgggtaggtggacaggtgggcaggtgagtaggtgaacaggtgggtgggtgaacaggtggccaggtgaacaagttggtaggtgggcaggtgggtaggtgggtaggtgaacaggtgggcaggtgggcaggtgggcaggtgggcaggtgggcaagtggctgctgttcccgtgggcctggctgcctcctgcgcactctggggctgcagctctggtcttaggctgagctcccaggcctctctgggggaagagagaggggcttacagcatgtccttggtccactgaattcttcctaacaatttgcaacattttgttctattttgttaattattatttttttaaaaagacagaggtggtcagggtctggggcctcttatcccctcatgggcacattttcccagcaaatacagtttgcttctcatgcttgggacttgcctcaggcctttctgaccctgcttgccctccccagaatcgagccactctccaaggtccatttcttctccctcctcccgcccctgtgccctgttcctgtgccatctcccgccatcctcacccgtacgtgacttctcagttggagtctctccaggtcacagcctccctgcctgccgtgtctgcctctccacggcacacctggcctctccccctcagccggggctccatggccctccacattgcctctcctcccctttcctccctggcttccctgatcatggtccacagcaggggccacgtcccatggtgtcagtggatgaggaagccacttagtgtggtgggatgtccacacacctgcacaggactctgctgagacggaggcttcatcttccttttggttcttctcttctttccccagatacggtggcgaacgaggccacgctgctcgatactgactacgacaatttcctgtttctctgcctacaggacaccaccacccccatccagagcatgatgtgccagtacctgggtgggtctcacagcacatgagctcaacgtgggtgagaggcagcagctacgtccgtggctgggaaccctggggagctgacaactggcttcctgtccacctcggtgcctgtgggctgactttttctttcttggttttttttatttgtttgttgtttgctttgtttttttgagaaagggtctcattctgtcactcaggctggagtgtagtgacgtgatctcggctcactgcaacttctgcctcccagattcaagcgattctcgtgcctcagcctccagagtagctgggattacaggcgcacgccaccatgcccagctaatttttgtattttttggtagagacggggtttcaccatgttggccaggctggtctccaactcctggatcaagtgatccacccgccttggcctcccaaagggctgggattacaggcgtgagccaccacgcccggccaggctgagtttttctccagcggttcatcgagtcctctgacaaagcaaggagctgatatagggccagtgggacggtcgccagtcaaggggctgggcttggtggatagattaatactcactgggcgtccagtcaaaacgccctgaaacctatgatgctgtcaaccaaacgaaggccaggaataccaaaatagccacataggcacagcccttccccatgtttctgagcacagtgtttcctctggggtcacacaggtgtcttcttgatcagcctcagccatgcttggtgagagccgggcactgggagagccaggcactgtgctctcctgtgacgctgtagacaccatcctaagctgtgcagaccccagcgctgcccagagcggagcagagggggccgggccaaggagtgggagctggggtcagggaacctggaggtgcagtggacagagccccggagaccgccctagggacctactccagaccaaactctgccagacctcggagcactggggcctccttctctgccctccctcctcaggcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaaggtgagctctgcctaggacacgcccagcctcagctggaggagaagctgcctctttcttagcccgagccccctgctggctctgcaggactcaggtcactcctttttggcccctcccctgttctcccctggccttctggggtgcagagccaccctgaggtggggtcctgccctctcccaccatcctttcatcccttctctagccctggggctgctgtgtccccagctgtctcttctctcgctgacacctccactgtcccatctcctcccacagagccgtgccgtttctaggtgagctcctgcctggtcctgcctcctgggtaatgtatcagcctcgcccactgtctgcggctgcctctctgggcccctgggacagaccctactgtgtccagttcagggctgaccctacaggaatgaactggggtctggtcttgtgattccagaaagccaggctgctgacgtccccattcacgagcccagcctgtgtcttgcagccattgtattagtcacgggcttgtgccctatagtcagacctcatgctttcttttggggttaggggtgttggttggaaatggtgggggctataggaggaggaaggaggatggttacatggaagggcatgagaagctggggacctgcaggtctcggtcccacgttcttttttttttttctttttttaagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaacttgtgaaatgtctagaacaataaaaccaggacactcatatcagaattgatgagcccagaggaaaactcatagtctttaatactgaaatgggttagcaagaaataattaaaatcaatgaatctgtaatgagctcttgttagaaaaaaaaaagcgttagaatgaggaaagtaagaaaatagaatgaaggaagataaaagcaaaaatgacaaaatcagagaaacatatcaaattcatgcacctgtgcccccaggtggggaggggtgggcatggtaggatttagctcacctgtcagaaacacccaggaaaaaaaattccagcaagtatcaatcaccacagattaagagaaaatagattaaaagagtcataagggattatgctatttgactccagaatatattttttacaatccaaaagagatgatttcaaggcaaatataagcatccaaaacagatcagagaagactggagacagagtaggtaaggacccttcccaaggcagacagacagacacagtcagaggtctgtgtcccagcccagcccccagcatcgagagcagccgggcaagcggccagggatctcctgctcctttcgggaacaggtgaaacgaggcaatgtgaagagtcgcaggcatggggagggggcaaagcttccacactcgtttctaatgctgggaaaatatctccatcaaaactccacaaaaccaggccctaccaggagtaactaggacttgtgaggcagtaaggaacgtccgcactgtctatataacaaacaggccattttaacccaggcatgggggctcacacctgtaatcccagcactttgggaggccgaggcaggcagataacctgaggtcaggggttcgggaccaggatggccaacatggtgaaaccccatctgtattgaaaataaaaaaaatcagctgggtgtggtggcggacgacctataatcccagctactctggaggctgaagcaggagaatcgcttgagcccaggaggcagaggttgcaatgagccgagatcgcaccattgcactccagcctgggtgacagagcgagactccatctcaaaaaaaaaaaaacccaaaaaaacaacaacaacaacaacaacactcaaataggccatttcatcctcatgactgcccatggggcagaagcccttactgtctcattgcccagctggtgggtggcacatggactggcagggagtctaatacccacacatgcaaccattgcacctgctggctccatcaccacaccaccctgtgtgtcgaagcaaacaccccgaacagtaccggtgcccctggaacccagtcacacggtgagagaatcacagaggcgtctacctgagcttcacccccggaagacatctctggacataattgtgtaattaaaggatcaagaataccatgatttctctgcagatgctggagtctgttaaaaacattaaaaccctttccctttaagttctctacaaatggacacagagtaaatctctagcacgtgtcattaagtgagacaaatgaggcaaagaggcaggtacatggtctttgctgactttcatacaagaaagaatggaattaagactgtccacacctatttggaaaaagacacaggaggaatgaatggaaattaatgagtatggtcatttctgaggataaaaatgcatgcagagggtaggaatcgaagccagccttttataagtgtaactttcatgcagttttaacttttgaaccagttaacattttatgtatttaaaatataaaattaaaacaaaaagtaaaaggcgacaagccataaaatgaaaacagaaacaaatgaaacta

SEQ ID NO: 15530 - DNA, 10903 bp, Human
tccttcagcaccgcggacagcgccaggcccagtggctcccgggctccctgccccgcacgacgcggcgggacttgggagccccgaaccctccaggggacgctgacctaggaggagcgcgtctcgcgccactcggcctggtggccgcgatgctgctggaaacggggctcgagcgcgaccgagcgaggcccggggccgccgccgtctgcaccttgggcgggactcggggtaagccccagcaggacactgaggacagaaacggcaagggcggcagaggcgcgaggaagggggtgcgtgcagggccagcggccaggcaaagaaagtcccgccgctctgcaggcgggacacagagatggaaactgcagagagtgagtttccagatcccagggtggcggggagggcctgacgctggcctgcaagagtgcgggacagcggttggagtggaggcccctagaaaaaaagggggcatcgcaggcacagctggggggcgatggggccgaccaaggggtgctaggttcccccggtgaccagtgcccgtcagctcttgcacacagcccggcccaggtctctggaccccacagcaggggacccaagcctgtgtctcccgcctgaaccaccctccccaagggccattccatcaccacggacgctgggaaataatggaggcattgttggagggctggccagatgccagcagggtgggccgcctccttaacctgccgccgccccttccccagtcctgccacacacgacccctgatcgcttcggcagcagctgacactcagccacctgcacccagcacagcccgcacacactcggctttgcacccgcgtgtccttgccctggcccttcttgggtaacaagtgctgtgcaaagtgaaggggcagaaagctggctgcatgggccactgctcaaaacggacacatcggacctgctgggagctaggagggagggactgtggtttcttgtgcccatccttctgggcctgggcccttaaagctcacagtccagaagccataggcagagtggacagagtattgctgtgagacccacagggagagggacctgcaggatggcatcagcccctggtcccccaacccttcctgtgtgtttctgcgcactgccagggcacccctgcctttgccaagtcctgtgctgccgagggccacccactgctgtgttcttccccgggtggctgcccagggctggtgctggcccagggccctctgggcaggggtgggtgcgtccctctgcctgcaaggacaggtgggttctggagagctcacctgtgtggactggggcaagaggctgaaatatcaggtaagggaccgtgttccaatggagccggagtgctgggggctggaaatggaaggtgtgccctggggcttccccagctcggcccctcacgacccgaggtcttggctgcgtgtccaggacacagagcctgttctctctcaaggattgcccttcctccctgagccgtccggggccgcagttccaggggtggagcccagaagcctgttagcatctgggatcggtccggcaccttgcggttccggtacgcagccctcggcgccacactcaccccttctgcgtttcgggttgagctcccgccgaccatctgctgctcccgaggccaaacctcagcggcgggaggaccctgctgccttctcgacccctctcccgggaaccttagccctcctggcgtgtgctccagctcaggcctctgcctctgggccgctccggcgcaggaagctgcggggccgggacgaacgctggcgggaagccctgacctgggccctcccttaccggtgcccgccctcgggccgggcacgcggggcggcctctgggcaccgcaggtcccggcgcaaaggcgctcagagtccgcagtggcccgggctggtctccgcgacccccggccccgccccgccccgcggccccgccccccggccgctccgccctccgctcggccagaggctccgggccccagggcggcccgcgggcgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgaggtgggtgcccgggccgagtggctgcaccggggagaccaggagatcctcaggcctttccgggcctggccgcggaggctggcaggagctagaggatctgggcgggagtgggcgcgaggaccccggaacgtccgcgcctgggcgcctcagcctgtatttgttgcagggcccctggcctgggttgtcagggagtgagtgaggttgtggcactgcgctgctccggccagggagctctcgggggtccagggtgggcttaggagacctctgcagcccggagccagctccctgggctggaggaggcgcagggagcagtggcggggcagtgaccacgggacaggagggtccccaagaaggccgccccagccggactctttccacgttccagcggaacagagtcagatgcaggggccaaggtcgagctgaactccgaccgtcggtctccccgaagtcaggtttcagcgtctgcgcccacagacacccgctcggtttatccccgctcagggcccgtctgtaggaaaaagcctctcttctccaggccccccagcttcctggtggcaccactctagctcccagcactttggttcttagggaacctgggcagttctcctcgactcccgggccagctggagccgcaggatggggaaggaggccccggagccagtggggagtgagagggaccggccggcgggaagggggttacatccaggctgtgggggctcgcggttccctacttatttatttatttttcgacggttcctgggaggggttggccgcgggggctggggggcggagagagggagggaggaaggaggactgcgcgcccgcgctcgggagagctggccggagcgggcgggctggcgtccaggctccgccgaccccgccatccctgacacaggagcccccgccagggctggagtcgccatgcagcgtaaggctggggtcgcgggcgcggcgcggggtgggctggggcggcttttgcccgacgcgggcgccggcggcgagctgcggccgaggcgctgtccggtccgcggtgctgaatccgcgctgtgtcggcctgtcgggccgccccgctccgagccgggtcctcgcctgcgatcgctgcccacgatggggaccccgggcgcgcagcgggtcctcgacgctccgcacccggagctgcggttttgccggatgcggggcgcattcatcgccggtttcccgccactgcgtggggaggcgcagcccagttttttccgccggaggtcgagggagccccttcctggtgtctctcacccactgggagatgggctggagccggcggggtccacagccagggaggcgggtgcaatatgtcagtaaatcccggtcccttcagcgggcactcctctcttccagagactttttctaagtgaagagggagtcctcagcccttgacacctggaaaacccgctcacagactcgaggctcccacagggcacccttggacctccccagtgtggttcctccagggggcctgcagtaccgaagtggggtgtggggggcagaagcagcgggaagccagacgtttgagtaactctgacggtgttgggggcacccacgcctgacacaaaggcagtggatcggcttgtccagtccactcataagtaattttgcggctgcccaatgatggggaaggcattgatatttaccccggaggcctgcagacagggccaccaggcagggcagccacatttgcgaggagtccctagaaagagtggccatgacgcttaacatgaaggagacccgatggggtgccccagctccaggtgatggtgaagacccgtttccctatgtttcctgccgggcttcagagagcagatccccctggggtggggttttcatttgagctccacatgcacccttcttggcactggcaacattttgtaattgagtattcagcctcgtgaaatggcctgggctgctttcttgctcacacacatttttagaccgatgtcagtttccccttagctcctgacataggatgcggtgcctgcacactcccggaacttgcggggccacttaagctggctggggaagagggtgtgtagggaaaggaggacccctcggcagccctgagtcctgtgggccggaggggagactggctcgcgttggggtgggaaggtggcttcactgcctcctggtctacgaggtgacccagaacttcctcgtgcccacagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagtgagccccgaaacctcacctcagtgtgggagcggagggcacgcctgccccagggactcctcccctcacaatcaccaaggccaggccctcgaagcctgcgtctctcgcaatcccagcccactcctgtcacccaggcagggcaccctgtggcctggccaaattaagggtggggcctctccatgggtgctccctgggtggctgggcctggctgggacatcagcaagtattatttggaaaaaaaagcaatttattacctaaatcacagaagcagtcattagagaagatacacccctatttgtaggattctactggacttagttcctccgaaattggtgatgttttagttcctaatgctggcacccagcggctctggcccagtggccttcatggctccagctgtggggtgtgagggactggccccagatgggtcctctccctccggattcaccttcccagatccagcatgggtcctgcaggcaatggcggctgggctccccgaggtctttctgagattgaggttcccttctcagtgggagtgggcagctctgccccggcggccaggctggcgaccaccctgcagggccggacagagccttcctccggggccgccttcccaggcagccgcttgccgctctccaacccgctcggggcgaaatgagcctcgcgcttccgcgctgagcccggccctgtgcgtcccgcaggcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgaggttagccgaggggacgacgctcccacctttcctggtctgaaaaaaatggggctgaggccacgcccaggggggcgtccggggaaattctctccccaagcgctcactaagggggcctgggctagggcggtgtaggcagcaggaagccgaggccgggaacggcggagtcacggacagacccgcgtcccgaaccgcttcgttcggtccgaagtgtgcggcttttcgcccctggtcggaattatcgccctaaattcttggccgcgaaggctgggccatacccacacccttagaataaaggggagcccgcggggaaatcagggtgcttggagaagggagccaaggctgaaggcgggggcgccgtggaggtgcgattttagggaaggcgccgcccccgcccccgcggcagaacccgccctccgccggcgccccctccaccccagcccgggtgctgcccgtttttgccaatcgctcccagcgcccgcgccttccgagaagcctgtggggcgggatgggggtgggcacctgaggccccgacgtccccgcgccggccggggtgggagggctgggggtccggccggggccggaggggctgccgcgcctcaccgctcgcccgccgcgcagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtcagcgctcgcccctgcttccctcccgcccgcggccttgggggcccccgcagagccgggcggccgctcaccccgccccgcccccaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccggtaggcggagggatcgcggagctcggggggggacgagcgcgcgtcggcggggtcgcaggggtcccagggagcccgcggatctgaatttcccatggagttagtggactccttaagttctactttcaaaagcatttcacttacagaacctgctcccccagcaccctccccgccctgggtggccactccggaccactgcttttcccctggtggggacacaatccctgtggcccgacctgtccccaagctgggcgcctacgggctttctcatgggggggtgggcgtgtccaggccgtctctctggctcctagcccttgcagtgatttttaggagaatgggcagtgcatttcgggaaagactgagtcgaagtcccagctgcttggagttgggggagggggctacctggggtcagggagagaaggttccatacccttctgtggggcctggattatttatttcattctccgggcaccggggatgctgcgtccccatctgttgatgcccatcctcagaatgtggacaagacactctcttttgggctgcctcgtgacccgggctactcactcagccactctggaactaaatatccttgtctgcaaaatgtgggtggtggtatctgtgcccccttcctaggctgctgtggggctggtcctgaaagcctgggccctggctgggctgttcctgactctgatcccaccaggcctgagacacctgggctgactcaggggtgagggcagtggaggggcaggggcagccatgctccaacagtagaaggggcctgttatgacctgtcatgtggtgtggggcagccactctttctccgacccaggggtgcctccgcctgcaggatgggactctgaggggccgcaggtggagggcaggcgctgactgagcctctgcttctgttgcagatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaatggaaggcccgcgtttttttgaggctgcgggggttggggagtgttgggtgtggggaacattctgtgaatgttgagaggcagccctggaggggccctgagtccccctagttcgttgcttgggctggcacctagtatgaatttgggctctctttatccctggatcttggccatgctcatgagcactggaaggaggtggggggaacagcccatcccttcctgatggaggggaggggttgcggtctccacaccctgtccctgggagaggcaggggttgggatgtccagagagcatgatgggggtgggaggtgggccgtgtgtgccattcacagcttgcagctggcaccaaccccaggacataggctggtagggtgaccaggctcatggtcatggaagtctctccagcttggattccaatcctggctcttctaacttgctgtgtgaccctgggctgggggctggaaccctctgagccctgcttccccgtccccaccccccaacccccccaaccccgccgccgccgtaaagagaagacagtgatgacagtcccctcagagggcagaaagaagttgtatgcgccccacccccacccccaggtaagtgctcctataggggcagtggtagaagcaggcagggttggcccttccacctcggccttccctcctgcaggaaggagggctgggcctcctccctgagggtctcttcctctgagggggtctccctggagcagagtgggggctggagggaggaggccccttggagcctgggctccctatttctcagtggacggggagggaaggtggaggagtccccatgcctttcatggggacctttgcactggcctcagttcccccagtaagggtgcggaggcccctccagaatgtggccaagggaagctgctctgagctgcagacttccaagtctctccaggaccagccatcttttggggggaactggttgggaccagttgtgtggtttttttttaaatggagttttgctcttgttgcccaggctggagtgcaatggcgtgatctccgctcaccacaacctccgcctcctgggttcaagcgattctcttgcctcagcctcccaagtagctgggattacaggcgcgcagcaccattcccagttttgtatttttagtagagacaaggtttcaccatgttggccaggctagcctcgaactcctgacctcaggtgatccacccgccttggcctccaaaagtgctgggattacaggtgtgagccaccgcacctggccaagggaacagttgtcttttaagggacgtccttttcatcgtttcgggatgtgtgtcaggcacatcctcttctgagtcccacagcggcctctcctctcaatctcacagaagagaaagctaaggcccaggaaaggggagggaagggaggagaggggagggaagatggagaaggggaggggagggaagagtggggagggaggagagaggagggaagaaggggaaggggagggaagagggggaagaggggagggcagcttgggagaaaagagcgggagactgtcctcagccatgcaggcttgggcaaccctggggactgggagtgatggggctggggcaaaggacctctgaggaacatcaccgggagaaggtctgatgtccagtctgccctgaccctgacctctgctgacctctaggcgcccacagaccccaggtctgcagggctaaaccgggcaggggctctggcaggctcctggacctgttcattccatgaacatttctagaattggctgtgctccgcccagcggcctctgcctgtggggagactgaggcccagaggaggaaaggacctgtcctggcctgggtccccccaccccccaacccccgctgtggggaaggaggggtgctgaccaggcggtcaacggggtttctgtcgggtcctcccaagccccacccgccctccctccctccctgtggcgcatggccttcgacccccaggctctggcagccacgctgtgtcta

SEQ ID NO: 15531 - DNA, 47184 bp, Human; identical to SEQ ID NO: 12647

SEQ ID NO: 15532 - DNA, 107421 bp, Human
atacatttttgtgtgcttatccagttatcctttagataaattccaataaatggaattgctaaagagtaaacatattttaaaggttttttgatacatagtcaaattgccctcctaaaatgtataaattagtagtgctcagtctgccaattcttttaactcttgttaatcatccaaagggaaaataattgtgtgtgcgtgtgtgtgtgtgatggagtttcgctcttgttgcccaagctggagtgaaatagtgcaatctctgctcactgcaacctctacctcccgggttcaagcgattctcctgcctcagcctcctaagtagctgggattataggcgttacaggtgcgcgccaccatgcctggctaattttttctatttttagtagaaacggggtttcaccatgttagccaggttggtttcgaactcctgccctcaggtgatccgcccacctcggcctctaaaagtgctgggattacaggtgtgagccactgcccctggccagagttttgtggttttaatcttttattactagtgggttcaaatctgttttcatgtatttattgtctgtactttttgtgaataagagtcaagcttcctatttttctattatgttaactttttcttcttgacatataactttatattaagtatattgtctcatatttgcactgaagacatttttcctaatgtggctttgcttgcggtggcttttcacacatttcttaattttatgaatcaaattgatcagtttttcaatgagacttaaaattccttctggggtgggatgcaatataatagaatgaaaaaggcagaggactttcacacaattcagtccatgatcttagtacctatgtctagttatcacctagcaggatgtggtaggaagagcactggactgggagtcagatcaccttgcctctctgggtccctacttcctcatctgtagaatggagataagaacgaaaactccctccgaggcctgtaaaaaaataattgaagagaatgcacataaagagctttcaccaggccttgtatattagaaaatcctctctgaatctcagcttttgttagggggagagggcaacacagacttttgtaaaactattttcactcacttgtatgtgagtctacgggaatgaggtggggatgaggaacctagaaatctaaccattcacccaacatctctgagaactgcatggctagagtcagaacttgggctcccatcctggtcctgcccatttcttggtatgcaaccttggacaagtcacctttacctcttccgtgactcagtttcttccacctaaaaactattatagatatatgacagaccacctgccctcattcccagccctgctgctgggcgaaggaaacgcttcaaaaacagctcacaaagggcggcaaacaagtctgctacggtgcagcctaccgccgaggggtggccccaaccccggcccccgcgcccctgccctgtcgcaggaacaatagctcccctggaggcggcgccggccgcggccgggggcggagctgtcggcgcgggagctgggggtgtgcgcggggcggggtcgcatccacccctcccgccggcggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcccgggagccgcgcgtccaaccagcccccgggtggtggcggcggcagcggcggggactgtcccggcggcaaaggcaagagcatcaactgctcaggtaggaccggtcggagccggccctaggtcttcccacccctccgttgccgcctccctcgtggtccctgcggtcggccgggctgggaaagaccccgtcgtgggggtcccaggggtgggcccgagggtgagcgagggcggagggcagggcgcgagcgtgcggtgtggctttgggaccggcgctggggatgggagtggccgtgggtgcgtccgagtgtgtcgagtggctgggcgagggcggcccggcgtgtggggaggcggtggggccggggccggggccggcgaggctgagcggccggccggggctcccggtgtggtcgtgggtgtgctcgcgggagcgtgtgtttgtgttgtgaaggctgaggggagggagggcggccccaggcagggatctgtgtgtgtgtgtgcagagtgcggtgggtgggagacggcgagggggctgggcggggtgagggcaggggagtgaccatgtgctgatgtgctggggagattcttccttaaggcactgggggtctcgggggtgggggtcgtgtggataaagggaacgggttgtcttgaggacgcggtttggcgatgcagagtgactgtgtgtgtgcgcgcgcgcgcgcgtgtgtgttctttgggttctgagatgggatctgggggcttagagtgacctcgggtctgtggatatgagcggggaaagtcccagggcccaggaagtgaccctgtgtttttgtgtgttgtgtgtgaagcctggggctcagttagtcaccctggggtatgcattgaagaggagggatgggtgccctatagcgaaccccatttatgtcttttcaaaggggaggaggcttgggagtcatcatcctgtgtagggtttggatgtagaaagaggaaattaggtctcagggaatgcccttgtgtagcaaggtgtaaccctgggttattaaagtgtggaaagagagaattgggtcccagggaagatgtcgtgcctgtgtgtgtgtgttttgcgggagggcctggattctggcagcagcggggagcaagggagtgacctctcccctctctccaaggccgcttgcccccccacagctgttggaaacaaagagcttgctgaggctttagtggataacactggggaggagggtcccagcagtaaagttcctcttcatttctaaaggggtcccagaggcgcacaaggattatggccctggggcaaagacaggcattcaggtctcattttttgagtggagggtcttcttggagctggcctagcagatgctagtgatcataagccacatccttgctaacttgcccttttatcaattctggagccttctcttgtcttctttaaaccaaggcggagtagggggaggagggaggaacataaggccactgggaatctgccggacaacctttatacttttgggctcttgaaggggcattatttctggaagagtgaggaaggagcaagagagtctcagcgcagatgcttatgctaccctaaatgaagcaagcctttggcccgctatttaggtttgaaggccttaaatcttttaataattttcatatggtaatgttttatgaggggaatggcagttttgagcacagtaaacaatggcatgtccattaaaagcatttccatccgtgaaaaaacttttctgttatttttctgatgttgaacgggatatggggtaatgctttattacataatcatactttaagaataaaaaccagttgtatattagagtgcctttttatgtaacaaatattaattatcaaacttgtaagtgatcgcaccatgtcaatatttttccagctaatgtgtcgcgggtatttgttcttgctaagctaattcgttcttagcaaaatatagtgtgtcttgatgggatgtttttgtgtgtactttctaacttgcatagttcaagttttaagaaaggaaataaaagaaatagagggatggatacccttgaggatgtgggttggtgatgcagagcgactgtgtgtgtgtgtgtgtgtgtgtgtgtgtgtgtgtgtgttctttgggttctaagatggaatgtaggggcttggagtgacctcgggtatgggcaggaaagtcccagggccggagaagtgaacctgtgtttttgtgtggtgtgtgtgcgtgtgaagcctggggctcagttagtcaccctggggtactatgcattgaagaggaggggtgggtgacatgcagtgtgggaaaaaggggactgatctaggggtcatggtccttgttaagcagctgtgtaatttggggcaagttacttaatttctcttagtttccattccttttaaaaaagagacttggatttagtaatatctgagtcttctttcaagcgtattcatcactgatataaatgtcaataaattaagctgatcaaataaaatgttttctagcagtaagatatacttgaataactgggtctaaagctagagttttaactaagtgatacttgtagattcttattgtaactttttaggatgaagatttgggaacgattcatatggaaaaaaaatttttttagttggtaagtttgagaaccatgttaatacagtctggacacacacatctgttaatgcagctcgaaattgtgcacagtttgtttagtagcttttattatctaggtatccccccacaaactgaagtttactctgtcatgtttttttttttgagatggagtctcactttgtcacccaggctagagtgcagtggcgcaatcctggctgactgcaacctctggctcctgggttcaggtgattctcctgcctcagcctccggagtagctgggactacaggcgcccaccaccatgccgggctaatttgtatttttagtagggatggggtttcacaatgttggccaggctgatcttgaactcctgacctcaggtgatccgcctgcctcggcctcccaaagtgttgagattacaggtgtgagccaatgtgcctggcctatttcgtttttttttttttttgagacggagtctcactctgtcacccaggctggagtgcagtggggtgatctctgctcacagcaagctccgcctcccgggttcgcgccattctcctgcctcagcctccccagtagctgggactacaggcacccgccaccatgcccggctaattttttgtatttttagtagagatggggtttcatcgtgttagccaggatggtctcgatctcctgacctcgtgatctgccagcctcggcctcccaaagtgctgggattacaggcgtgagccaccgcgcccggcctatttcagttttaaaactaaatacagccctcgattccctgtagatattcatttttggttttggaccatcatttcagcctactgtgagctttctggagctgattcggtcaggctgtgcgtgttgggtcactcacaggtttttttcacttgcaaatatgaagagcagttctatggcttcattaaattaatagaagttgtctagattgtgaaaaaggatggaaccctgcgacatattactggagactttctaccaacttggttgatgttgttacgttagtcaaccagatgttcaactagctatgcatcctgttagttgaatttaacagattttcgagcttctgctgttcaacattttcccattttgttcaccagcctattatttaaaagattctttcagattgtcttgttagattgttatgtgtatatatcatcctgtcatcctccctttttccattttagtaatcctgttaaataaaaagcacatgttgtatagcctgccttaataaagagctgatggtggctttctcattttactgtattcgaaaacttatttatccattttagaatttttcagcagttacatagcaggtttacccacagatgtttttctggatctgcattccgcctttttttttttttttttttttttgagatggagtcttgctctgtcgcccaggctggagtgcagtggcatgatctcggctcactgtaacctctgccttccaggttcaaccagttctcctgcctcaagcctcccgagtagctgggactacaggcgcacaccaccacgcccggctaattgtttgtattttagtagatatggggtttcactgtgttgcccattctggtctcgaactcctgagctcaggcaatccgcctacctcggccttccaaagtgctaggattacaggcatgagccactgcgcccggcctgcatttctccttttttgaaatttgagcatgtgtttatttctatttatttgatttctggtcttctggcaccttgtcaaggtagcttagataatttgtggtagtttttaaggcagatgtaaaagttttttcagcatcatggagtgtgagttatttggatcagaaagcatattcttttgaactagctctgtattctgttactgtcccctacccatgccacttaccttagaagctggtttccttttatcagatttctgacctccctagcttgaagatcatgcttcttgatgaagatgaagcatagggaattggccctgttgtctcttgatattgcatcttccctaagcaatgggcctttggtttatctcttcttgttctcaacaagacttttttgtttgtttgtttgtttgtttgagacaggatctcattcctgtcgcccaggctggcgtgtagtgacgcaatctcagcttactgcagcctcagcttcttgggctcaggtgattctcagcctcctcagtagttcagactacaggtgcgtgccaccacactcggctaattttttgtgtttttagtagagacagggcttcgccatgatgcccaggctggaacaagacttcttttgttgtcctcttgccccagttctccacttattctggactttagacttattgagattaaaagaaaaacttcgattttatatcttttttatttatgcttatttttttttaaagctaacttaacagaaagttcccagttatccaaagagaaaaaaagcttggaaatacatgacatatgtgaagaaagataaacttgaatttaggagaccaggtaaccttagactgactgactttgtttttcatttgtgaaatgaagatgatgatggtcctttttggctctgggatatttgagaagaacaaatgagactaaccatgtggggcatttctagcttagggaatatggttaaagaggtagaagaacatactgagagaccagtaagtggcatttcgtgatagatataaggtagagaatttgaaatgggttttaactagaagtgggtcctctggattattatatggtggtaggaatggtattaatggacgatataaatgtcagattatgagaagtgccttatttgtggcaattcaggattcttgggaataaaagtgagtttttctaattaatggggaatctcgggcagggcttttatcttctagatccctgttgtgtaaaatgtggatggataataattaatttagcaaaccttgattgaatactgcgtagtgtaatctaatatactggatgttaagggaaatatatgagaaggcttccctgctttcaagggccttataatcttatagaggtggttagcctcttacagatatatatagtggaagtttctgtttaccacatctgggcttgcttccctacagcagtccccatcaataagcatttattgagcacgaacaagataggattttttaaaaggggtacagttaagtggatttatatatattcacaaaattgtacgactgtcaccactctctaattccagaaaattttcatcacccccaaaagaaacctcatagctattaacagtcattccacattcctcgcctccccagtccctggttactactaatctactctctatggatttgcctattctagatatgcatgcaaatgggatcatatgaggtgtgttcttttgtgtctggcttctttcccttagcataatgttttcaatgtgcatccatgttgtagtgtgtatcagaacttcattcctttttatggccaaataatattccattgtatggataaaccacattttgcatatccatttctctactgatggatatttgagttgtttttactttttggctgttatgaataatgctgctgtaacattcatggacaagttttttgtggacacatgttttcagttctgttgtgtatgtatctaggagtggaattgcttggtcatatggtaactctgtgtttcacattttgaggaattaccaaacggttttccaaagtggctgcaccattttacatttctaccagcaatgtttgaagatcctaatttctccagcatcttctccaacacttgttattgtctgtctgtttgattttggccatcctagtgggtgtgaagttatgtatcaatgtcgtttttatttgtattttcctaatggctattgatattaagcatcttttaatgaatgtattggctatctgtatatcttctttggagaaatgtctattcagatcctttgctgggcttgattttgacatcttggagtaatcattcccttagtaaatcatactaatcagttcccacagcaagcacagagatgctcaaatgctaagttggctctcgtttgtcatttgatttttctgcttactaagcaagagtcagttgtatttgttttcaaacttatttataccagtggtaattatgagtataatttaataaatattactcaaatcgatgaaatatgaatacaaaaagttgtttttatgaaatgctttgaaaagacttgataaagacaagaagctgaaagaattgcctctgaacgaattaaattatggttaagacaactgaaacagagtggagaaaccctgtaaacttttggaaggatttcccagaaaacactgcaagtatttttaagcccctgttctacttaaaggaaaggaaaatggacattgtagatctaatggattatgggtgtgatttatctaaggaagtggggaactgtgtttggcagacttacactcaaaaaaaaggtcttggtgctacattgggaaatgaatgtataattatgtatttaagactaaaatggctaaaatagatatcattttaaatggtttctgccttaactgacttttttggttaatagatcaatgatcactcttgtatatgtttgaaaagaggatttccactgtacaaggtgccctgaggaagatacagatgtggtgtcatgggaatgtgtaattctgatttgtaggaatcaaaactggtttcatggagtaagtggcactcaagctgggctgtatggggagagtagaatatcacctagaaacaacagacgcacttttgcctgaggcctttgctgttgatgttcctttggcttggaatcttcttgtcccagttcctacagttgtttgctctaatgtcaccttcagtggtgccttaaattacagccttctccaccttccatccacaatgtctctctcatatcctaatcttccttcgtgctttttcttgctctaggacaccttttcctgtgtgacatactatacgttttacttgttttctgtctctgtatgtagctctatgaaggcagagatttttatctgtttcgtttaccactgtattgacagtgcccagattggtgtctggtacgaagttaggttcccattacatatttatttgtggaatagattaatggctgaatgaacatagaagctgaacatagatgaatgaacatagaatacctcttaggaagggtattctaggctgaaggaatagctttaggaaaggcacaaaggtggaaaagagaagggagtcttttcgaaatactaaattgcggggattaaggcaggagattatgccaccacattaaggtcttcaaggcccatctgaagttttggcatttggttcaaagacatcaagaagcttttaaagggtttgagtgacattatggttttagaaaacaaagtctgaaattggtgaagatggaatggagaagggaagagcctggcggtacgatgaaagataatggtagaaatgggaagaattgagaggacttgtttagcctgcacaggttttttgtttatttatttatttatttttatttttaattgttgttgttttttgagacggagtctagctctgtcaccgggctggagtgcagtggcatgatctcagctcagtgcaacctccgcctcccaggttcaagcgattctcctgccttagcctcctgagttgctggtactgcaggcgcataccactacgcccagctaatttttgtatttttagtaaagacggggtttcaccgtgttggctaggatggtctcggtctccttgtgatgtgcctgccttggcctcccaaagtgctggaattacaggcgtgagccactgcgcccagcctagcctgcacagttttttaaaaaagttacattggttgttagccattaaaaatctggaggtttcacttggcaatctatttttctgccgactcttcttcttcttcttttcttttctttctttctttcttttcttttttttttggagacagtatcttgctctgttgcccaggctggagtgcagcggcttgatctttgctcactgcaacctccacctcccaggttcaagcgattctcctgcctcaacctccagagtagctgggattacaggtgcacgccaccacgcctggctaatttttgaatttttagtagagacgggttttcaccatattggccaggctggtcttgaactcctgacctcaagtaatctgcccgcctcggcctcccaaagtgctgggattacaggcgtgagccaccactctggcctgcattctcttctaaacttggaggtactgtcagcattgggcttttatttccacattgcaaaaatcagtcagtgctgtctagtgaggcatgagctctttactttgcccagtcctcaaccagccagcctcttttattgatctttttctgcctaaacttctggatcttctgctagagatggtggggtgagttgtgatgctcttaatttgagatggagagcctgtttggaggagagtcaaattggtgtacattccctcattcctgttattcacaattatatgtttggatgggagaccttatttctccagtgcctaggtgttttggtctgaactcctctcctgcctgtactccttgtaacttccactgtattgttcttctttttaactctttccttgaatccacttcctcctttgtatttgaaacctaccctgctatctctgattataccattgtccttgaatcactctctgatgtttttatgtctatttttttttcttaattttatcccttaaactttcccttttgtctctttctaaattctttaggtggatatagatcattatgtttctttaactccattgtcatttatgataaaatttctctcattgttgtgaaacacatgaatttatatatgttacagatgggttttttcatgattttgcgttatggtctaagaatgtgtcatatggaatctctgggttttcatattaaaactaggtgcgtccaggcacagtggctcatgcctgtgatcccagcactttgggagcccgaggcgggtggatcacctgaggtcaggagttggagaccagcctggccaacatgatgaaaactcgtctctattaaaaatacaaaaattagccgggcatggtggcgcatgcctgtaatcccagctactcaggagtttgaggcaggagaatcgcttgaacctgggaggtggaggttgcagtgagccgagatcgcaccgttgcactccagcctgggcaacaagagagaaacaacatctcaaaaaacaaacaaacaaacaaacaaacaaacaaggtgtgtcattgtattctagtatgaaaacaaattttgtgaaagattcttctatccagaagagttatttccttgacttctcagtctccatgttatattaactattatttttacttaagtttactttattttcatgtaatttcaaacttagaaaaatgttgtaatagtacacccagattccccaattaagattttaccacatttgctttaagtctctctttgtgtatctactctttctctctctatcgtctgtctgtctgttttttttttcccctgaacttggctctgtcaagttggcccctaccaaagggagagggttaatttatgttttagttccatactttaaattttttgttttgtcatctcctcttaattaaatagttaaacttccacttataatgataggtttatttttcacagtttttcagtttttcttatatttttgttattctatgtaggacatatacattgaacattattttgtatcataatttgttgtactttttacctttgtatagagtagatttcaagtatctcttgaagttatcataggacccaaccttttctgaatttgtgtttatattttagtttttaggtgttgggatttgtctcccaatagagttatagatcattctgctttcagtggcattcaactcatttacattaaattaagtaattgatatctgtgctaccctccatcatcatcttttttctaaattgcacaatccagtgttttcgactatagtcacaaggttgtggaacattttcatctcctccaaaaggaactttacatttttttttttttttgagatggagtctctctctgttgcccaggctggagtgcaatggtgcgatcttggctcaccgcaacctctgcctcctgggttcaagcgattctccctgcctcagactctcgaatagctgggattataagcgcccgccaccatgcctggctaatttttttgtttttagtagaggcggggttttactgtgttgtccaggctggtcttgaactcctgacctcaggtgatccgcctgccttggcctcccaaagtgttgggattacaggtgtgagccgccgcgcctggccaaggaactttacattctttagcagtcactccccaatccccacctctcctcatccagccctaggcaaccactgacgtactttttttttttttttttgaaacagtctctatcctccaggctagaggacagtggtgtgatcttggcgccctgcaacctccgcctccccggttcaagagattctcatacctcggcatgagattcaggtgcctgtcactgcgcctggctaattttgtatttttagtagagacggagtttcactgcgttggccaggctggtctcaaactcctgacctcaagtgatctgcctgcctcggcctcctaaaatgttgggattacaggcatgagctaccaaccctggccatgatttactatcttttgctgtagatttgtctattctggacatttcatataaatggaatcatacaatatgaccttttataattggcttctttctcttagcatgatgtttttaaggttaatccatgttgtaggatgtatcagaatttcattccttttttttgactgaataatatttcattgtctcgataataccacattttgtttatccattcagtatccattcatctgttgatagacatttttttgtttttactttttgactattatgaataatgccaccatggatattcatgtacaagtttttgtgtaaatacattgtttcatatctcttgggtgtatgtattccacctaggagtggaattcctgggtcacgtggtgactccatgtttaacattttgaagatttgccaaactgctgtccatgtaaaactctatgtttaacatttgaggatttgccaaactattgtaaatggttgcagcatttcacattttcatcagctatgtgtgaacattccattttccacatcctcaccaacctttgttattgtcttctttgttataaccaaccatcttcatttaagttcctatttgttatccttcattttccctatatatgtggtttctttaatggaatttaaattctcaatttcttttaagctggattgggagataacttcaacctatttatcccccttcattttttacattgttagaaacattgtcttaacttaactattttctttattcatataattctattattagcttcttgagcatttaggggcttggcatacttctcatgtacttggaaattctatacttaaatctgaaaattctctccgtatatgcttttagtttattaggtaacttaatttattgtaattcctttgctactattcaaattcatctattttttaaaaagtatcatgtattttccatggctcagcagccttgtcattttttcagaagtcatttaaggttctaaagttcttaacgtattcttgtacctttaaaaactttggcaggttattatattttcaaccacagctcaatttctctctctctttttttttttttgcaaatattctgagtctgtcttttccatggattaaaaaagggaaaaaacccacaccttttttctttgttataagagcagtatataatctgtgtagaaaatttgaggaatatggaaaaatatgaagaggaaatctgggataattgccattctcttctttaatctcagtgtttatgctaaattatttcatttttcatcagaaaatttttgaacttgagttttgctctttttgcccaggctggagtgcaatgacgtgatctcggcttactgcaacctctgcatcccaggttcaagtaattctcctgcttcagcctcctgagtagctgggattaccggcgcgtgccaccatgcccagctaattttgtatttttagtaaagatggggtttcaccatattggccaggctggtcttgaacccctgacctcagataattggtccgcctcgggctcccaacgtgttgggattacaggcgtgagccacagcacccggcctgaacttttaaaaaaatattcatgttgttttgctttgcattttctgtttatgctggagccactgttgttcagaggtcagatctccttctgggatgttttatttttattttttgagacaatgtctccctctgttgtcaaagctggagtgcagtggcatgatggcttactgcagccttgaccttccaggctcaattgatcctcctacctcagcctcctgagtagctgagaccacagacgtgtgccaccatatccagctaatttttaaaaattatcttttgtagttacggagtctctctatgttgcccaggctggtctcgaactcctgggctcaagtgatactcccgcctcagcctctcaaagtacaagcatgaaccactgtgcctggctaggaatttttaagttcagtttatttttgccttgtcagctttcatttaatattgttttgcacgtgaaactaaactgctgatgttgctgtatcaattctgttgtttatagcccagttgatatatttagattctttattgttcacaagtcagctcaatcttttagtgtcctgtattcattttctatagctttttttcttctttctctttattttattttttaaaaaatttttaatttttatttattagtattttttgaggcagggtctcactctgtcagccaggttggagtacagtatcactatcttggctcactgcaacctctacctcctgggttcaagcaattcttgtgcctcagccacctgagtagctggaattacagctgcccaccaccatacctggctaattttcttctgtatttttagtacagatggggtttcaccatgtttgctaggctggtctcgaatccctggcctcaggtgatctgcctgccttggtttcccaaagtgctgggattacaggcttaagccactgcgcccagcctccttctctctctaaagtggtttgaggtgttttctaggtggtacacttgtgtttaccattgtttacttcaaggttataccataagcacatcctaattcccatttatttagacctagttttaaaaaaattattcaatgttttacaacaaaatttgtcggggtttctggttatggtagtgtctttttaagtttgtttttggtggtttcagccagagtaacagtcagttttcttcatagtttgcagtgttcttttataaggatctcttataaccattggaatcctataagggattattatactcctttttttttttttaaattctaggaaactgggattctcagatttagcacttggtcaagatcatatagttacttttacttaatcaaataattggaaccccaagtctggaactctttctaatgcaccagaattttgtgaagtctttaaaaaattatcttttaaaatcattaataccaggtttttcagtgccagtatgcaagttgctgtgtagattttcatctttgtgggtgatttccctgggttctggctacctcctattctacttagtgttgcagacactaagggatagtggttagaaatagaaccagaggacattgttcttgtgtttagattaattattgatttaaaaaacagtttaatgaaggaaatgtattgagtatacctgcaaaatcttatatatgtaaaccggcatatgtttcaaaataatgggattataactgtatgtatagttttacaatgtgttttttttcacaataggtcttagttgtcttttcatatcactacatgtgtttctaccaaagtctgtgtagtattatgtcaataatttaattcccaaaagatagacatttagattgttttctactttggttttacagaaagtgctgacgttaacaatcttggacataggtttttgtatgtttttcttttatatctgttatagtttcctggaaatgttgggtaaaaggataaagacaattaaaatggcaatgcatatggacacatgagaggttgtgccactatgtacttccacagttggtttgagtgctcatttttctatactttctccagaactggtgctaataaaaaacaatagtagcttacacttaatagagtacttattatgtgtattattattttgctctaagtgctttccatatctttaatcctccgtcagaattttgagataggtgctgttattgtccccattttgtagatgaagaaatggaggcataggtggtaaattactaagctcacacagctgtgataagtggtagagccgggatgctggacaaggtggtctgatgccagggtgtccctcttaaaaaacatattataatgcctgtttttaatttttttatttcaatttttccaaaatttaagcagcatgatttatatgatttaaaaattatttctattttttattgagataattttcataatgtaaaattcagcatgttaaagtatacaattcagtggttttcgtacatttactatattgtgcagtgatcatcactatctaccatctaattatagaacatttctatcaccccagaaagtttctacctgttaacagtcagtcccactactccacacccccatcccctggtaaccacatagagactttctctgtggatttatttattttggatatttcatataaatggaataatacaatgtgtagccttttgtgcctgagttatttcttttaacataatattttcttttcctttttcttttttttggagataagatctctgttcccaggctggagtgtggtggtgcaatcatggctcactgcagccttgacctccggctcgtgattctcctatgtcagtcccccagtagctgagactacaggcatgtgccaccacgcctggcagatttttgcatgggggtttcaccatgttgcccagactgatctcaaactcctgggctcaagcaatcctcctgccttggcctcccaaagtgttgggattacaggcgtgaggcactgcaccctgcctacataattttcaaggttcttatatactgtagcatgtaattgttttatttgattttaaaagtaatacaagtttgttgtaaaactcaattcagaaaaatacagaataatgaagaaagcttaaattctaccgagagataactgtggttcctattttggtgggtataccttccaggtttttaaaataggcattaaaaaaagtttgtgttacatacattttaaaaagcctgactttaaatgtgtcatgtcaggaaatgtagagatttttcatcattaattttaataaccgcaccataacagattcagtttatggtttgccaggctagtgtcagaaccccagagatcagaaacatccatgaggaagagagtgtcacagctctgagatctttggctaggattggcgaggcctggaaagaccctgggagacttaaccactcaactctgtacccaggccttttcttccatctgatcttacagtagtttttctccctgtcaccttgcctggagagtcctgatacaggcatttagaattaaagtaggcagcgggggaagattgcaggagtgggggtggaggattgacaggagcaatgtggtttaacaaagggtagttggcagtagtatgcaaaatggaatgaaaaatattggagtcagacgattgtgtggcatatgtgaaatttctttcgttaagtatagcttagagaagttttagccatctctgcagttgatgctttttaatattaatgtaaactgcttttggttttgtatcataaaatattaggtaaagtttctttttcctcctcatatctttatactagaagataactaatatgattagtaaacaagttgaagaggatttaatttctaatttttctgatttcctgggacttgaagtcaacatttgctaaatctattgcttgattttataccctgaaatgtattttcagtgatttgtgtcattagaggtgcccctcagattggttgggagttgaagtcatatctgggaaaagaaaaaaagtgaatatttgttgtataactacttgttttaggcacgattgcttttgaatacattatctaatcattacaatatcaaaggaaagtattattctaaaaggagaactaccacgtgaacttggcccttcctgatatctaaacttatgcttcgtctgtggtatagcaaactgtctctggggttgtctttgaaatcacattgaggtttttttttttttccccattaaataataaccaatatagaaacttgaaaaggggagaaatcactcattgtttaactgctgtaacaggttactgttaccggttttgtttattcctggctggattatcttatatgtatggtgtgtgtgtgtgtgtgtgtgtgtgtgtgtgtgtgtatgtgtgtatgtgtgtatgtgtgtgtttgaaatgagtttcactatattgtcccggctgatcttcaactcctggtccttctgcttcagcctccaaagtagctgggactacaggcctgcatcacagtgcctggcaggtttttcatataaaatcatagtctgtgtatatagttttgtggtctgcattttcactttaacattaataagcttatttccatattctataatatacatctttaaatagctttataatattccatagttgtaccacaccatttcctggtgtgcaatatttcaaatatttaaatattttaaatgtttctgctattttcagtatagagatcatggaattgttttgtaggcagttgggtacatgttcaagaacaaactggccttgttctgggagtgaaaccatccagcagggtcctgtcagattggattggtttgcttttctgaaaaagggcagatttctccaaatactactaacatctagacagtcagtataaactcatgacaaatttttttaaaggacaaggtgaaaagtttgaacatattctgtggggagtcaatacagaatccagtagagatgaattaaagttttccacatgttaataaggccttagggaacattaatttataggactttccccagcagtgctctgaagactggaaatagcactagcaaaaacagatgacatggctttaatatggttgggaaaaccaggtttgaagactcgaagtggtgggtgtgaatgtgaatactgccagagaatgaacaaaatgagatgacacatgggatggttgaaggcagaacatttactatacagtagggatccttttgtcttggtcccataagaatctggtagttatttggttaattgagaaagttatttaaagtagggagtcacaaaaatgattcataagtgcatgtaacattttattttaacatacacatatttattaaatattttgaaagagggcctataatttttctttgagaatagtttctttccttttttttttttttttgagacagagtctcgctctgtagcccaggctggagtgcagtggcacgatcttactcactgctacctctgcctcctgggtcgcagttcaagcaattctcctgcctcagcctcccgagtagctgggattacaggctcgtgccaccacgcccagctaatttttgtatttttagtagagacggggtttcatcacgttggccaggctggtcttgaactcttgacctcatgatctgcccgccttggcctcccaaagtgctgggattgcaggcgtgagccaccgcacctggcctcctctttcttgaacaaaccacttgtataatgcattgataacaaactccagttttaatccctttaaaaaggaagctaaagacttgtggatgcagaattctaaatgcaactgtaggttttttttaaaaagtagctcaccttattcaagtctttgagtttagttttcatagaagtaatttattttcactcatatgaaatgttgaaatcacataattgtagtaacaactacataggctgggtagctgactcttgaagcacaagaacagctaccttggttggagctaaagtgctcatggatgttctagagagggcctagtagccttgagaattcattgtgccataggcattgctctgtaggttttatagagaatgacacactttggttaatctggagagttgattaagttggagataagttctaagagtgttattgacacggactgggcagtaggagaaggaaaaaggagtgggtaaatgaaaagaggtcagaaaattggggggataatgaagactgtttggttacaaggggaggccagaagtgtcaactgctctagaagggtcaagaaaaggattggaggatttaagaaaaaagccactggatctgaggttgctttgaccttgaagaagaagagttgctataggaagaaggaggaagtgaggcctgctggaggttaaggtactattaaaggtgggggatttaacataaacttggaatcaatatatttaggttcctctactgaaatggagaatagctgtggcagtatgttgagatcttttgagattgccgattatttgactaattttccttgtagtgattgtgtcagagaattagatgtaaagtgtttgctttccctttactgtagttttcaactggggacagttttgcccccttcccccctctcccccccacaggatgtggttgcttatgtccagacaattttggttgtcagagctggtgtggtcctactggcatctagtgggcagaggccaggactgttgctaaacaacctccagtgtacaggatattccctacaacaaagaattatctggttccaaatgtcaatagtgcccagactgagaaaccctgagttctgttgtaacatctaatgaagtttatttccttttggctctccgtgagtgttagctaactcataagatccccaaaactacctttctttttaacggaagggtggtagaaaagtcgtatcattctggaaggctgctggatctcattttgaatcagagcctgaacctagttgttgctgccagaagttgggaatttgggcagctcaggttcatagaaagcagagtttctcccactagtgtgtattgtttctgagctttgaaatgttaatgaaattctcgagacaagttttacattttgagaattgtggggcagatttgcaacaagagcaaaatattttgttctgagcaactcttgtgagtacttctttgtgtaaaacatttctatttggagaattcatttttgagggccttagtaatggctcatccgttttactgaatttccattttggtttcaggaaggcaggtgggtaatcatcataatcattgacaggtagtagaatgtcctcttgatgcctggtactgtacagaatacttgaaaacaaagaacattcagaagatgatcccaaaatagattccttctgtattgggtttaagctaaggcagtgattctgttctcaaatttgttagaaatcagctgggtgtggtggctcatgcctctaatcctagcactttgggaggctgaggtgggcagatggcttgagcccaagaattcaagatcagcctgggcaacatggtgaaccccatctctacaaaaaatacaaaaattagctgggcatggtggtccacacctgtgttcccccagctactcagaaggctgaggcccagctatttgggaagctaaggtgggataatcgcttgagcccaggaggcagaggttgcagtgagccgtgttcacaccactgcactccagcctgggaaacagagtgagaccttgtctcaaaaaaaaaaaaaaaaaaaaaaaagtaaggtgtcagagcaccagcaagtcatgattctcttgataaattttatcatgtggtctctgatgtagcacaaaattttttaagaccattgcttagaaatatttatcttattaaatttacacacaatcattctattggaattatgtttgcatgtatcaatggtgtgaccagtggtggcttatatgataagggctttttaaaaaatgtattcatttatatacattattttctataatggtaagtctggaaagaggaaatccacaggcggtgtggtgattttatgattcctccatcttactgtcttgctcctggtctttctggtctgtcatcttttggctgctgcaactttaggcaacaggtttgctctccagtcaaggaaaaaaacagaggaagaatgaaggaggaagggacagtgcctacatatgaacacagagcgagggaggccaagaaatgtaggttatttagttgggtactttgtttccctgaacaaaattggagttctctaagtaagaaggggagaatagatccaaggtaggcaattagcagtgactgctgcaactacaaaacaatttaaaatgtccattcatgagcttgtgacattcatgacctgacctgtgttctcatgaaacattgttggaatatttgtattagtattccttacctatttgttgaacatacttttgctgctagccagcaaaatatctgaaatcatctgatgttagttgatagccagcaacaaatctgaaataatctcagatattgaaggtttaagaaacataaatgaaaaaaccccttaaaaatgagaagttttttttgttgatttttttttcgtttgcaaatgagaaaatttcatatttgattttaatgaaggcacaccctagtccaggacaccagtgttcctgaggaacatggttttggaaccactgatattaatattgtttgtgtgtactatgaaattactttctctctgctttcacttacattgttttcctagataaaaacgttctcttttctttcctgtcttttactattactcatatgttgtgggcaattagaacattctatatttaaaatatcttttccaaattctttataatgatcctgtattagctttattatgataaaaaagccttattaatttttcaaggtcaatacaagtcttgttttttctgacactgcaccctatgcctcaaatccagttttgtcccctgtctcttgaactcctacagcagtcatagactgtatgacgcatttagccccttaattatagactgtattgaattcatcactaattgttgcatatattagcaagatcatcccgttacatttttttcctgtgtgtccaaaattcttagcatagttttaagtacctagtagatgcttagtaatggctttctgatgataaactaatcacatttatgcatgaacacacatgaaactagcatggatttgatagcaagatatgcataaaataaaatatgactaataaccagagtaatcagaatttcatgacttttacccttacctattaatgatataggacctctagcaccctcataaatgcctccctccaagatttattccgggagtcaccaaattgtgtttgatgtgtgcccactaatgcattccactgctacatgacacctgtctttttcttcctgtgctgtttgctgcctctgcagttgcacgttggtacctcctgtcagatatcagaggtctgcctctttgcccgacactaccatctccttggtcttatgctatcctgctagatacattgctgatattcagggactgttgatgtgtcccagctcctttctccccatgtattatgtcttgtgtgagcatcaaagcagagcttatcacttcgtttttagtgaaaatcattctttagtttctttgttgtagctcctctgtctctgttatgagttcttggagctgggctggaggagcaaaccaagtctttagaagggactgtgctcaggatcacttctcttgttcaaggctgtgtttatgccaagttcttttttttgagacagagtcttgctctttcactcaggctggagtgcagtggcacgatctcctcactgcagcctcctcctcctgggttcaagtgatcctcccacctcagcctcccaagtagctgggactacaggcatgtaccaccatgcccagctaatttttgtatttttagtagaaacaaggtttcattatgttggccaagctggtcttgaactcctgacctcaggtgatccacctggctcagcctcccaaagtgctgggattacaggcgtgagccaccaggcccagccagtgggaccaagcttttctgcctcacattagcagggatgattattcccctaaagtattctgtagtccctcatacaaacattccttggggttaccaaatgtgactcctggtggcagggatggtttaggttctagcttgcaatccactgtacctgtaaagtacaacaggtaaaacattacaattcaagagtctcaaagtagcaaatcataactcagagtattatcttgcctcgcagacaaaataaaaactttacttattcttgttttttatgtctggttgtaatagaacccagtgtgaactttaagcctacagagaaaggagaaaagacaaatgcactgtatttcattagtcaaattgtgcagttcttatttctgtagcccctaaacttgattaagctcttagttgagcagatattgtacattcttaccctcttttacagggcagttctttattaatattttgttatcttccttttgtctgaagatgtgtctttgatagtaattggaaccagaccttgtccaagttcctagcagaagtgtgggtagatagggggaaaatccctatacctaggattgagcctcaagagctaaagcaaggtcaagggggaaagggaagagacagcaaaaatggggaggtaaggagaaccaaggacataaagcttccacagccagggtgatgaggaatgaaaagatggccttctctacctggaatagtttgtgaaacagtaagaataacaaaatgcttgtgttagctttctcttgctttaagtttccactcatgtcttttttttttttttttttttttttggtgagtgcttgagctttaatccagttctgtgcacctgagatcatttaaggaaaataattttttgtaacccagaaatcatttaagaaagataatttttttgtaacccacctagatgtgatcttgcccttgtgcagtacttagttgacagtgactactcaagtaggtactgttgactgtcaactccttagggattcaggtacttgattgccagctcctcggagggtgagctaggagtaggagacccaagacaccactgcagagcagtgggaataaatggggtagagagaggtaatgaaatatcactaggacagttgtcaccggacatagaattcccttgacttagtttactgagtcctgctttgaaatctagaaatagaaaacaaccaggaatggggataactggagaaatgctcccttagatctctttgccgggacctcatcatgatctagagatacaggagtccttgctcttttcccagagagtcttagcttttgagcagcagaatcaggagttaatctaggactctctctgctcccagactcatgtattcaccactacactgggatggtttttttttttttaaacagtcatttgtttattgtttgcctaagtgcatttgtttttgtaagctctcattccccatacaaagtatatgaaaattgcattgtagtgattttcacccactttcactgattggcagcttcaagcactaaccttgaagcttaatttgatgcttaatgttggagcaggagcaatatgaccacagaattctggtattgttgattggctctgcttgctttggtagagtcaacttaattcagtccattaaaagttttaagtctagtaagattttgaatctctttaattctgtgtacacaaatgctccatattatttattgtatgaaattcagattcactgttcttttgtagttaaaatagtttgcctagaatgaataatgatcacccaaaatttattctgcataccaaaataattaagataatttttatctcatttaattaatattactgttaattctcattagccttaaaagtaacttactagaaaaataacctaaaatgttaaataagaaatagtaagattgctaccttaaggccttagaaggcaaaatggaaaaattccacagatttacctttggaaattatgttaagtcctgaaattttgagttctattttgagttacttttaggctcattactatgcaggattctgtttggggaatactgagcattttgtgtcttacagaatttctttttgtatagttatgtcttattacacttctgaatgggggggctcaatacattttaaggactttttcatacacacacacacacgcgcacagacacacacacgtaataaaaagccaaatatatatgtcaaacaatttttttcttttgcagaattaaatgtgagggagtctgacgtaagagtttgtgatgagtcatcatgtaaatatggaggagtctgtaaagaagatggagatggtttgaaatgtgcatgccaatttcaggtgaggaaacccagcctattttgaaaagttttatattcttcgtattttataattctaaattcttcaaattaaaaaacctaaaacaccttgaaccccataaagaaattggggtcacagcccctcagttcttttttgtcagatgatgccctgttatttgtatcttccatactgcttgcatggaattgagaggacagattgacaataatagatgtgacaattctttgaaaaaaatgtcaaatttctatttaaatgtaaggtataattgtcactgaaaggaaagaggtacaggttgaactagagtctcttattttaaatgttggcatctttttccttttcttctccttctagtctgtctctttcccttccattcttatttgttgctgtctcatctcttcaggccacagaacttgactgacttggagactcggggtaagtcaaggttagagctcgaatagcaagtggaacctcaaactaagagtgtaaatatttttgcttttcagatgctcttttagttgtgattctgttgtctaaaaaagtaaaacaagggaaatagttatatttaattctttctttttattttctgtggttaaatggtaatcagacttcagaatgtttcttacaagatggtctctgatggttgatttgatatgaggcgaaaaaggaactagaattttttttccactcacaattttattctaaacgtacccaccatttgggttttgaggggaagaaagggcacagaaatcagaaacgaaagcataggagagttagtatttctggtaaccctgtgacctcaggcaaatttctgtatgagctcaggtaattttcttggcatcagtattctatctgaaaagtgaaggcacgtttcctacccttacttatgatactgtaaatgagaatcaaaattggaaagaaagcttgcatatgaaacatctttgaaaactgtaaaccatcaggtggtttattttaattaaaagaagtggagagtttaggtaaaggaggaagggtatgtaggtatactgttgtccagccagtttcttcatggttgaaaggggctttacattcaattacgtagaatgataggagggtttctcttgggcatttttatatcagccaccttctgccaagctttcttaggtagcttttggctggcttcagatccctgctgcctgttggctggagacatcatttctttgccaagagcacctttccatagagctctgcatagcatggaaggtgactttagccagaatgaaatgagaagtcggtgataatttgaactgttttccccctgaacctaatgtgtcatttttctctgactgctttcaagattttttccttactgtttttgactattaagtactgtggtatggtttttcttgaacttatcatgcttggggttggcagaacttctgaaatctatttgttactcagtttaagaaatattttgtcattatttcttaaaattttttttctgcttattatttcttataatctgggacttccatgatgtgttagaccttttgatactgtctcaaggtccctgatactctgttcatttttttcccaaattttttcctgttctttacattagataatttttattgatctgtcttcaggttcactaatcctttcttctgtcatctccattcttcccatccagtgagtttttaattgtagattttttatgtttagaatttacagtttctgtttacctgctgggatttcctcttttcattcactgtaagcatattttccttgagcatagatgttattgccgctttaaaatatgtctgctaatgtccatatctaggacatcctcaggtattgcctctgttgattgttttctcatgtgagaatggaccatattttcctgtttcttcacattagagtaactttgaatttatcctatacattgtgaatcatatgttttagagtgtgtgagttttgttatgttcctttgaagattattgttatttttgaaaccgttggctgaattcaaactgcagattctgccttacttgtggtgggcagcaacacaagtatcaattcatttcttttagcctcactggggctacttggagtctgccccatgtgtggtttaggggtctgccagaaacgtgctctgagtttatacgcggaaactgggactcccctcgaactctctcctttccgagatttccctctcactttttagtggctgtgattgtcctcaagtctgttatctggttcattaaaagaaaggtggtgggttttgttgttgaagatttagtcatcctgtgtggggaagaccggggctgttctcctcttcagctgctgtgtttccttaggttaaattccttgaggtggaattgttgggccagtggatactcatgtgcagattaacattatcaccaatagcctcatatcagatgtcctgtttcccctcaaccttttgatagtggattttgttggtccttttaaatttacaaatctgaaaggcaaaaacaatttttatttgcatttgattactagagaaattgaaaatgtgctgtatatttgttaccatttttttttgtgaattaatatttcatattctgtgtctagtttctggggtattttctttttccctcatgttgatttgtaaagacatgtgtatgcatatatacatactctgtgcaatacaatattggaatatatatatattgcttactatgctgagcatttgatattcattaactcataaactctcaagagaacctgctgctttgatttatttatttatttttatttatttattattattttttgagatggagcctcgctctgttgccaggctggagtgcagtggtgcgatcgtggctcactgcaacctccgcctcccgggttcaaatgattctcctgcctcagcctccctagtaactgggactgcaggtgcatgccaccacacccagctaatttttgtgtttttagtagagacgggatttcaccatgttggccaggatggtctcgaactcttgacctcgtgaaccgcctgccttggcctcccaaagtgctgggattacaggcatgagccaccgcgcctggctactttgatttatttttaaaaagagtaatgtatgcccatagtaaacaacttgaacaatataagaagatatgtagcaaaaaaagcttccactccagactgtcaactcttctcaaaggcaacatctgttacttcttgcatttccttctagaagtattttgtgtgtatataaatttgtttaattccccttttaaatattaaatcatttaatagtatttatcttggagattgttcctttccaggaacaatagattccaaagaactctatattttaaagaagttatcctaatttcatttttttgtttttctttttaacactatgtatttttaattgacaaaaataattgtatatcttagtttcattttcattttgtttatattttagacacaaagaaatttcagattttcaccttatatttatctgtctttttttttgtttgagacggggtctcactctgttgcctaggcgggagtgcagtgacacaatcatagcttactgtagccttgacctcctgggctcaaatgatcttcccaccccagcctcctgagtagctgggacagcaggtgtgcatcaccacacctggctgattaaaaaaatttttttttgtagcgccaagacctctaggttgcccagactggtcttgaactcctgggctcaagcagtcttcccaccttggcgtcccaaagtgctgggattacgggtatgagctgctatgcccagccctgcttttcttcattttttgagaaaagtatttccctgaaactctaagattataaagaaatagcctttttgacgttttaaaaaatatacttgaacagctagaaaatccttccatgatctgtctgaattccttgcatttttaccttgtggcaaagcagggaaggaaaatatgttgggagttgacaccattagacatttatccagtgcttacttgtgctgggtatgagactagatgctgaggatgtaaagatgtttaaagactggttccttgccttgtaggagcaaactgcctcagggcttacagtatagtttgatcttgctgccgagtgaaccttcctttgaccattctgccttcctttataagattataaatctgttcagggtagacttaggttattgccagcttaaaaataatgacctgacatgcccattaaacccttctctgctggatgctttagcagtatctttcaattcattttaaaaacttgcttatgattcagcatgcttttagtgctaaatagaagctttctgggacattatttaaatacattttaacagataacaggattttaaataaaaattcaaattgtttttttttttagtctgctaataagagctattatcttgccacacatataaacaaagccacttttgctaatttggtatatagaaacatgattaatactgcatctttccctgaaaactttgtatagagtacagtctatgactttttttcctgttttctttcttcatctttgttctggcattctctgaactatgtgtctttcttcctgtatttatcaatgtctgctcttgctaggtgccatgccctcttattagaccctttattagtcacagttctccagagaaacagaaacacacacacacacacacacacacacacacacacacgaatgtgagagcgagcgagcaataaggaattagctcatttgattatggaggctgagaagtcctacagtccgtcatctgtatactagcccaggaaagccagtggtacaagtccctatctgagactgaaggcctgggcaccaggagaagatcgatgtcctagcttaagcggtcaagcaaaaggagagaagaattctattcagttcttcagtggattgaatagtgcccactcacactggggagggcagtctgctttacttgatccactgatgcaaatattaatctcatctagaaattccttcacagataaacccagaaatgatgtttagtctgggcaccatggggcccagtcaagttgacatagaaaattaatcatcacaaccttgttattattttctacttgctgtattcagcatagttcctgacacacagtaggtacacaataaatgcttgaatggatgcagttccagagtcgtacactgctccatctttctaaactacttgaaatagctggcaacatcatcacattcttctagctaaagaaaaggtacaggggagagttcttcctcccaacaagggtggcaatatagaggagcagactttaggttagacttagaatccaccatcagtgcataagtcagaaatcgcatgttgttaaaattgtccaaatcccataatttgtccattagcataattagaggcttccaggagagacccatggaaactgagaatgaccaacagcaggtctacttctcccatctcacactcactcctaggtatatgcttgtgagggtgaatttcagagacattaagtcctctgctcagtgtcaccaagtgacagatggcaatacaccactgacttaacttgagtgtgtagtggttaaaatacatcatatgggaggaattgtggctcttccacttattagtgactattggcaaatacttacgactgagaaatgatactagcaatagcaaaatagctaatgtttattgagaatgtaccatggtcagatagaaatgccaaaggtagattatcttatttaatcttcataacaactttgttaggtaggtagtattataatcaccgttgtacaccattgaacatggtgatggtgctagcccatagtcacatggttggtgggcccaggatttgaattcaaacatttttggctttatagccttagctctaagcattcaaccatgtgcttcacatggtttatgatatttaagttaggacacttaaagttgtagactaatgcttcctggataaaaaatgtgaagattctcagccctatcagaattaatgcttcattttaatattcagtttctttactatccttagaagaaattcacggataaattaacctacataaacacatgattaaagaaatgaatttaatgcatgattgcaatgtaaaggagaaataaaagtaatttataataaaataaatatttcagaatgtaaatgcttaggtatgattaccatagaagaaaatacagtcatcagatgtttgtgtctgcttatgataaatgtttggattaaaaaaattaaaagcaggtcgggcgcggtggctcatgcctgtaatcccagcactttgggaggccgaggtgggcggatcacgaggtcaggagttcaagaccatcctggccaacatggtgaaaccccgtctctactaaaaatacaaaaattggctgggcatggtggtgtgtgcctgtaatcccagctacttgggaggctgaggcaggagaattgcatgaacctgggaggcggagatagcagtgagcctagattgcaccactgcactccaacctggcgacagacctagaccctgtctcaaaaaaaaaaaaaaaaaaaaaaaaaaaaaaacaactaaaagcaatttcataccaggagtacatgaaacaaaaatgtagatgtctagtagatgctagaataaaaaccaatattaggataagttataacagatcagactgatttgtagtattaaggaaagtcttgtcaaaattcctacatgaatagccagagagacattcagaagttgtgtggtacttgcttttgttgtatggaactgtcctttcctttgcagtacttcaggcatccttggaatctatctggtaaattacagtaatgtccgtctgtcaatgtgacaaccaaaaatgcctccacagggacagccacccctagggggcgatattggcacctttgtgaacacaacactacgttagaaagtaagcatttgttgaggaatgaagtgggattggaaagttcatagatttagcacttgatatcttggagctcatagtagtttccttggctaattgagtattgtataattacaaagtaacattgacttatgtagacatcatactaggtattgtgtaaattttagggaaagagaagaaagcaatgtgatccatgaaaaactggaggaatatatataatagggaggcttcctaaaataaaaatataattttaagaaaagttggtgtaagattctgctgatactgaatgtataacaaagtcgactaggttataaaatattttactagaagttgtttttaccagtgcttgacctgtggtagcatgccatatgtatgcttcataaagtaaatctgatcactttttaaaagtagataaatgataaaagtaagtcttgctcattgaagaaaaatagagaaatatggaaaatcttaaatagggaactgggaaaccatgaagacaggtaatgtgaaaaatttgttgacattttattccaggacttattttacatgtattcatttttttctaaatgggctataaatatactttattttcttgctatattttattttatattatcatattatttaaaacatttacagttagctttgtggaatacataatacgtttaaaaatagtacagaattcaggccaggcgcagtggcttacgcctgtaatcccagcactttgggaggccgaggcgggcggatcacagggtcaggagatcgagaccatcctggctaacacagtgaaaccccgtctctactaaaaatacaaaaaaaattagccggacgtggtggcgggcgcctgtagtcccagctactcgggaggctgaggcaggagaatggcatgaacccaggaggtggagcttccagtgagccgagaccatgccactgctctccagcctaggcgacagagcgagactccatctcaaaaaaaaaaaaaaaaaaaaaagtacagaattcccagaaattatatatgtgctttttgcctaactttgttagcttttcttgtcacacaatatattttttaaaggtaattcttttttacaattactatttttaaacttcagcttttattttagtttcaagggctacatgtgtaggtagatgggtttattgctgatcctgccacccaggtagtgagtatagtacctaataggtagtttttcagtgcttgcctttctccctctctccccactgtagtagtgtccagtgtctgttgttcccatctttatgtccatgtgtatccaatgtttacctaacactaatgagagcatgaggtatttggttttctgttcctcagttaggatattggcctccagctgcatccatgttgctgcagaggacattatttcattcttttttatggttgtgtagtattccttggtgtatatataccacatgttctttatcaaattcaccattgttgggcacctagattgattccatgtctttgttattgtgaatagtgctgcgatgaacatatgggtgcatgtgtctttttggtagaatgattgattttcctttgggtacctacccagtaatgagattgctgggttgaatggtagttctgttttaagttctttgagaaatctccaaactgctctccacagtggctgagctaatttacattcccacctgtgtagcattcccttttctttgcagtcccacaagcatctgttattttgactttttaataatagccattttgactcttgtgagatggtgttttcttgtggttttgatttgcatttctctggtggttagtgatgttgagcattttttcatgtttattggtcacttgtatgtcttcttttgagaagtgtctgttcatgtcctttgccctatttttaatggaattatttgccttttgcttgttggattgtttaagttcaaaaggtaattcttaatgactgcaatattaatttcttgaacagttatacttcaattaaacattgtcttgttagatattaagatttttaggttattgatattataaatttctgttggaaatggctgtaataaatgtttgtctacaagtttctgtcacattgatttctaaatgtgtaattctggatcaaaaactgtattcctttttttaggattcttgaaacatattctttaattatgttaccccaaagtagaaccaaaactggtgtagtgggatgtccacctaattgaattttttaatagccaattttataagttggaaatagcatctcatcttagtggacaaccctgattgctagtgaagatcaataatattttatgcattaactggccatttgtaatttttctgtaaacacttcatgtctgtctttggtcccgtttttattaatttgtatgatctattttttaagtaataataacttgtatcatattgttataacattttccccagattttaaaactttagtcatttatgatatttctaacatgtagatgttttcaggttttcctacatgcaggtccagtgtcatttctcaaacctgtattaccttttttcttcttcacctgtcttatttctactcatctttcagggctcagttcatattccactttctctgaggatgcttttcttgaatacttcagcttacaataataggtattaggcatcacatgcttactgatttggtacatgatctagctttgcagtattggttttttttcctactcgtatgactctctgacaagattgtaaggtttccaagaacagagatcatcctatatttctttgtgtcttctgtaccatttaccttgggactttgcctactagatgttttgaataatgatttttttctatttttatgattaggtttgaatgaataaatgaattttgataataataaaatgctattacataagtagcactctttacattgtcaataatttcctcttattaccttggtggtttttcatagcaagcaaatgaagtagatagagattttcattctcatttttttggatagttggtagttattttccttatgaatgtgaaaaaaggtatgaagaagtagcataattctttttaagccaaaaaaaaaaaaaaaccccagactattcagtagcgaagtatgtcataatgctatggtattgcattcatgaatgtgaaataaactattaatattcatgcctagttctgagaatttatttttgttgcttttgcagtgccatacaaattatattcctgtctgtggatcaaatggggacacttatcaaaatgaatgctttctcagaagggctgcttgtaagcaccagaaagagataacagtaatagcaagaggaccatgctactctggtatgtatgatattcttctgaataaattttggaaaatatggtggaatcatttctaaaagggggttttgagtcagaggtatatttccacaactgctgtgtggattggtggtggttgttgcggggagtaggggaaatcttttttgccctcatttcaggttgttgcttttcaaccccaggtggtcttgtatagacttatgttactccttactacattgttaaggcttaacactctttttatagggacttactttctttgcatgtcctttgccttatgatttgaacagtagacagaatgagctttgaggtggggaatgataggggatctgtcttgatgattttttaaaaagaggtgaggaaggtcgggtgcggtggctcacgcctgtaatcccagcactttgggaggctgaggcgggcagattacgaggtcaggagattgagaccatcctggctaacacagtgaaaccccgtctctactaaaaaatacaaaaaattagctgggtgtggtggcgggcacctgtagtcccagctactcgggaggctgaggcaggagaatggcgtgaacccaggaggtggagcttgcagtgagccaagatcgcaccactgtgctccagcctgggcgacagagcaagactccatctcagaaaaaagaaaaaaaaaaggtgaggaatttctgtagaaagtcattagcagtatcacagattgttgctttccaagttttttctctgccacctgttcatcccatgctgtttgtatttacttcatcttttttttccttccagaattggtagtggttgatttggggaactattaatgttattttcttgtgtttgtattaatgtttggggatagagatgccggtgaggtaacttgaattattatatcaaggttagtggtaaaggtgaaggccattcttaggggatttccacttcctttctttccctatatattacagtgttcagaaattctccattttactaaatgtgacaattttagggtcaactacaaagtcaaaggggacagtctccaaggctgttctcacttctgacaccagctgagatcaagaggttccccagctaaccctaggctcagtaatttgctagaagggctaacagactcactgacagctgttatatgcgtggttatgaagggagaggatacatgttaaaatcaaccaaagaaagagatgcccagaagattctgggaaggttccaaacatggagttgctgatttttctttcccagtggaggcatggacagagttaactcctcctagttacagtatgtggcagtgcacatggagtattgccagccaggaaagcttgcctgagcatcagtgttcatagttttttctttatgagactgcatctcactctgttcctcaggctggagtgcagtggcacgatcatgactcactgcagccttgacctcccaggctcaagggatcctcccacctccgtctcctgagtagctgggactacagacacatgccaacatgccaggttcattttttttttgtattttttgtagggacagggttttgccatgttgcccaggctagtcttgaacttgtgagctcaagcaatttgcctgccttggcctctcaaagtgctgggattacaggtgtgagccattgtaccctgatattcatagtttttattggggctcattatgtaagtataatttgatgagttggttgtgtggttaattgaagactctgggtccactaatactgtgacctgtaacccctactctactcttcatgattggtctttctagtgtaaccagccccaaccctaagacttagacgtggcccaacccccaacactaagttccagtgtggtcagcaccctcccttaacaaatatccttctatcaggtatgacgtaggttaccttccggaagcagagggaaaagacgagacctctcttgtaggaaggccaaattctttctatacacactaaaataatcacgtgcttggagaaattattatgtttttagtctagtagactatgatttggtgtggttcttatatacttctttaagtacattgtgtttcacaaaatgatctagaaattaaagaggaatatggaggttctttccagtctcaaattatgtttcacttatgaggagcatatgtctaagacagcaagtgttaacacctaatgttaaacattaggcagcaaagtggtagattgggagcactgtgctagggttacaagacctcgccttaacctaactccaacccttatttactgtgtgaccttggacaaatcactaagcctctctgagccccaattccttaacttgttaagtggatattatctcctggggttgttaaataaggattgaatgagcaaagttataagctgctatattgattttattttctgagtgggcagtgttttatgttatttggtcttttgtggatcctattccttgaactagaaatactattctcttttccttatttgaaaactctttttcttatgcttaaggttggtcttaagccttttctcctctgtgaaatcttccttctgtgacatctcctggcagagtttgtttataccttgggtgtatttctatacatataccatattgtatttcattcatctgacataagtacctccagccaaatcagtgctttctcagtggggaggtactgtcttacctagggatgtgtatcgtaatctcagggtgggacggaatcgtgtaggttggggcaatgcgtaccatttacaaaatataacatacagggagaattctaccttgttatcagagtagccacagtatttaatttatttaaggattctaaatgacgaaggtatgagatttttatatttattaaaagtagacatggtttgaaaaaaagattgggagtagtatcttgtgtactgggaatatgtcttatttatcattttattcctcgcatttaccatggtgcctggcacataatatgtaaccaatcattgtatgtggaatcgaagtaataaaggggtgttttcctaagaagagtttggtcataaaaacaattttgagtttcctccctcgctgtctttttttctgttccatcactctttcatttcctccttatttactcagagaaaatgtcattttgtggttgattaatcaaaattgaacataatttaagactttccataaaatcccatgaagattttacaatgggtactgcatacaatatatatttttctaattcctcctgtttctgtggtatctgggaatttgattattgtccgaaggagcttgaagggaagggaacaatattgttctgagtgttgttttctgctctagaggacaatttggagagctagcatgggttctttaggatccagggtatcctctcccctggcaagtgctagataaagcatcaaattcctcacttgctctctctgctttttaaaatgactctgtgctgatgattttacatcattaccctcttttcaacatgttctgtgctaatatgttggttcctttaggattatagaataaatattttacattaattgtacttgagactggcttctttctggtaactttgatgaaggctctttttaatttcactagcgacaagtcaggtaagtccttcggattggatttcctagaggaagttaattttattagtaacatgaaaacctcaagcctttggttccttgcttcctaaaccttggggcttttcttaccttttggcttttggtctttatccgcagatttccttaagaagatttttttttttgtagtaagacccaaagctcttttcctgcctttctaataaaagcagcttattcattatttctctcaagctttaacaaaaactaaaattttctcttatcttttaaatgagtggattaaaattaattatttatatttagccttttactttacagtatttattgtctttactctgtgcaaagcatctgggtatgtccttaatgggatacaaagatgtatgaaatatagatgattatgtatctaagcaatttatattttaagagcagcataaaataagtatgtaagaataaataagatatcaaaaatatgagaaaaggactctttgagaatggatatcacagttttatttttgataggaaattttattatttgataagatgaaatttccgggaaaaatgttcatattcattctttgtttttcttctcagataatggatctggatctggagaaggaggtaagtttcaagtacctcttaaaggatatttgcttttctttctttctttctttctttttctttttttttttttttttaaatcagctttgagatataattcacataccatataatttgccacttgaagtgtacaaattcagtgacttttagtaaattcacagttatatattcattaggatattcagagttatatattcatcaccacagtcactcttagaacattttaataacctcaaaaagaaaccatgcactccttagccatcactcctaacccaactctccctctcagctctaggcattcttgtttcttgcatttttctctggaagtttattgtcatactaaggggaagatgttgtagtttctgttaaattgaggttgcatcatccccacaagtgattttagcttggaccagagtatttgtaactctttcccataccttgctttcaagtttttgctcatcaggaattttcatggtacagggttaaaaactccagagggagttgtgcatagaaaaaggaagacttgcccaacaactctcgtggaatttagagtttaatttaaacctttaacaatttcctatctatgtttttgattttattttacaaatatatgaattatttctgttgtttaaaagattaatatttggtaatagcatataatggagtttaaatgatcagaattgagattgactaatctatatcatagtctaatgaggctataattcttaatgagtatgtactgtataccaaataatgtttgagatattatggggtacaccaaagaacacccacttcagtacaattcacacttaatgcaaatggaaactacagttatgatcctttcaaaactgcctgaaacctcactccatacgtctacatttcatagaatcttaaaatttcagagttggaagggactttgaaggtctcctggagaataggagaactgtcctgaggagaaattcaaggatgacagtttcagctaaaaaaaaaaaaaatgattaaagctttcaaacaatagaatttgaagtagatggacatgttcaagcagaagctttataatcaggtgtgaaggatcagataataaattccagatcttagagctggaacagattttaggcgatcatgtagtctagcccctgtggtcaggtattcagttaggaaactgtcattgtcattgttcctatattaaagaagtgagagttgatctcaagatttgcttatataatacaatattgggctgggcgcagtggctcatgcctaaaatcccagaactttgggaagctgagatgggaggatcacttgagcccaggagtttgaaaccagcctgggcaacatagtgagaccctgtctctaccccaaaaaaaaaaaaaaaaacaaaaggccgggcacagtggctcatgcctgtaatcccagcactttgggaggccgaggcgggcggatcacctgaggtcaggagtttgagaccagcctggccaatgtggtgaaaccccgtctctactaaaaatgcaaaaattagccaggcgtggtggtgggcgcctgtaatcccagctactcaggaggctgaggtaggagaattgcttgaacccaggagacagaggttgcagtgagctgagattgcgccactgcactccagcctgggggacagagcgagactccttctcaaaaaataaaaaaataaaaaaatttaaaaaagccaggtgtggtggtatgtagtctcagctactttggaggctaaagcgggaggattgcttgagcccaggaggttgaggctgcagtgagtggtgatcacgccattgcaccctgtctcaaacaaaacaaaacaaaaaatgctggatatcttgccctgaggatgtaggttgaccatttttaaaaaatttttttttgagagcatgagttagaagggctaagtggtttgccccagttaatatacagaccttagtgagctcatggtaactgtagtatttctgaatattatgatgttttggggcctcagaattacttaggatgataatccctggtatctgtttgggagtattcatgagagtttaggggaatatttctatttaaggacaggcagacaccaaaaattagaagttcggaagcattaccaaacaggcatggcagatttgtgtaccttttttaacactatctttattataagacaccccctgaggccgggtgtggtggctcatgcctgtaatcccagcgttttgggagactgaggtgggcggatcacaaggtcaggagttcaagaccagcctggccaacatagtgaaaccccgtctctactaaaagtacaaaaattagctgggcatggtggtgtgaacctgtaatcctggctactcaggaggctgaggcaggagaatcacttgaacccaggaggcagaggttcaagtgattctccaggctgagattcatccaggctgagattgcgccactgcattccagcctgagactccgtctgaaaaacaaacaaacaaaaaaaaaagacactccctgaatagtactctttttcaaaccaaattcgagggaaatcccttgaatgaactgaaatccttaagttgatttcagaactgatctccctggccagtttgagattatcaggatatgatccactctagttgagacccacaaagtgtaaggccctttcagtgtggaatgtgagctgagtttggggctggaggtatttagtgtttttatttttttcttttgcgttggagcataagagacctgcatacttttgtatctgcatatttttggctgtgctaagtgaccaagtagaaaaagaagaaaagtcctttacaaagagacccttttccattttaaaatttggagataagtatttttttttaaactctgaaattagtttttatgtagttagaaagacaagtatgaaactgatgtgaggaaaaggtgagagttacattcttttgtggtcaggcgcttatctgctgaccagctttgcacaggctgattgcaacaggagggtaatcacaggacttaaatgtattgctcctgtctcttttctttctcccttattcagtgttatatggtaatttttcttaaaaaagcaattcattatcaaacctactgtgtagttctgcctacatagtttaagggatcatttttcagcaccaaaacttgttttcctcacaaaatatgttgtactcagtactggcaacatttttgaacttcaagcattggtagattttggaagtgactgttttcaagagctcaggtacattttcctcagaaacaggataatgactgctgaaaacatgaagcatatctggaaaggatcccaacttttggttgtaaatttgatttttctttttaaacagaagaggaagggtcaggggcagaagttcacagaaaacactccaagtgtggaccctgcaaatataaagctgagtgtgatgaagatgcagaaaatgttgggtgagttggttgaggggaagggacaaagttatttagagattaatcatcagtatgattatattgtggaaaggtatcatttacctggttctgtatcttttgtgtgttttcaaattttttttttgtttaatgctagtctattgacttttaaattgatataatactatggctatttaaatcagtttaagtgttataattttagaatgataatccatttatagttttctggttttatctatgcttttcttcctccctgtagttttatagttttatgtattttataccaagtgcttttctcactcatgttcagccttcattaaggtaggttttgtagctgacagcactgtctgtccaatttcccattcattccctgtaagaaatggtgttcttttttagaacagtaaggctgcagacatttatcaacagtcatgtttgatttttcctttcatcagtattcttatttatttccaatatcattcttctttcattttcctgtggtgctggctttttgcatatttgattctaaaagctttaatgttgactttaggacctgggagcataaatggatcttcttcacttcctcagttttcacttagtatctattttaaaacatttatttccataagatatttgtgctttcttccttacttgtacatatttttggtgtgtattttccagttccgtatttattcagcccgtaactgcatattcgagcctttcactgaacagtaataatatgatctaattagcattaatgtccaaagttagttttgcaaattaagaacactcaattttcagtattatgtacaaaatcagctatttggatggcacttggtaaaattgtattaatttatttggtgcatatttcaaagtgggtgagaactggcaaaagacaagtaagttcaataataaatgaactcaacaaaacctgaatttactgtttctgcatattggtcacatagattgacccatgtccattcatttcattcagagtggtttgatttggaagaacatgttttccaaagcagatactggcctatagaacaatagagaaatgatgagcaatatggacttacagagagaactgataatagatattatgctgtttcttccttttattttgtactaatgatatggcatgatgaaacaccttaatataggtatatgtgtcagtatttttccttagtactcttctgtattagtgttcagagtcaaaatagctgtcagtgattgattggcttgatcaattggtctgtttttattcctttcgcggtgcttctattcatccctattttatacatttttctattatcatttttcatgcctaaatttaaaaagatggaggtcttttgcttagaattgaaacatattccatctagtctcagaagtggctccagatgtgacatctgcataataggctgggtgcaatggctcatgtctgtaatcccagtgctttgggaggcttaggtgggaggaatgcttgaggctgggagttctagacatctacatgataaaatacatatctttatgtaaacacctcctcatagtgtaatatgtagcctattcccaatcagagcaactctgttgtgtttactaaattaattttttgtgtgtctatttatctgagagcttgccaccactattgttgcagataccagctctaagcataaggaagtggacatagaccatggaagggcttaccaatagtaaggagcatgcaggctcttaccagcaggctaaggagcacatagacagtgacaagcagccaacgtcaggcaaggaaattgatgcaacaagaggaaaatacgaaggaagcagttggtatctttatctagaaaaaagtgattaagctaaagtgtttgatccttctatggaaagagacaaaaggaaatgttggtaatatctaatcttttagtctgtaaagcacttgttactgattgcagttgttttaacagtgtaaatgtatctcagtggttatttttttttaacttttaaatgggccatggtaccaagaaagttatatagtggttatgtaactccctcaaagcaccttccatgtgtttttcatggttgctaatcaggtgaatagtgatgtatctaaaggtaatttttacctatccagctgggccgtttaggtctggaaaatggaaagctgcagaaatatgacattagccattaagtcttgatttttatataaaaacctattatttattaagatgttacataatttccttattaaaagataaacttttagttattaagaacaaaagctcagtttaattcaagtagttctgttatgacttaattattatgaactgcattggaatcagagtattaaggtaggatcttaatatttatcttcaggcagggcgcagtggctcatgcctgtaatctcaatctcagcactttggcgggcagagcatgaggtcaagagatcaagaccatcctgaccaacatgatgaaaacccgtctctaataaaaatacaaaaattagctgggtgtggtggcatgcacctgtagtcccagctactcgggaggctgaggcaggagaattgcttgaacctggtaggcagaggtttcagtgagccaagattgcgccactgtactccagcctggcgatggagtgagactccatctcaaaagactaaataaataaataaataaataataaaaaatttatcttctagtctgatcctctcacttcaaagatgaaatcattgacgactaaagtcagagggtttgatgtgggtatattcttctaattaatagtacagtgcttttcttaccatctgcctctttctaattttcctttaaagaaaaaaattcccggaaggaatgttatcttctttttcctactttgaggactgctgcccagtgactttttttttttttttttttttttttttttaacaaaaacactgccctcttcatcagcctggtcccagctgtgatttctttacttctgtattaagtcttggtcactctgagtactagctgcttttaaattctgttagttcttagctggcatctagaaatcaaatgcctatttattgaatttcttaccagtgactttcagtcttttttgactacacttcatgtaaaaaatacatttgcattgttatccagcactcctgtttatatacacatggtactaataaatattaagtcaaacaaaattctgtggaatagtacttacctttattaaatgcaatgtactctaatattttctatcctactttcttataaaatactggcagtgaaccactaaattgacttcataatccactagtgattatgacctacagtttgaaaagtattgctctatagtaaactataatagatgtgtactgcatgtatttttttaggtgtaagtattcatttaaaattttattgtatgccagctgtggtggcttacatctgtaatctcagaacctttagaaggccaaggcaggaggattgcttgagcctgggagatctaggctgcagtgagccatgattgcgccactgtgctccagcctgggtgacacagcaagaccctgtctccaaaaacaaatgaacaaacaacccagaaaatcaaatgtactttgtcttttctcaatttgaaatgtctttcctgtcagaaaaaatgttatccaacctatctgatttgcaaagagcagctaaaatctttctcttgcttttaaaaattctttctcttgctaatggttgttaaaaaaatctggcattttggtgaggggataagtgataccgtgtaagttaattttctgctattaagagaagtgctttttttaaatttagccatttaaatagaaattgatttaaatacattacatacttctttgccttcttaaacagaatatacagaacatgtttaacatactcttacaattacatatgtagtatattacagttttcagagcattttttacacataatatatttttaagctattctgagcagttctgtttggtagtagagcaaggaagtattatcctgatttttataggtgaaggtgagttcagaaaggctgaatggagaaccagaacataggtctcatgacaaggaatcagtctattgtgttgtgcatgcacatgtagaggcccatgatgtgtggttgtttcactgctgcacttaaggcttcatttagctttgtgttttgggttctatatctgttttttaaaaatgttttcttctctcttgtaaggctgttagctgctgcttctagatgctgtcagtgtgccttggcaatgagtttgactgtagatgccctcaatttttaatttgcttctctgcttccctggaataggaaacaaacactcgcagaaactgtatctaaagtaagaataagttctaaatgtaaaataagagtgtataggttcttctgagtgaagtgcgtgaactttattcattgtatgtgttttatctgtcttgtctgctcaatggctattgtaattcatttataatttaaattatttttgcttctaagaggcttccccctcacccttccttcctgaaactcactgcatttctttgatggcatcgtgggctttgcttgggtttgtgacagttatgttcgttaatgcttacctttcaaatttatacctagaggtgtaggtggttgaggctccaagaaatatgactccccacataagtgggtttcagtatttcactgtgaccactgtgaaacagtgcatagacttcctactgggtcttaaaacttgaaaacagccttcctttacagcaacttgtatttcttaaaccacatattcttagtaccacaccccctcactttctaaacagtatttctaatctgtccaaggccgaagttattgttgtaagatagccatcagctgcttctctggatagtggggacacataatcataggactccttcacttcagtaccttttatatacccgacctaaatccctgcccaggaatggtgtgaggagtctgtagaatcatcaggcctaatgccaatacaggtgagttataaaaatcctccagttattccttttgaactttgtctgcaatgcactttatggaaatagcccctgctcttctgccttttttatgtcagtctcctttttagagatgctgtttccatttatccccctgagtgatataaatatctcagagttgctcagagaatcatacaggtgcagggtatggcagacaacatggataaccagtttaatccacctgctggacatcttagtcatttgtggtaccattttctgttttgatgcagatttctggtcagtactacaatatgacgagtctctccctcagaaggtgcagtgatatcttttctcttgtgtaaacagagtaatgctacacatttgtgtcctgcaatatatcctcctttctggaagcttcatgtactttttaaaacaagaactgaagaagtaccttttctatccttctgtttttatttcctcctaatcagagatggcagtaatttttgtcatttagcactgccttattctggatattttaaaactatttttaggtttagtaagtccctactgtagccccttagattataatggaaaaataattttgtgttgttttttaaaacacaaacattattaagcattattttatccaaagtataatctggatgttagtaatgacaggttcctttatccagaaatatcttctttttttttttttttttttttttttgagacggagttttgctctgtcgcccaggccggagtggagtggcacaatcttggctcactgcaacttccgcctcccgggttcaagcagttctctgcctcagcctcccaaggagctgggattacaggtacctgccaccacgcctggctaatttttgtatttttagtagagatggggtttcaccatcttggccaggctggtcttgaactcctgatctcgtgatccacctgcctcggcctcccaaagtgctgggattacaggcctgagccactgcacctggccttccagaaatatctttttgagaccaagtcttgctctgtcgcccaggctggagtgcagtggcatgatctcggctcactgcaagctccgcctctggggttcacgccattctcctgcctcagcctctcgaatagctgggaccacaggtgcccgccaccacacccagctaattttttgtatttttttttagtagggatggggtttcaccgtgttaaccaggatggtcttgatctcctgacttagtgattcgcccgcctcagcttcccaaagtgctgggattgcaggcgtgggctaccacgcccagcccagaaataccttcttaaagtcctttgacagttgccagtaagagagttttgcctttaaaatgcaaaactccgtctccccataatctcttgcaattttctgaatgcactgttattattgaacactttcttacccactttgcccctgttattccctgtgcctggagtcccattcctgtttatcagcttattttaactcctattcctccttctagccttagatgccgtgtgacttaggtcagattcaccacctcttcttataagcctaccttgcgttctcccacagttcctatgtgaccatattctgtgtccctccttggtcttgaaaaagcaacctctgcatagcactaagtagactgtgagcttcctgagggcagggactttgtcttgctgatttttgtcttgggtaaactgcctataaggttgggtatcttaggatggacccttttataggcctttgttgaattagtggcaatcgacactaggcctttattattcacttagagctgcttacagggtggttgtaaggatttaatatgtgtgaaaaagactagcgttgaatttgttgcaggctttattaggtgtttgttaaatctcagtaacttgacatgaattagtttaagccaatgttttcctaactgctaaataaacttactatattgagaagaaatggtactttctatatagggttaagaaaaaaggaagcaaaagtgtggatgtttttcagtaataataccattcagatgtgcacagtatttgatagatttcaaaggactttttacaaaatcttatttgatcctgtcagcagtgttttgaggtattatccctgttttaaagacttggagttgtgatttgccaaaattatagtgctaaatcatagaaggtattgaatttatgcattcatttatgtatgtatatatgcattcatgccttcgaaatttagtgctgccaattcaaaagcttaaaaaggctctagagtgaaaggtctcacttccacccctgttcccagtcactcagttgccttcactagagacagtcactgtgatctgtttcttgtttaatctcctggggtattttatgtatgtgcaagcagatatgtacatatattcttttatttaaaaaaaaaaaactaatggcatcacactatacccgtagttctgtaccttatttaaaatctttattgtaaaatgtatactgtatacaaaagtgtttaaacatacatgtgcaatttaaggaatacctgttaaaaactacctatgtacctaacacctagggtacaaaatagaatactgctattatttccagtaccttgtgttaacctagccatggaaggaaagggcaatagtgcccacttagagaggaaggcttacggaagacactttgaacagcctctgtggcagggtctggttttcagctcctcagagagtttacaaggttcccttttggggaagtcagtggacaaagccatgagtattggagtcacagggtcatggagaacgtaggctcactatagttgaggcatctgataggattctaatgtctggatcactggtagaaatgtgatcagaatggactgctctgctctgtgttgtttacttataatctccccatagctcatcttcagctgtcaggagtatgtcaattaactgagtgggttgagttgttcttgcagcaggacatggaggggagagcaggaacttcattatcttcatttatttttttttattatactttaagttctggggcacatgtgcacaacgtgcagatttgttacatagtgcatgtgccatgatggtttgctgcacccatcaacttgtcatttacattaggtatttctcctaatgctatccctcccccagacccccacccctggcaggccccggtgtgtgatgaggaacttcattatcttatggtcaagccaagccaactgcagataagaatctgggccaggcttacctgggcagtctatcttctgactgaaagttgggtacggtagcactaggcatcttagtaatgatggccatccacacagctgtctatagagttaaactatttcattgtggactgattgccctctacaccttgtatatagctgtcatcccaggatctcccttcagtgtggtgtcttttccaacaacaatcgattttccaactctctgacactacctagatgtccaacaattcaattaaattctgacagtaactacttggagttagcgcagacccacggttaaggactcagtcccataagactgcccccgctttataaccagctgcaaatgaggtccccaggctacccccacttctgcccagatgaccataaattttggagttcccatgccctagctaatttgctaaaacacagaacttgggaaagcactatacttattatttgtaaaggatacaaatgatcagccagatgaagaagtacataaagcaaggtccagaagggtcctgagtgcaggagcgtctgtccccatggagtcaagtgcaccaccgagatgtgctccctcaccggaagctcccgaaccccccgtattctgagtttttaaactgaagttttattatgtaatcgtgactggttaactcattggtcattggtgattgaacttaacatccaacccctgtccccttcccagaggtagaagaattggggtggggctgggaggcagaagttctaaccctctaatcactgtggttggtttttctggtgacattaactccctgccccctcaccccatgagtcatctcactagaatataagaactctcctatcactcaagatatgtcaagggaactctataccaggaactgggaacaaagaccatgaatacttattattataccactaggatcttcctagaaattcctttgtctctctctcctatatagggtactgtatttcttctatttttgcttctaacttcttggttttactctcctattttattacttcttttagcagcttcttatgaaaaggtgtgagattttaaaaacgtttgagaccttgtttgaagtgtttaggtatttttattccacacctaatattttattcagaactttgcaagtgcataattcgagctgtgagacaaatttccctgagaattaagaaagtgttgctttgttgtcttctagcttccagtgttgctgttgaagtctaaagccattctaattcttgatcttttgtatatgattttttttctctcttgaagcatgtagagtcttcttttggtctccagtgtagtgatatctcacaatgttatgccctttcctagatacttactgacttccattttgaaaaattttctttagttatttgatgatttcccttcctcttttttctatttttggtactcctgttacgtgaatgttgacatcctggtctagtctcattttatctttttttcccctgttttctgttttaagttttttttgctgtactttttgagaaatttcttcaactttatgagtttttcatttctgctgcaatttttaatttccaggagctcatttttgttttcagagtactcatttttagagcactttacttttataaagattgcagtctgttttggtacatatacgttattagttggtattctatctattgaaagagtgagattttcttttctatcaatcattcaggactcatggatttttcttttattcatttgtagtcaatgagttataattgttcttttgtttagtttttaatgttatgtggccttttaaaatgagttagggagtgtttttttctagtctctggatgactttgtgtaagagtgaaattatctacttttggccgggcatggtgcacatgcctgtcaatgctttgggagaccgaggtgggcagatcacctgagatcaggagttcaagaccagcctgggcaacatggtgaaaccctgtctctgctaaaaatacaaaaaaaaaaaaaaaaaaaaaaagggaaaaaaaaattagccgggcgtggtggcacataactgtaattccagctactctggaggctgagacacaagaatctctcaaacccgagaggcggaggttgcagtgagccaaaatcgcgccactgcactccagcctgggcgacagagtgaaactctgtcttaaaaaaaaaaaacaaaactacctactttgaaagattggaatggatgtgttcatgaattgtctttttaaaaaatgcctggatccggaggggaggagccaagatggccgaataggaacagctccggtctacagctcccagcgtgagccacgcagaacacggtgatttctgcatttccatctgaggtaccaggttcatctcactagggagtgccagacagtgggcacaggtcagtgggtgcgcgcacagtgcgtgagccgaagcagggcgaggcattgcctcactcgggaagtgcaaggggtgagggatttccctttccgagtcaaagaaaggggtgacagacggcacctggaaaatcgggtcactcccacccgaatactgcgcttttccgacgggcttaaaaaacggcacaccacgagattatatcccgcacctggctcggggggtcctacacccatatagtctcgctgatggctagcacagcagtctgagatcaaactgcaaggcggcagcgaggctgggggaggggcacccgccattgcccaggcttgcttacgtaaacaaagcagccgggaagctcgaactgggtggagcccaccacagctcaaggaggcctgcctgcctctgtaggctccacctatgggggcagggcacagacaaacaaaaagacagcagtaacctctgcagacttaaatgtccccgtctgacagctttgacgagagcagtggttctcccagcacgcagctggagatctgagaacaggcagactgcctcctcaagtggctccctgacacctgacccccgagcagcctaactgggaggtacccccaagcaggggcacactgacacctcacacggcagggtattccaacagacctgcagctgagcgtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaacaagttgaaaactttgaaaaaaatttagaagaatgtataactagaataaccaatacagagaagtgcttaaaggagctgatggggctgaaaatcaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctgcaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttgcagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacagagagacttagactcccacacattaataatgggagacttttaacaccccactgtcaacagtagacagatcaacgagacagaaagtcaacaaggatacccaggaattgaactcagctctgcaccaagcggacctaatagacatctacagaactctccatcccaaatcaacagaatatacatttttttcagccccacaccacacctattccaaaattgaccacatagttggaagtaaagctctcctcagcaaatgtaaaagaacagaaattataacaaattatctctcagaccgcagtgcaatcaaactagaactcaggattaagaatctcactcaaaaccgatcaactacatggaaactgaacaacctgctcctgaatgactactgggtacataacgaaatgaaggcagaaataaagatgttctttgaaaccaacgagaacaaaggcacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggacacaaaaaacccttcaaaaaattaatgaatccaggagctggttttttgaaaggatcaacaaaattgatagactgctagcaagactaacaaagaaaaaaagagagaagaatcaaatagacgcaataaaaaatgataaaggggatatcaccaccgatcccacagaaatataaactaccatcagagaatactacaaacacctctacgcaaataaactagaaaatctagaagaaatggataaattcctcgacacatacaccctcccaagactaaatcaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaacccttcctaactctttttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatggtcaagtgggcttcatccctggcatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgagcaaaaactggaagcattccctttgaaaacgggcacaagacagggatgccctctctcaccactcctattcaacatagtgttggaagttctggccagggcaattaggcaggagaagaaaataaagggtattcaattaggaaaagaggaagtcaaattgtccctgtttgcagacgacatgattgtatatctagaaaacccgactgtctcagcccaaaatctccttaagctgataaacaacttcagcaaagtctcaggatacaaaatcagtgtacaaaaatcacaagcattcttatacaccaacaacagacaaacagagagccaaatcatgagtgagctcccattcacaattgcttcaaagagaataaaatacctaggaatccaacttacaagggatgtgaaggacctcttcaaggagaactacaaaccactgctcaataaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaaattcatatggaaccgaaaaagagcccgcattgccaagtcaatcctaagccaaaagaacaaagctggtggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaaggtggattaaagacttaaacgttagacctaaaaccgtaaaaaccctagaagaaaacctaggcattaccattcaggacataggcatgggcaaggacttcatgtctaaaacaccaaaagcaatggcaacaaaagccaaaattgacaaatgggatctaattaaactaaagagcctctgcacagcaaaagaaactactatcagagtgaacaggcaacctacaaaatgggagaaaatttttgcaacctactcatctgacaaagggctaatatccagaatctacaatgaactccaacaaatttacaagaaaaaaacaaccccatcaaaaagtgggcaaaggacatgaacagacatttctcaaaagaagacatttatgcagccaaaaaacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcgtcattattcacaatcgcaaagacttggaaccaacccaaatgtccaacaatgatagactggattaagaaaatatggcatatatacaccatggaatactatgcagccataaaaaatgatgagttcatgtcctttgtagggacatggatgaaattggaaatcatcattgtcagtaaactatcgcaagaacaaaaaacaaaacactgcatattctcactcataggtgggaattgaacaatgagatcacatggacacaggaaggggaatatcacactctggggactattgtggggtggggggaggggggagggatagcatgggagatatacctaatgctagatgacgatttagtgggtgcagcgcaccagcatggcacatgtatacatatgcaactaacctgcacaatgtgcacatgtaccctagaacttaaagtataataataaaaaaaaaatgcctggatccgatgctatctttaagggactttttaagaacaactgatttagtttctttaatgattagtgtacccttaaggttctattgcctttttttttagaacttgatagaatttttaaaaagttgctcatttcacctagagtttcaaacttgctggcataatgttgtttacaataaccttttattatcttttaaatcataatccctgttgaagttttagtctgtttcattactgatactgctttttatctttttctctctcaggaaaaagcctgcagaaaagcttgcgttatcaatttgaaagtcttttcaaagaaccaacttttggttttactaacctctgttgtaacttttaaatttctgttgttatatattttccttctttttgtttttattggcttttttttctgttgttcattttctaactttttaaatggatgcttaattttattttttgtctttttattttatttatttattttttgagacagagtctcgctcagtcgccaggctggagtgcaatggtgcgatcttgtttcactgcaacctccgcctcctgggttgaagcgattctcctgcctcagcctcccgagtagctgggattacaggcgtgcaccaccatgcccagctaatgtttgtatttttagtagagatgaagtttcaccatgttggccaggatggtcttgatctcctgacctcatgatccacccacctcgaccttctaaagtgctgggattacaggcgtgagccaccactcccggcctttatctattcttttgagcaaaaactttgaggtgagggatggaaccaggaggctgtgtggggaagtgtttcaggaagagggaaagcctgaggcaggagtgtccctagtgtgttagaaagaaaagtgggagtgttagaagtggatgtggtagagtttcatgaaaaattttatgataaacatgaaaaatgccttttcatgtggtactttccatgctcagatatttatttggtataacagctgtaatgaatagagaaaacactggtctcagcccctcactggtttttttgattgggggcttttagatttccttcatattcagtttctgtattgataatttagaattgtcagggttagatgaggcaaatgtgactatacccacacagtaggtgcagagtaaatgtagttaaatgtttcaaattcagcatatttattaaagagtgatttctattcatttgagtgcacgcttctgtgctttgggcatcctgacctctgctacgcttggcagtctgcaaacagctgtaatcactataatcagtagtatccgtggcctctggagtctcatattttcctccttcgctcattgtttcactgagctggactttacttgaaatggtaatttaatcttctttctttgtatgccattgaaaacagtagtgattgttttcactgttgttagtcttagatgcagtggtaccatcccactaaggagcactgtctttttcatacatttgatcaaggcatttcctggttgggctgcaatacccactataaacaaagccacttgttaaacaagtgattacttgtttcttattggactggtatggtattttgctatgttgctgtcattttcttccgttaaccaccatttctatttaactgccatcccagttttgcccacttttatcctttaggtcagggtgggcaaaatttttttgtaaagggctagatggtaaatatatcaggcttagcaggccacatgtggtcttcaccatacctaaccttttagaaatgtgaaaaccatttttagcttctgggtgtgcaaaaacagacattggtctggattgacccacttctgtaattgccaggattgatccctactttaaaccatccatctatatatatatttttaatatatggtaaaatgacagcaaatagtgcctttattccaggttgagctgtacttttttcccccttgttgtttcttaattccttttatttttcattacttcttcattttcttcacctttgtgttttctacctgtgttctccatgaatcaagaaatctgttatgcttagtgaacgctttgttttatccctttccttaattacttaattcatatcatttaaaaatgtttcccattccttgggggcatattgaaaggaaagaagcacttcccttttttgaatcatcccttttattacctttctctcattttcctttactaataggaatgtaccagaaaatctaacggggctgaatgtggtggctcacacctgtaatcccagcactttgggaggccgaggtgggggaatcacttggggtcaggagttggagaccagcctggccaacatggccaaaccctgcctctaccaaaaatataaaaattagccaggcatgatggcatgtgcctgtaatcttagctacttgggaggctgaggcaggcttggacctgggaggcggaggttgcagtgagctgagattgtgccactgcactccagcctgaacgacagagtgagaccgtatctcaaaaaacaaaacaaaactaaactaacaaccacaaagaagaaaatctgttaactttaccagattgctctttgaaattaattttctcttctcctttgcctgatttgaccccctctattctgctactctttttcacattatttcactgcagcttacctgtagccatgagaataatcattctcaaatattgtttttattatattactcctttaaagacaaatatatatttagatttgatatttaatatagtaatttggaatttggagggtattttaacaaccttcttttattttgatatattaaaaaacaatatcttctgtggaaacgagcatgggctctctcaaatgtagcagtgtgtatatagatcaggctatgtttattagtgctagaagcgtgtcatttatttcaaaagtaaaactaatggtatgtgtatatcaagaccctattgagagaatctgaaatactgttctttagtagaaaaaaataggttaaatctttgaaagcccatttctaggggtaatgtcttggaagtttttatgcagaccttgcctcatattgtagggctcaaaaaattttttaaatgaaagtggttattgcatgattttttctcctttatgctgagccttgaggaagaggaactgggaacaaaaaaaacgaagagaaatatggcctttccttggaaaattgagcagggaggttcacaattaatttaatacctcaagttttgtttaagtaatgggaaaagtttttgtacatttgtttaatataaaaagcattgtcactaattttggtaatgggcaagccatgatctttgagcctctgaccttttaggattacatttcttttaagtcttctcttgattattaactttatttctgagcacatgctgagattgttagtaagagcatgctaaatctaacctctttttcttttttggtagtgtgataagattgtggtaccagggctgagccttaactgtaatgtatatgaatctaagcaagataatcatcaatctggcttggtatacatgacataggaagtcaggtcagatgatagttgcaattctagctggttaacaacttttcttaaaaggtgttcagtaatggattcatttttctagaaacattaaggtaggtttcttagaatatgacatatggctatgtttattttgttctagtcagtgcatttattgatgacttgtcaacattatgaatatgtcagtctgaagagatgttacatgatagaattagagtctaaaagatttcagcatgctgagatagataatctaaaatttgatagagataaatgtgaagtcctaaccctgggtttcagacaatagtggtgacatgttttgcaggccatacctacagagttgagtatatttaagaagttaagtatgtgtctaaagtttgatgtggttatcagaaaagttaatgcaatcctgcctgtgtttatgtaagcatagtgtccagaacagttaaggtaatagcttctctgtactgtagtccttgttttgttcttggcctcatattatgagatactgaatttggagggtgatgaggatgatataacaaatgaatcattgaattaacttcaggtgaaaacttatattcaatataatgattatctttgaatctttaaatgatattttgggcttattacatgtagattcagaggccagagttagagtcaatgggtggaaattaattaggatgcatgtttggggctcagcccaggtaataaccactcacccatgagatgtactgccttggtgagatagtaagctgtctattgctacagatgctctggcaggggcaatgtaacaataaggtcacaaatactgctgagaggagccctgcactgagtggaagatcagaatagatggctttctaaagtccttttcagcatggcattctttcaatatttgtttagatacagagatattatgactaaatgtttgtgcacatgttttcacccacgcatagtagattgttgttctctgcatttgtctgcgcccctcccttatccacaacttttacctgaactcaccttctgtgattggctaactttattttctttggttctttcacctcttgttttccagaaattaaatttttggtacaatatatattttttgactttagtgaatattcttatgaactaaaatttttttctgtttccttaatttttaaattataaaatatattcaaaagtgtatgaaaactaaaatatacacatttgattgaatgcgcaaaaatgaaatgagcttttgtgaatctacctcccaaggcaagaaacagaattttttttttttgagacagactctcatgttgccaggctagagtgcattggcgcagtatcagttcactgcaacctccgcctcctgggttcaaatgattctcctgtctcagcctcccgagtagctgggactacaggtgcctgccaccacgcccggctaattttgtttttgtagttttagtagagatggggtttcaccatgttggccaggatggtctccatctcttgaccttgtgatccacccgcctcggcctcccaaagtgttgggattacaggcgtgagcctctgtgcccggccagaaacagaattttagcagtacagtcgtctgtcagtatttggggggaattcgttctgatactcccctcaaataccaaaatctcaggatgctcaaagccctgcagtcggccctgaggatatggaaggcagactgtacttcagggcctcccatgtctctctctaattgcatctgtctctcacccacatgctatactgcattttgcagaaattattcccttcctttctttatattttatcacatatgataggtcccttaatgatctataatctggcttttgattgcttttgtattttgtataaatggaatcatgctatatgcattcttcttgattttctcgtgcacagcattatgtttttgagattcatttatgttgatgcacatagctgtagttaattcagttttactgcttgttgaatttgattgtttgcctgtaccacattcttttacagtccattttactttcgacgtttggattattccagtcttttgttttcatgaataatactgctgtgaatattctttcacattttctggtatacacgagtaggagatattctttttttttttagacagagttttgctctgtcgcccaggctggagtgcactggctcaatctcagctcatcgcaacctccacctcccaggtttaggtgattttcatgcttcacagcctcctgagtaactgggattacaggtgcctaccaccatgcccggctaatttttgtattttagtagagacagggtttcgccatgttggccaggctggtcttgaacttctgatctcaagtgatccgcctgcctcatcctcccaaagtgctgggattacaggcatgaacctttgagcctggcctgtgtgtaggagattttcaacggccttgccttgttgtgaagttgttgggcgtgtgcaagtctagtttttcgtcagaatgcctgttttccaaagttgctgtcccagtaagctttcctactgtgtccggaattggtgggtttttggtctcaccaacttcaagaatgaagctgtggaccctcgcgatgagtgttacggttcttaaagatggtatgtccggagtttgttccttcagatgttcagctgtgtctggagtttcttccttctggtgggttcgtagtcttgctgtcttcaggagtgaagctgcagacctttgcgatgagtgttacagctcttaaaggcagcgcgtctggagttgttcgttccttctggtgggtttgtggtcttgctggcttcaggagtgaagctgcagaccttcgcggtgagtgttacagctcataaaggtggcgcggacccaaagagtgagcagcagcaagatttattgtgaagagtgaaagaacaaagcttccacagcgtggaagggtacctgagcgggttgccactgctggcttaggcagcctgcttttattcccttatctgaccccacccacatcctgcagattggtccattttacagagagctgattggtccgttttacagggggctgattggtccattttacatagcactgattggtccgttttgacagagtgctgattgctgcatttacaaacctttagctagacacaaaaggtctccaagtcccctacccaattagctacacacagagcgctgatgggtgtgtttataaacctttagctagacagagtgctgattggtgcatttacaaacctctagctagacacagagtgctgattggtgcgtttacaaacctttagctagacagaaaagttctccaagtcacctaccccattagctagacacagagcgctgattggcacatttacaatcctttagctggacataaaagttctccaagtccccacccgatctttaggtagacacaaaagttctccaagtccccaccggattagctagacacagagcactgattggtgtgtttacaaacctctagctagacacagagtgttgattggtgcgtttacaatcctttagctagacagaaaagttctccaagtccccacccgacctagaagcccagccggcttcacctctcaatggcacttgcctcgggaccttgcggcacctagcctgggcactctggcagcccagagggagcttgttccctgatgaagcccagcaggcaccagccggccttgccaagtgcccacccgtgcctccccctccccacctccccgctagcagagggagctggctccggccttggccagccccagagaggggcccccacagtgcagtggcagactgaagggctcctcaagcagggccagagcggatgtcgaggccaaggaggtgctgagagcgggtgagggctgctagcacgttgtcacctctcactaccagcagaggatgagaattcccttagcttctcatccttgccagtacttgggttttgtccttgtttttgacttttgccaatttcgtgagtgtggatggtatctcattgtgattttaattttaagttttctgattcttaatgaggttgaatatcttttcacatatgttgttcttatatgtttcctcttttatttctatttttttgctcccctttcccattgatcacatatattatttaaaaaattgatttgtatttgtgtattctggatactacttatttgttgattatgtgggctatgtttatctttttgtttgtaacttgtcttcttattctctttatggggcattgtttatttcaaattcctcagtcttacgtttgatctcctaaatctttatagtttttgactttcacatttaggtcttcaattcattatgaattaaggaaatcatcaaacagaaaaggagaaaaatgatggacctctacccatttattcatcttcaaaagtctaattctgttacctttttttgggaagtatttaaagcaaatcccagcatcaagtcaccttacctgttaagatttcagttttgctgatattttttctgcttggtatatgagttgctgagagaggtgtgttaaaccctatcatggtggatttggcaatttcattttttttttttttctttctttctttcttttttttttttttttgagatggagtcttacactgttgcccaggctggagtgcagtggcgctatcttggctcaccacaacttctgcctcccaagttcgagtgattctcctgcctcagcttcccaagtagctgggattacaggtgcctgccactacacccaactaattttttgtgtttttagtagagatgggtttcactacgttggccaggtgggtctcaaactcctcacctcgtgatctgcctgcgtcagcctcccagagtgctgagattgattacaggtatgagccaccacgcctggccagatttggcaatttcttattgtggttatatcagttttcactttataggttttgagactatcttaaaatgtttagaattatattatcctgctgaataaaatatttttattattatgaagggattttctttaattcctataatcctttttgacctaaaatcttttatatctgatattaaatataaccatacgaggtttcttctatacccagggtgatgtatctctttcactctcctattattttgaacttttggtgtcatcattttaacatgtatcttacaagcaacatatagctggcttttgtatttttatccagccaactacctttgttatttaattggaaaatgtggtcaacttaaatatattgtgaatactgatattttttttcttattttatacttttgtcttgcttttcctttttctttttcctttcttgccttttttggattttttttttctctagtagttttgaagttatggattttccttcttgtaatggtaacctcagcaattttaacatgcatattcagcttatcacaatctaaatttccttaatgtcactgttctccttaaacacttgaatttcaattcctccaaacttgtgtgctattgttatcatcatgtattttaatttccagcttaaaaaaatttaaccacacagagcactgttgttcttatattacccatgtatttagacctttgttcttcattcgtatttgcatctcagactttccttaaaggatcatttttctattgcctttagaatttcctttactgacagtcagcaggtgacaaattttgtaactttttactccttccaagttacttttattttacccttattctcaaaagatttgtcttaaatagaattatgttctaccttagcgcatagcaggtactatttcacttttagctataaacaatttggcttcagtattgcttttgaaaagtcagtttccctgttattcttacttcgctgaaggtaatctttctcttctttctggctgcttttaaaatattctttttctcattataaaattccactatgatatttcagtatgtggatccatttttagtaatcctgtttgggattcattgggcttcttggatatttagatgagtatcttttttagttttagaaagtttgaagagaagttgctgagaatattttcctgcctcattttcttaactcctggaatgctaatgagatttttgttagatcttctgactcttccatctctctctctctcttttttttttttttttttttttgagacagcatttcactcttgttgcctaggctggagtgcagtggtgtgatcttggctcagcgcaacctccgcctcctggcttcaagcgattctcctgcctcagcctcctgagtagctgggattacaggcatgtgccaccatgcctggctaattttgtatttttagtagagacagggtgtctccatgttggtcaggctggtcacgaactcctgacctcaggtgattcgcccaccttggcctcccaaagtgctgggattataagggtgagccactgcgcccagcccatgtctcttttttaaatatgcaccatgtcttagactctctgctgtggtctggttaatttcctctgacctgtcttctaattcactaattctcctttagcttctctaatcagctgttaaatctgcccgttgcatttcttatatctagtaatatattgtttatttctggaagttctgtttggttcttttaaaaatcgatttgttctcctcatggtgttctattacttagttgtgggtatgtgactgaatgtgtctctgtgggctgagctgcatatttttctcagaattgtatctgtggaaaatcatttaggtctaggatgaaattgagtttctccagagaagattgcatctgcttctgtcatttgcctacagcaggggtgtgtccaatcatttgacttccctgggccacattggaagaagaataattgtcttgggctgcacataaaataaactaacactaacatagctgatgaagtaaaacacacacacacacacacacacacacacacacacacacacacaaatctcataatgttttaagaaagtttattaatttgtgttgggctgcattcaaagccatcctgggctgtgggttggacaagcttggcctagagcctcttctagtccttgaccccttaaaattaattctgggtttgagatttttcaaaacaaccaagtagtattttaagttgtaattaaaacttaattacagccctgtgtgagggctggcttgtggctttgaattctcaggggagctggttttctttttgtttttcaaagttatgggtcagtgcaacctttttaattttttaaatagtccctttggaatatgacagctcatttccagtttaccttcatgctgatatatatatatatatataacttttttagggtctccagactccctaccttaggtgggtcagtgttctttgtctcatgttcccagaggccaccttaggtggatcagtgttatttgtctcctgttcccagaggccttgtgttagtctgttttcacactgctgataaagacatactagacactgggcaatttgcaaaagaaagggtttaattggattcacagttccatgtggctggggaggcctcacaatcatggcagaaggcaaagaggaccaagtcacatcttacatggatggcggcaggcaaagagagagcttgtgcagaggaactcctatttttaaaaccatcagatcttgtgagactcattcactatcatgagagcagcacaggaaagacccacccccataattcagtcacctcctaccgggttcctcccacgacacgtgggaattgtgggagttacagtttaagatgagatttgggtggggacacagccaaaccatatcattcccctgcttgcccctcccaaatctcatgtcctcacatttcaaaaccaatcatgccttctcaccagtcacccaaagtcttaactcatttcagcattaactcaaaagtccacagtccaacatctcatctgagacaaggcaagtcctttctgcctataagcctgtaaaatcaaaagcaagttagttacttcctagatacaaagggagtacaggcattgggtaagtacagccattccaagtggcagaaattggccaaaacaaaggggctataggccccatgcagggcagtcaaatcttaaagttctaaaatgatctcctttgactccacatcttgtatctgggtcatgccgatgcaaaaggtgggttcccatggtcttgggcagctgcacctttgtggctctgcagggtacaggtggctctgcagggtacagcctccatcttggctgctttcatgggctggcattgagtgtctgtggcttttccagatgcacagtgcgagctgtcagtagatctgtcattctggggtctggaggtggccctctcctcacagctccactaggcgacgcctcagtagagactctgtgtggcggctctgaccccacatttcccttccacgctgccctagcagaggttctccatgagggccccacccctgcagcaaacttctgcctgggcatccaggcatttccatacatcctctgaaatctaggtggaggttcccaaaccccatttcttgacttctctgtacctgcaggcttaacaccatgtggaagctgccaaggcttggggcttgtaccctctgaagccacagcccaagctctacattggtccctttcagccatggctggagcagctgagatgcagggcaccaagtccctaggctgcacagagcacggggatcctgggccctacccaggaaaccatgttttcctcctacaatgggaggggctgccatgaagacctctgacatgccctggagacattttccccattgttttggggattaacattcgactgcttgtaacttatgcaaatttctgcagctagcttgaatttcttctcaaaaaatgggattttcttttctatcacattgtcaggctacaaattttccgaacttttgtgctttgcttcccttataaaactgaatgcctttaatagcacccaagtcacctcttgaatgttttgctgcttagatatttctttcactgggtaccctaaatcatctctctcaagttcaaagttctacagatctctagggcaggggcaaaatgccaccaatctctttgctaaaacataacaagagtcactttgctccagttcccaacaggttcctcatttccatctgtgatcacctcagcctggactttattgtttgtgccactatcagcattttggtcaaagccattcaaccagtctctaggaagttccaaactttcccacattttcctgacttctgagccctccaaactgttccaactcgtgcctattacccagttccaaagtcacttccacattttcaagtatcttttcggcagcaccccactctactggtaccagtttattgtattaatctgttttcacactgctgataaagatatacccgagactgggcaaaagaaagaggtttaactggactcacagttccccagacccacgtggctggggaggcctcacaatcatggtggaaggcaaggaggagcaagtcacatcttacgtggatggcagcaggcaaaaagagtgcttgtgcagagaaactcccattttaaaaaccatcagatctcatgacactcattcactatcatgagagcagcacaggaaagaccttcccccataattcaatcccccccccaccaggttcctcccacaacacacgggaattgtgggagttactattcaagatgagatttgggtaaggacacagccaaaccacatcaggcctgcaaagccaaaaaattggtaattgaatttacccagtttggcaaatgccttcaaagtgaaaatcagctttagagagctcaattgacctttctctgtgcctgtgtacttataacttctgtcctaaatattcctgactttcttaccaacttgtgaatgtatttaagagaatgttttaaaatgtttgtccagtgttttttgttgtttttatcaggaaggttagtaaaggttcctagtcctctgtgttgctataaacaggagagtctctgtatttttatttttgtttctctattcctaactagattttactattcttgaggggagtaatcttgctttggacttcttttgccttctctgtagtacaacactcagtgttcagtggatactcagttacacagatagacatgtagctagaaaacacttttgagggtttccattttacatatttcatgtctattatattttttaaccttcccagttatttggcaaggtaggttatttatttatttaagacagggtctcactctgtcccccaggctggagtacagtggtgcaattatggctcactgcggcctcaacctcctgggcttaagtgatcctcctgcctcagccttccaagtagtggagaccacaggtacacaccactgtgcctggctaagttttttattttttgtagagatggggtcttgctttgtttcctaggctggtctcaaactcctgggctcaagtgattctcctaccttggcctcccgaagtgttgggattacagtcatgagccatcatgcctggccattattattacctccattttactgatcagtaaactaagacttagaggaagaatttggatacaaatctggtaataactaggggtagaatttagatttgtgactattgactcataattctgtgtcctttacaatgtgccattttgctatttaattaatgtcattgatatttgacatctcctgattactttatctagatatgaaaattccagagaaaccactggattcataatatcttgatgaaattatctctaaatcctcacctaaaatttttttaggtatttactttgcttaagctttcatcagtgacttaaaacaatatattgacttctgttacagaaagcagaagaaagaattggtcttttttgctgttgcagcattgtgaaatatttttgttgtaaaatataggtaatttttgtcttttccaacaggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacaggtaaaatccattttatttattcagagacccatctttattattgtataaatgtaatcttatttgtacatttggtagtgtttcaaatttgtaaaatgagaaatcctcgaagctttatttttttattactttatatttcagattttttattactaatttagttttttttcattattttcatcttctcaagacataaaccatgcttcttggttttttatttagttagttcttggttgctagctgatcctaacatggaattataattattatttatagttctaatatcatctcaaatttggaatgattatagctatttaagagttagataacttattttaatttcagtaaaactatgttattgccatatatttgttaaacctctttttatagagcataatagtttactttgtttttccattatctgtatcattttccctgtacatattatgtatgatacagattttggtgtgaagttagagaatgtaaggaaaaattattgcctttagcttaaaattcttttcacccttcttgctttttgttatagcttagaaaccatgataccatataagaaagagtttttgttttccacccctactagaaatattcagtctctaaagccagagttcccaattttctttccccagtaatattcagatgagttgggaagatggattatttcctcagtcacatatgtggaccaggcacactctcatggactaggattgtatatctttcttgcttactggttcccttcttcctccctttttagacttattaaagggatattatgtttttatctgagctaaagggaaaaggttgtaagccaaaatttggtacattatattggtaacaaattatttgtgacacactacacaattgattgcagtacctctggtctaaactaccaaagaatacccaggaagctcatcagacaatttttaggtaggagttgagtgtgggcatgatagaggacaccatttactgacagggaccccttctgggtagatgtcccacttagccttgatcttgaagaagtatggtccccccaccccagtggggtggcatttagagcttgagtgggaagactagcttagagaaggactatgttctctgaggaaaagatgcatatttgaatgatactctactctttggaatttcaagttcagagcacctggtcagtgtattagttcatcctcacgttgctagaaagaattacctgagactgggtaatttataaagaaaagaggtataattggcttacagttccacaggctatacaggaagcatggctgagggcctcaggaaacacaatcatggtagatggcaaagaggaagcaggcacatcttacatggccggaaaaggaggaagagagaacaaagggaggtgtcatgcacttttgtaaacaactaggtcttgtgagaactcactcactattatgagaacagcgagagggaaatctgccccccatgatccagtcaccttccacaaggccccttttccaacgttggggattacaattagacacggcatttgggcagggacacagaaccaaaccatatcagtcaagtttgagagtttaattgaaatgcatcctttagagtgattgggccttaagttttgtcttagtcccctctgtaatttttcattcacaaacctaactatgtctttcgtttgcctcctccactagtactgggaagcttgtgcttctaaacacgtggttatggctcatttatagtcttcccagtccaggtgcagttctcaaatcaggggtcattttttatagtaagtgtttcataacacagcagagattccccatttatcttaatctgatatttccagggtaacagtggtaggagaaggtaaatcttgaggcagttgtcttttagagaaagaaaggtttaaccctttcttctcagagtaggtgttgttttagtttgcataggaaagagtttttaaaggaggcgacattggagctgaagtatagatgaaattggctattcatcatgcaaagagcacttatacctaggatgcctagaggcctaagacagaaatgacataattgatttagagaatggtagacaacatgagcaggataagggggcagaggttaagaagaacttggaataatttggaattattgggagtatcatgatatgacttaaccattgtatatattttaatttgaaaaccgtcttctcttacagatacagatgacactagtttgttgggaaagaaagatgatggactacaatatcgaccagatgtgaaaggtactgaatcatgcatctccaaattttggccagctatggaaatacggtcactagctgtccttattagttctgtttccattataacaacacctctaactttgctctctatagtaatatacctaacacagttaattattagtattaatagtaacagaaacagctgaagttcatctcattttataaggtactctcatatgtgctttctttgattaaagtctgtattgagataattttagatgtacatgcacttgtaagaagttatacagaaagatctctcaatatgttttataaaaatcctctttactcctctagaatctcctgttaacacttgcccgatgcccaggtctttgaaccttgttcctttgcctgaaactctttatttcctttcctgattaattccttcttatccttttaatcttagcttggaagtcattttattttgggaaatatcccttgaatctgaagtctatattagatgcctttcctgtatactcccctctctgaacacttagcccactctattataactgcctttttattcatctgtaacctcctctaggctatgagttctgtgaggagaggagaacctgtctgtcatgttcactctgtatccctaaccctagccgaatatctggtacataagtaggtactctgtgcttgtctaaagagtggatgtggctcaaagaagcagtaggttttatttacacaaggtctcatgtagtaaaggttggagcagaggctggattccaggtcccttgacttcaaggccactgctctttttgcttgttttcacatccattattttgtttgattcttataactgctctttgataggtaaggaccaatgggaagattgaggatcaatgaggttgtatctggttaactgaaacaggtctatatctttggccttctaggccaggacctctatataattgctgaattacaagtgcatcatctatccatttgtttggttgcaccattaaaagatatgtgatctatcttttatacctaatttctaaacaatatgtaaaatgggagtgataatagtacctgtttcctagagtttcataaaaactaaatgagataatatatgttaagtgctttgaacagtatcggatatacttgtaagtgttcaacaaatggtagctgttatcattgagtaatttgttacttctcttacttgaatcatatgaaacctgagttagttataacccatgagctgctgaaatatgtctcctatgttgaaacaaaatgctgtatttaaaatagaaaatttcctgtattctcgtaggagacaaaataggtcagcttcagttttattcactatattgatagtacttgactagaataggaaggccatttttcagtatttggaagctcatacttagggcagtttggggaattgtgtgttctaaagcacttgtgtgccattgataatggataatttagagcctaggccacttttgagatactgaaaatgttttacacataagaattgatctctaatttaaatgaaattatcatagtagaaataatttattatgtacctaatttatactggtcattttactgtttgtagttaggaagatatctaaaatatatgcatctttaaagttcttgtgatgtagtaaatgcagataaccaacttctaacaaagtagaaattgattattgctataagtgtatacagtttaaaagtgcaatgggaattcagaaaagttgagattaatttttggtggggaacagtgggaatctgtgaaatgtcttggaagaagtggaacttgagtgaaccatgaaggacgaacaggagtcagaaggatatctaaggaggataggagagcatgagcatagatatgcacacaatgttatgacaggatgtgttggagaaaggtaaggaatcctttgggctggagaataggaggcttaagaggtagaagtagaaggcaagactagaaagacagcttggggccagattgtgtagagtgttgaatgctatgctactctagggaatttagactttatttgtgggcagtggggaatcattaatatatttgaaaaaagcaaggctacaaagttaaccatttgaaagaatgatacctggcaggaatattgtgcatattgtatacattggaatggaggcagggatatcagttaggtaaagtcaaaaggaatagacatcttagatatgagagatagagagttaaaaatgacttaagtcttcaagctcagatgacttagatgatgaattctgttcacagaactaaggatattaggtaggtaaaggtgtttggaataaagtaagggaggagttgatggtggagatgattgattgtattttagagtttgaggtgcttgtggaactcatccaggtcactttgttcagtataaatttgtgagtcagtctttggatatagaggtgataactgaagccacaagaatgaatgagagagagtattgtctgttataatagctactggccacatgtagctatttaaatttaaattaaaatgaaatcagcttggacaacatggtgagaccttgtctctaaacaaaattaacccgtggtggtggtacgcgatgtggtcgcagctgcttgggaggctgacgtgggagaatggctagagcctaggaggttgaggctgcagtcaactgagatcgcaccactacacttaagcctgggcgacaaagcaagacactgttttggaaaaaaaaaaaaaagcattctagccctatttcagatgttcaatagccagatatgaccagtgactaccatatgggacagcacagatatagaacattttcagagttgaagaaagttctgttggatgcactattatttagaaaggagagaaggcccaacttgggatgaagcagaaagaggactgagaggaagaaaatcaagaagagtacacagaagctacaagggaaaggatggccaatagcttaaaaaactacagaaaggtatgagaagacaaggactaaactatgcttgaatttgaaggcaaggggatcattgacaatcttggaccaagtttcttccatgaaggatgaaagacgaaacccaaattgtaaaaatgttctcataggaaatagaggttaaaaggtaactctatttttattgtgtttatttttacctcatttacttttatttatttatttattttgttctcacagcatttataggaggcccttagtaaatatccacgtctgcaacacacagccaagattgggtaggtaaggcagtgatctggggatggaggctacaaaatgaaaagcaggaacacagcaccagcaagaagctggaaagattggaagatagtgctcagtaagaaatgtcttttaaaacttagctcttagagaagagtgcttgtgaaatggagcatttgtatgtctagaatagctgctgaattagagcttttcttgggctgttggaaaacctgtggtaaatattgaaattggggtgttagaagctctgttgtagatgttgaagtcataaaggatatgattgagcatgagttgtatgggagatgggtatgtggcatttagaaaacatgtatctatgatatgtaaacagaatagtataataaacctcatatatccagtacccaccttcagcagctgtcagcattgtcattctttgtctgtatacttccacccgtgtgattatcattattctcattttatggtttttaaaggtgtaatttatagcactgaaatgcacaaatcttgaccaatgaatatacttcacatataccacatcttataattgataccatttccacctgcacaggaagtttctctgtggtatatgacattttaatgtgaccattttgattcaaagatatgctcatacagcctataatctaactataccaccctttttattattatgaagacattctcactttgttcctgagctccaccttgtcccaacccccaccccatctttggtctcatccttgagcctcattagtctctcctcctgcagctggccagggatacctgagatagcgagatagtgatatcatttccattactggtgactgtttagatatttcagtccagctcttttgatatgtccttttaaaaacgattttgacaaatatgcctcatcaaaaggaaagactgtgagccaagcgctaagatcaatgaaggaaatcagagaatgtcatggagcttggtggagagtcatatagaggatgattagcaggctcctaagagaggaaggtgctggggagctgagagtggaatgctgggctggaagtgacagtggcgagcacatcaggggaaaagggaaggaagggaatctaggaagtaatgtggccttggtacatcaggaagatgaaaggagtattttctaagggagtagttgaggtagatgaacctattcatgttagaaaaggtgtttctctgggcacagtgggcaggctaggaaaggaggaatcagggctggtgtggaggacagtggggtttagaattgggagagtgggaggcattggagtgcgggtaggagtttatatagtggaagataattccttaatggagtccaagcagatggtggttagggaaggatgtgtggagggatatgttagtggcgaaggctggggaggtgcagggtagtataggggaagcaagacagaatattttgaattttttaactgtagagatttatagaaataatgagccctagggttactgatgcagtgttgatatagttgtggcctcagtggtttaccttccagatacatgtctccattgctaatagcaactcctcatgctttattttggttgtacactgttggaccaggacagatagccagtggaacaagcctttgcagataagccatctggtactgggttttttcataacatcatcccttagaaccacaactatcctttgtatttgaaaacactgcagctggtggtggatttgtttctgaatgcctctgtgggtgaaaggagccatttggtgaccaagtatactttttatattgtacacacagacacacacacacacacacacacacacacacacgcacacacattgttgcagttgcaacagactagcagttgcagttgttgttcttggagcctgtcaccacttagctaagggcttgtttaggcaggatcattctgtgctcagttcttactgtgtgcaggtgacatctctgctgttgtttccgaaaccatgttatgttacatcttttgaggctttttatctttcctttttgaagttggctaatttacttggcctggagagcaggtgcttggccattctgctttttatctgtttcctacacatctcctaggatagcttggagaaataatactgtaatggctaagagcttgctctctggagtcagacttggtctatatctaatagctgtgcgtgttgatttctgtgagcctcactgatcacatctgtaattagggacagtaatatctactacctaagatcactatgaatattaaacactatgttactgagttcattatcagtgttattatggttatttttaatacttttgtttcctagtttcatgttgagtaacctggctgtgctcaacagtctcaccattggtgagatagttatctgtcttgttatttaatattatggttcataagtgacatcagtaggatattctttcatttaatagttattaattgagtgccctactatgtgccaggtgctttcacatatttatgttatttagtcctcataacaaccaagtttaccctcattttgcagatgaagaaactgaagctgcaggagttttgcccatatagaatggcagaacagcgactggaattcagcctttctgaccctaagtgctgctccttccctttgtaccatgattctagaattcttttctgcttccttgctttcttaattaccttcagatatttaatcccctctgagctattactttggtgaaccttaacacttgttctcgagcctggatcttttttcaagcactggtttcacatattcagttgcctggtgggtccttgtacttacttgtttgttttgccattgcttcaaacttctggaactaccatagtgcctggaacgtaatagatgcttaaaaaatactttttgaatgactggagatctaaacttgatctcagcttactacattttctcttcggaacccccatcattaggctcacatttggagtcatttttacataattctgtattacaagcatcttcaataaagaggacagtttggttctactaaactcttaaatgtgcggggttagtgctgggtaccactcttcaagatagttgtaaattgtttgagtaggggtgggactggggaaatctgagcttaaaaataaaggattggttaatagaggggagagggtaaacagatgtggggaagtctacaccaagttgaagcgaggtttcattcaacataaagaaaatctgatggtattagaataaactgtattatgagttctggaagtgttcaagtagacataggctctgagagttataaaactaaagagattcctttatcaaaccagatggcctccaaggacccttccagatctgagtttctgagctcattcactttccaaaacatcttcaaaccatttttattttttctgtgtgtctagtatctactcctattgctgagatttagcttagcttcttgttgccacaagtttggattatgtactaaccttcttatttttttgagacacagtctcgctctgtcacctaggctggagtgcagtggtgcgatctcagctcactgcaaccttccacctcctgggttcaagtgattcttgtgcctcagcctcctgagtagctcggcttacaggtgtgcaccccattcccagttaatggattatgtactaaccttttaattggtcacctgatatatatatatggtcttcctagttcccctgccccattatcttgtatgctggtatccaattaattattttaatatctttattgagattccatttacatgccattaagttcatctgtttaaagtgtgcaattcagtggtttttagtatgtttacagagttgtaaaagtgttaatcataatctaattttagaacattttctgcacccctaaaagaacctccacacccattattagtcagtcactccccattcgcttaaccaccagctctaggcaactactctcaactaattttcatgtaaaacccggctttccctgtgctgctcttcaaaaggcctttagtgtcttccttgtccatacgatgaagaaaacatgtctcacctagaattcaaatttttccataatctagttttagcctacttttccaactttgacatatacccttcgccagtctgaatgtatcactctacctgggttgctactgtttattcttgagaatgccatgtgcattataccttccctttgccttccaccattcctctgtctaaatctatttatgctctgagtcttaacttaagtcctaccctatcaataaatcctttagcctacagtgaattctcctttcaatttgaacttccatagcacctagtgttataaaaccatcttttgccgtttaattgtaaactgccacatgggaccccttccccttgtgttattcagcttttcatgtgtatatgctgattttctaaattgactataagcttcttgagggcaaggaccatgcatgctttttttttttttttaatatcctctgtagcttagctgagcatgtagctatgtccagaaatagtatgtacgtttaatgggatgaataaagttggcattgagcggaatattagactctgtgaattcggacgttgtcacaggattcaaagccttattagacatgttcatgttttatatagcctcactttgcctacagcttgataccacattctttcattaattcattcagtatatgtttattggtgccatacttttcttattaatttctcaaaaccttgtttttaatttggttaacttcctctgactgctttcacctagctgagttctcttatagctttcagctctgcattattcttgaaattccttgctgtttaaagaacttcttatggtagattagtacattaccacagcctctacagacctgcaccgtcctattactaggactctatccttataggactttattatcataggttggtgcataacgttattctctatagtcccattgttataccctttcatgaccatgttctgagaaatgctatgggagatgaccactttcctcaattcacttatggcctgattgggaatgtagagtggcatttttagtttgaaactgtagcaagaaaagtatatttgatctcagttatttggcttctgataaactatttctcatcaaagctaaattacttcaggaaagtcttctgcttggatcacaagtattaataaataaaagatgtgataattaagttttgacctctgttaggaaacacaggataggactactgcagacagcccagttcactaaggaattcaagatggaaacctttattggataataattttgtcaatggaaaacaacaaagatacaatttataactgttttttctccctttaccaggagaaaattagaatttattcatttaacaaacatttgttgagcacggaacaatacttggtaatacttatttattaagtacttattgtttgccaggcatttttctaagttctgtacacacttacatacttaatacactaaatatattatctcatttaggcctcaaaacaaccctaaaagaagtagacatcactgtcatcttcatttctcagattaaaaacctgagggccagaaatagttaagtaactgcctttgggtcacacagctagagagtgttgtaaccaggattcaaacctaggcagtctggccctagagctgtgtgcttagccattatatgtactacattctaaatgttaggagttatacagaaacgaataacacaagcagctagattattaaggagctcacagtcttatggtagaggctgacttaaaaaacccaaatagcaataaaacaggcagtattgtgagtgttataatagaggagtaagtgctcaggatcatagcagcccaaaagagagcttgatttcttttgcaatggcagaattatagtatgggagctggaagagaccttataagccctttgatgacagaatatgttttcatttttgtattcccagcacctaacagagtacccagcatatacaaggtgatcagtagatgataaattagtgatctgttttgcactttccattatgatagctactaggctcgtgtggctattgagcacttgaaatgtggctagtcagaatttagatcttttgtgggtgtaaaatatcagaatttggagacttattttaaaaagtaaaaatatctcaatttttaatattggtagtatgtgaaaatgatatttattggctatattggattaaaatatatgattaaaattaatttacttgtttctatttactttttaaaatctgggctactagaaaatataaaattacatatgtgtcttgtactatacctatgttgggtagtgctggtctcattcagttccctcagagagaagaagtgatttgaacgaggtcacaaagcagtaaagacattttttaaattgagaatttatatgttaggttccctgacttttaggtctattctctttctaggcataaattaaattagcacaatgtaaatatatacactttgaggaaaaataatatcattttggtctgatttctctctgctttagttccactgtcactgaccttaataatcattaaggtttttttctgtctatatgtaaattttgatcctcagaaaatccgcgtttttggttctcagggtttttttacacttggcacctctattctcacttctcccttgatcttcctcttgatcttctccatacacatacatataactcactatttcattcctttttaatttgtttccattaacattaaaaaattttattaataccttttatttgtattttggggagataggccctgtgatgttacatgatgtgctatataaatagctggttgttttggtggtattgtacatgcatttgttatctcctttagtcctctcaaaactgcatgaagtataggtcctattattctgaatttatagttatgaagtctcaggtttaagagggtagtatactgcaggtacggctgtagtgcacagagtctgttagctagaactgtgtaagatagaaatggcaggaagcctggggatttttcctgcacatggacaggcctgtaaatattgcggaattctgggtcctttgagcttaggattaatgtattggtgcatataccaaaaaaagtacaaaaatccattcccaaatttatttgtgtatgtgtgtgtgcatatgtgagtgtgtgatgtatatacagagaatgaatgagtgaatgaatctgattttgaagaccaagttcctatgttttcatctttcctgacctgttccatctctccttcctgactctcttcattttcttcacttcagttcagttcaaatcattatacttaagtctgagcagatgttcatcaacatgttgacagtgttttatttttggagagcgaaatctcaggttattttgaatttcttttttaacctctgtattacttgaatttttaaaataatgaccatatactaagaaaaactatatgaaaagagcagcaaagctattttcacttgggaaaaaaatcaatgtgcttgataattttcattccaaaaataaacctttaaccctaaaatttcagagtcccttaatttgctctctgtcattcagtgttctttggcctcaatttcatagccctcaaataaatgattaagttcattccccaaaagccaattctatgtacaccatctgtctgtcacagaggtgaactttcttttagagcatttatttctttagcaaaggtgtttagttttctttgccagattgtttttaaacaacagtaactcctagcagtcacattctgcaaatatttttaaatgctttgaatctaaacagtttacctgctgtgtttatggcataataggaattagaagagaccctggatcttatctaaccccctatctgataaattttcttttcaaattgccagtaggtggttgacagtgggtgaattcatttgctgtttcagaacatttgaaaagtccttatttttcagcttgcgtttcattgttgaacgatctggtttatgttcttttaagatgctagtgatcaaagagaagatgtttatattggaaaccacatgccttgccctgaaaacctcaatggttactgcatccatggaaaatgtgaattcatctattctactcagaaggcttcttgtaggtaagtcagcgcttccagatcagtggtgagcattttttttcatcaatggttgttgctctatagaagggaatgaaatgtagactaaatattaccagaaagtagtgtttatttgcagtagacaagtaaaaaacaaatcagcagcatcatttggaaaaaaaaactggcaagtaatatgcagaaaacaaaaatcttttttttttttagggcttaacattttaaatataatactatacatttttaatacaaaaaataaatgtgccacattccaacactattttggtttttaggcaatctgtcacaaggtggctgagggactaaagactgtattaagaacagagaacatgtaactcaaataaaatatgtgctaaaatagatttctaaaaataaggggatggggacgaagaaccaggtgtgaattgagagatgaaaatggaaagggcgtaaatcctcaaatccctgattccagagaggttatgtaacttgttcaaggtcaacagcaagttagaaatagagctgggaaaaaactaagtctcagactttccgataccctacctgatgatcttagtgttttttgctgctcttgcctgtctgcggatacacctttttgctgctgctgctagaagctcatcatctgcttgatgttggtctagttagccaggtgatgtttctatagacaaggggacattgctgtcattttgctcacccttgcctcctggagtttgaccagatcctttttttcctttcttagtcaaaacatcgaaacatggagaaatactatacttttcttttgtttggtccacctagaagccagtgaatctttctttccaaaaaaataagaggaagcaattggaaatccagtctcttgggtccttctacttctttagctccctgctcctgatttttttcacctgcctttctcctgcttaaaaaaacaagaaacaaaacaaaacactgtaaactgttaatggttgaatagttctttaagacatttgctttttcctgattgaaagttctccttgtctttgaaggagctagccttctcttcttttttttgtgaacatttaaaaaatctagctgtacgaatggtaacaggccaggtttttttttttgtttgttttgttttgttttgttttgttttgttttgttttgttttgagatagagtcttgctctgtcgcccagactggagtgcagtggtgcgatcttggctcactgcaacctcggcttcccaggttcaagcgattctcctgcctcagcctcctgagtagctgggactgcaggcatgtgccaccatgcttggctaattttttgtttttttgagatggagtctcgctctgtcaccaggctggagtgcagtggtgcgatctcggctcactgcaacctccgcctcctgggttcaagtgattcttctgccttggcctcctgagtagctagcactacaggcatacgccaccacgcccagctaattttttgtatttttagtagagatggggtttcaccatgttagccaggatggtcttgatctcttgacctcatgatccgcccgccttggcctcccaaagtgctgggattgcaggtgtgagccaccatgcccagcctaattttttgcatttttggtagagacagggttttgctgtgttgcccaggctggtcttgaactccttagctcattaaatctgcgtgcctcagactcccaaagtgctaggattacaggtgtgagccattgctcctggcccaggccaatttttaaactaaatcttatagtgggctcttcatgtttgtcctacagtggcatggatagcttgatagaagtttggatcttgtcctcttaggatggtgcgtctttcaagatacttaaatgaaggacgagagagaggatcatgttctggtaatgatgtgatacaaggtcattttctagtattttactaactgaaagtaagaggattgaatcgtgtacaggttaaaggctttgaaattggatacactgacctggccaattattagctgtgtgttctttggaagttacgtaaaatatctaagcctcattttcatctttctgaaagtagaatagtaatagtacctatctcatgttgttaaaattaagtgagataatatatgtaaagtgcttagcctgatacctggtatgtagtatgtacttaatgaatagcaattgatatcattatactctaagcccgttagtcaggggctctttgttttgttaaccactattttccctgtgcctagtataggacctagcccagtaggtactcagtaaatattttttgaatgacctgtgatgatgataaatttttaagaggaatatcttaaatgctaaagaatcccttttctgcacaattataactccttaaaagcagttgatctttttcttttgtctgagtctgtgcagtgtctataggaatcaggccatgatatcatgtgcacttctgctagtaggtaggtgtgtttgcatagcagtaaacaggcaaggataaacagcctttagccacagtcctattgttaggttaaaatcttctagcattatggtaccactgatttttcgttttgtttttgttttgagatgaagtcttgatctgtcacccagactggagtgcagtggagcaatctcggctcactgcaacctccacctcccaggttcaagcgattctcttgcctcagcctcccaagtagctgggattacaggtgtgtgccaccatgcctggctaatttttctatttttagtagagacagggttttgccatgttggccaggctagtctcgaactcctgacctcaggtgatccacctgcctcagcctcccaaagtgctgggattacaggcatgagccaccgcacctggcctgatttattttttgattgattgattggttgattgacttattaatgccaaattctccctgatattggggtgtcaaattcaactatgacagagatccagggatcttgcctttaaaaagcatacaacctggtgaaagagaccgacaaataagtaattataatatggaaaatgctatcatacacagctatacatgaggcgatttgggacttcagaaaaggcacatcagcctgaagatgggtgggggacattgttggaggaagggtcaggtcttacaggaacatttgggccatcccaggagcttggcttttattttaaaggcagtgagagacgattagaggattttaagtagcaatgatgagatcaaatctgaaagccactctggtgacattgtggaaagtagattagaaaatttaggagacttagtaagaagtaagggcctgaattaagtataaaggagttgtgaggctgagaaaataaatggattgcagagagatcattaggtggttgaactcacagatgttggtgaccgacctgttaggttggatatgagcacgagaacctggggattggtggaggttagtgggattaagagtcaggagagtctcctggctttctggctaacacaggattgagtgggaaatgcattgggaagagggagaaggtttgagggggaatgatatattcagtttgacgtgcttggtctaagatgcctgtgggatatccgcttacagatgtctagtgggctgctggatatattttagttttggaactgatgagagagatgtgattgaagacatacatttgagaatcattccctctctagcatatccattttactttctacctagcaattcttctatcccactagccctcccatttattgatcctatcaccttttccgtgtccctccctggatattctcttcccctcgttagtgtaaattccatggccagtcattgtagttccctttgcatttgaatcccacattcctctattgcttcatcatactcacttgccaaaactgtagtcctggttcctcccagctctccacccactgcatacctatacatgcagttgatcatggctgtcggtgaaaagcacaccaccggttaactcgtctcactgacataccgatcggtctcaaggtgggccctttatgctgccctggcagtcattctacacctgcagtttatacattctcctcctctcctgtatgatttctttgtaccttctcctctctcctcagattagcagtacctcctctctcatcctcactcttgcctgttgatcttctttccaagttcactgagaaaatggaagcaatatgagaacttgcacactttcactatcacctaccagcaagcctctccctgtttctctgtatcatagaacttgatatcagtatatctcatatatattgataaacttttatttattccatcttggaaaaaaactcctcattctcattcccaccagttactgtcctgtttgtttcctttccttcatagaactcaaaagagttgtctaaagtctatctccagttcctcacttcccatttctcttgaactcaccccaacaaacttttgtccctaacactccactgagactgttctcatttctaaattcagtggtcagtacttagtctcaaattacttttgaatgatcagtgcatttgacacacttgttcaccccctcctgtgtgatatgcattcttcacttggtgtcaagaattatactgtctcttgtttttttcctacttcgctggatgttccagttttcttggctgcttcccactttgctccttgacctctcaatgtagtagtgtacccgggttcagtcccagtcctcttctcttacagattctgtccagtctcaggacttcccatgacatatgctaataactcctaatttacataaatcccagacttctctactgaatttgaaactcgtagatccatatgcctcctttacatttccacatggacgtctgacacctcaatctcaacaggaccaaagctgatctcctgatctgctctccctccctaaacctgctttacctgccaccttcttcatctcagttgattccaactccatcttttcagttgctcagacaaaacaccctctgatgtatctctgacttctctttcgtatccaatcagctgggaattctgtttcagaatatctccagaatttggttacttctcaccattgccagtgctgttcctagtgcaggccaatgttttcctgggatttttgcagtagcttccgtgattgtattctacagtccataatcaaaacagcagacagtgagtgcccccgccttttttcttttttcttttttcttttttttgagacagggtctcactctgttgcccaggctggagtgcagtggtgtgatttcaggtcactgcagcctccacctcctgggttcaaatgattctcatgcctcagcctcctgaatagctgggattacaggcgtgcaccaccacacctggctattttttgtatttttagtagagatagggtttcagcacgttggccaggctgatttttgcatttttttgtagacagtttcatcatgttgcgcaggctggtctcgaattcctgacctcaggtgatccacctgccttggcctcccacagtgcagagtgaaccttttaaaataaaagtcagttcgtatcattcctctgctaaaatccttccagtggttccttcatctcactaagtgcagaaggccctacagttttgtctcttcacctctctgtctggctctcctctccctcaccccctcttctgcagccacacttgctgttcttgggcatgccatgcatgcatggatgctcccactttaggggacttgcactggctcttcctttgcctggtatgctgtcctccaattgtttgcatggcaggctcctcacctccttcaagtctttactcacgtgttaccttcttaacctacccggattgccttatttaaaattgcaaccctcccttcctgcaactttcctggctcatacctggtgttcgcagtttcccttaacacctcacaccccacatcccctgtagtgcatatcaccttctaacataaccatttaattcacttactttgtttattgacactcttctcccggtagctggtaagcaggccagggatctttatctgttctgttcactgatacatcccaaatgctcaccacagtaggtgctcaataattgtggtaaatggatgtgtgaatgaattcacacgtgagacagtgggagtgaatgggattgcctgtggaaggtgttttgggatgaaaatagaaagtggaggactgaatccctggatctgcctttaatcagtaacagaagaagaagtaataacctagaagttagtactctaggtattaggagagtgtattagtctgttttcactgctaataaagacatacccaagactgggcaatttacaaaataaagggtttaattggacttacagttccacgtggctggggaggcctcacaatcatgggggaaggcaaagaggagcaagtcacatcttacctggatggcagccagtaaagagagggcctgtgcagcaaaactccagtttttaaaaccatcagatctcgtgagactcatttactgtcacaagaacagtgcaggaaagacctgcccccataattcaatcacctcccactgggttcctcccacgacacatgggagttgtgggagttactattcaagatgggattggggtagggcacagccaaaccatatcagatagtataaccaaaagtcagttggagaaaatgatatccagggagaactgcagggatgatatatggcctattggttctttttgatactctgattttaatctttggcttaagccaaaccattagagagctgcatatctaggacattgttacagctccttatggaactgtttttatattactgagctttgactattggccattagcctaccatgaaggacattatttaaaaaatcccatgagacttcattatatcattgaatttactgcagctgtgttgttgaggataatgttctttatgttagaaggtgccctctttaaatgaggaccaatgagattaagttcccttaagtttcataacagtaataactgtgcttcttttgaatgacttgtttgattttattttatggagattgtattttgtgtcaactgtcctccctccctccttccttccctccctctcttccttccttccttctccattggtgtttaatatatgcacagagttgtgcaaccatcaccacaatcaattttagtacattttcatctcctcaagaggacacctcataccctttagcttttactcccaaatcccctcatgctctctagctctaggcatccgctaatttattttctatctctatagacttacctattctggatagttcatgtaaattgaactatatagtatggggtctcctgtgtctagctttttttaacttagcgtaatattttccaggttcatccatgtcataacacatatcagtacttcattcctttttgtggctgaatactattccattgtatggatgacaccacatgtttttaatctactcatcatcagttgatgaaaatttaggttctttccactttatggttattatgaaaaatgctgctctgaatgatcatttgcaagtttttgtgtgaacgtgttttaatttcacttgggtaaagcttagtggtagaattgctgggccaaatggtaaccctgtgtttaacattttgaggagctgccagaccgttttccaaagtggctgcaccattttacacaccctacagtacctttgacaacacttgtaattatctgactttttgatttaggctatcgtagtaactgtaaaaactggcatatacggtggctttgatttttatttccatgatggctaatgatgttgagcatcttttcatgtgcttattggctatttgtatatcttctctggagaaatgtcagtacacatcctttgctcttttattttttggctattattgagttgtattagttatttatatattctagatataagtcccttatcagatatatggaacttactttttttttccattttgtggcttgtcttttcactttcttgataatgtccttaagtacaaaagattttaattttgatttagtgctatttatcttttttgttgttgttgttgcttttgatttttggtgtcatatctaagaaactgttgcctaatctaaggtcacaaagatttactcctatgttttattctcttctaaaaattaaatttatttaaaaattgacaaaattatgtatacatattatgtacatcatatttggaaatatatatacattgtgaaatgtccaatcaagctgattaacatatgcattacctcacattgttaccacttttgtggtgagaacacttaaaatcctcagcattttccaagaatacactgcattgttaactatagtcaccatgttgtacactacatttcttgaacctattcctcccatctaactgaaatttagtatcccctgaccaacatgtcctcaaagcacctcctaccacaccagtccctggtaaccactattctactctctacttctatgagatcaacttttttaggttccacatatgagtgggatcactcagtatatgtctttctatgcttggcttatttcacttaatataatgttctggaggttcatccatgcaaatgataggatttccttcttttttatggctgaatagtattccattttgtatatatacctcattattttatccatttatttgttaatggacacttagattaaatccatatcttagctattgtgaataatgctgcaataaacgtggtagtgcagatatttcttcaatatactgattttatttcctatagttatatacccagtaatgagattgctggatcatatggtagttttatttttaattttttgaggaacttccatacggttttccataataactgtatcttatgttttttttcttcagagttttatagttttagctcttacgtttagatctgcgatccattttgaggcaatttttgtgtatgacacgaggaagaggtctagcttcatccttttgtgtgtggatatccagttagcaccatttgttgaagaaacagttctttccccattgagttatcttagcacccttgtcaaaaccaattgaccatagatgtatgggtttatttctaggctctccattctcttccatgatccacatacctgcccactgcttgtttttttttgtttgctggaaagcgtagagcccaatgtgaaatgtactgggaagtgtctaggaacctcagggactggattggtagacttgcagcacccctggatttccctgtttccctcctcccacatttcttttttgttgttttaatgtgtgctttgcgataagctgcctcaaattcttttcttaatgagttgtgggacattcataaatactgtttttatacttcaaatgttttattaatcagttctcactgaaggctggctaatttatacatttcactgctgtcagcttaaaaatgtaaattgtctgttaagtgtcttaaatatttctccctgtcaaattatcatcagctgatgcagttgtctttttatctacttttaattggaattcagataatttccaagattagcacctacagcttacctccttgactgcttgacattgtttctgttattaataacttattttcatcttccccttgcatcttacatgtttatattttatacactgaaaagtgtcttgaatataatttggtgctatgttcagaggactgtaaatgtttatacctattttttcaatagtcttaattttcaggtacttagccctaaggaataacactaaatatagaaaagcgcatattcaccaagatgtttaccacatctaatttataattgtgaaaaattgaaaataactgacatgtcttagaactgggaatagataatgctagctatattatagtcactggatggagtattatatttctgttttgaaattatatgtatctattttgaaaaaaatgctaagagagtagattttaagtgttctcaccacagacatgataactatatgaggtaatgcatatgttaattagcttgatttagccattccacaatgtctatacatttccaaatatcatgttgtacatcagtggtccccaacctttttgttgccagggactagttccgtacaagacagtttttccatggactggggattgggggtgggggtgatggtttggggatgattcaagtgcattacatttattgtgcactttatttctattattattacatggtaatacttaatgaaataattatacaactcaccataatgtagaattggtgggagctctgagcttgtttttcctgcaattagacagtcccatctgggggtgatgggggacggtgacagatccttaggcattagattcacataaggagcactcaacctagatcccttgtgtgcgcagctcacaatagggtttgcgctcctatgagaatctaatgccagtgctgatctgacaggaggcggagcttgggtggtaatgtgagtgatggggagtagctgtaaatacaaagaagctttgcttacttgcccaccactcacctcctgctgtgtggcctggttcctaacaggccatggaccaatatctgtccatggcccgggagttgggggggatccctgttgtacatgataaatatacgtaattttatttgtcaatttttaagcaaatttaatttaaaaagtgaaaaaaaggagtaaatctttgtggctttagattaggcaataatttcttagatatgacaccaaaagcaaaagcaacaataacaaaaaaagatatacattaacaatattcagcaactttaaaattaatgtgatataacttaggtgaaagacgcaccatgtaggcatatcagaaagacagtagggaaacatacaaatgacatttttcccccagatggtaggaaagtgcatgatatcctattcctgtttaaattttattactattttgtattttttaatgtaaaagcttgggagtatcaaaatttgtaattttcataggaatatatatatttttccttttcagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaaggtaggtaatgatgtaagaaatatcaactttaaattagaggcaggcaactgtttatttatagatgctttgaggccaccagtctattaggaaaaatcttatgatcagttccctgaggttttcagtggtctctccctatccttcttctttaggatacgggcagggactaattcccagtcttacaggtatatctgggcgacaagcagagagggaatgagaatagtcaatgagataaaggaatttagggatctgagaactgtatacagtctttgaacactgtattctgggaaaataatgttagtagcaatcttttttttttttttttaagagacagggcctcactctgttgcccaggctggagtgcagtagcaattagagctcattgcagcctcaaattcctgggctcaagtggtcctccagagtagctgagactataggcgtgaaccaccctgactggctcagaatttctagaatgatctgcacatgcataggagatccatgcagaagatttttaagccctgcacaactgcaaggggttctgtgccctaagaacgtactttactcacagttagtatagtaagaaaggaagaaatcagaggctgaagatagttttattgtgatatcatggtgttaacattacttcattttcaggattgcagcgataagtaataagctttaaaattctgtattataaataaaattattcgtcataaattaaatgacttatttggagtgcagtggcataaaatgggtcttttctaaactgagtagaaatacataagtcagactgaactgggcctgagaaaagtcagagtaaatccagcaagttcgtgttgtctttgtgcttcccagtctaatgcttttcttcctgcttacctctttctttaagcttcagttcagaagtctcataagcatcatttctccacttccctgcattattctgggcagagggttgaagcatatcaaatacagatattggcaggccataatggatttgtggcccttctatccaaggtctggatagaagccagaccttcagtagtctcagccatctggagctgagatgataaatctagaaatgataaaaaagaaaaggttctccaagtaacagatatttttcataacacctaggcatgaaagtcagtgcgctttatttcacagaacagatgatctgcccttaggcaagactactgaatataaaattggacggtagatcaaagtagggacataatcatgtaacaaataatgataacagaaagagaagatagggaaaacacatttaacagcatgactggctgtagccatttaatatagactcagaggttaagtaatttgtctgtggtcatccgactagtaagtggaattgtctggatttggattcagtttgattcccattcattctttacactgaaaggttccatgttgagtcatcttgggaaacatgtttgcccagtatgaccattgcatgggagcagggttcaaacttgattttgtagcagtttagggtttttgagcaggggaaggacttggtataaaccatatttttcagagtattaatgagtcatctgaaaaattcattggagtagtgaacatatgaggtagggggaagaccatttaagtcattattagagttaaataggagtgaggtaatgaatgatttggaaggcagaaggaaaattaaggtaaagtaaggggagatgtttgaggcctggagatagtgcctttatttgagacagggtctcactctgtcattcaggctggagtgcagtggcatgatcttggatcattgcaacctccacctcctgggcttatctcaacctcccgagtagctgagactacaggcatgcgccaccatgccttgctaatttttgtatttttttttttgtagagactgggtttggccatgttgccgaggctggtcttcaactcctaggctcaagtgatccacctgcctcggtctcgcaaagtgctgggattgtgcccagccagatagtgccatttttaagaggatcaaaggatgtcagagtcaatgagaaacaattctgagttcaaccccttcatttagagaagttgggaaactgaagccctgagataagaagtaccttggtctaaggtcctagagctaggaaagcccccttacaacagtcttttacccaactctttcagtgctataatgctcaactactcaattaaaattacctggcaggcagttttgaagtaggtaccctctagtttatactccagatccctccttgttgccctcacagccacttagacatcacagtgtatttctaactatgtcacagtgtctttactgcccactgtctctacgattgaagagtcatctcattgaatttatcacagatttctcctggaggcctgtctttttattatggtatttcctcccctagaatgtcttgctatcttggatttagaacatttatgtacttggatttatttccattgagtttttaagtatctctcccacacagtccattatgagacagctgttgacatataccgtggcggctgtcacatgggaggaatcttctttaaaaggatgttcccactgacctgtttatcaagactgcatgagtcaatttttctttttttcttcttcttggaatcgcctttcatattttcagactcatagaatgacagattgtcaggaaccttgaacatcaccttaactaaacgccctgattttatggatttaaaaaccatggcactaggaaattggaatttttccaaggtcatggtgagttagtgacagtacaagagggttgcttgatctgtcagctagttttctcatttatgaaatggagatgattccaactctgtctacctcacacttttaaaatgaggattagtgaggtaaaaccatatacaaaatggaagtattgtcaacacttttagtcaaggcaaagctgtactctttgaaatcgaacgaaatgaggagtactcattgttataagactttctttccattaggttgtaaatttcttgctggcagagattttggaagctagtccaactcctaatttattttttacatataggagaattgaggttgcacagttagttattagcagagcccagaattcgtcttagcccccttattccacattgcatagcacagcatcttgtgtttgcaatctagtgtgcaggcacaagagcagttccaacccagtgagatttgtactgctgttgagaaacgtggtaaaatgagagcagagttaaagaatgtcccttatcctcagtgtggcagttccttatgggcttctgtggtttgccccaggagggtgtggacagcttcttttgagtcattgtctaaaatcagtagacattcctatgtattcatagctgaggttaataagcacacttcttcctgatttctcccttcatctaagctcttcttgtcattttagagctgtcttctcataatgcacagggaaagtacataggccagagtcctttctcctgtcaggggtttcatgttatcagtcactgtgactagggagtttctaggctggaggaagggtgggatatctgtcagggatgcatacatagtagcatagacactggtaatgagttttgcttgtgccagtacctatattacatatctaatcctctcaacttccaggtttgtagaggaggtagcagtctgaattgtgttcatcttcatcttgtcttgcaacagataccatctcatttccctttcatgtaattgcttgcaatgtggctttatgtgcaaaatgtgtattactttggaaacatttgaaatatcctgaacaaaatcatcaaaacaatatttttctctctttctttttttaatgcaacagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactatatggcctctgttttggtgtgtttatttactaaattttttgatattggtgtttcagtatatttaatatgtgaaattagtagaaaaagcagatttcggttcagaattcccctttactgttacaaatactgattgaaattatctaaaggcaaaagctttacccaacatttggagtttgcttttttgatcatttggcttctaggtttaatattagttacatggtggctttagtgaacttttttaaaaagctttactcttctacccacacagtcttatttgagtcccttagtcagtcagcaagcatgtttggaacagtccccggtgctttgcaagggttcagattgcagaacagtcacatatgggtatttgtagttataaatacttgaccgttctctaggggtggggtttccaactctttaaacaaccctgttgcctgttatcaagctgactttttgctccaagtgccagaattgattgtggttaggacatcttacgctgagaaataaataaaatggaacataatgggtctgcttcaaatgctgataaaatccaccagaatcgcctgtcgagtgttacagaagatgaagaccaagacgctgctcttaccattgtgactgtgctggacaaagtagcctccatcgtggacagtgtgcaggcaagccagaagagaatagaagagagacacagggaaatggaaaatgccataaaatccgtccagattgacctgttgaagctttcacagtcgcatagcaatacagggcatatcattaacaaattgtttgagaaaacccgaaaagttagtgctcacattaaagatgtgaaagcccgggtggagaagcaacaaattcatgttaaaaaagttgaagtcaagcaagaggaaataatgaagaaaaacaaattccgcgtggtaatattccaggtaagcttgcacttgtgttcagcttgcttgttctaatctcttgcatcttttaattgccaaaagtcatatcagaggtttccagtgtcacatcttaactattgtatatattaatacaatggagttctgtattagcagcaatctcaggataaaaccatttctctgttaaccaaagtactatctgtcatttcggtattttgagcttctcaaccatttcatgtaatatgaactgtggctcatagcttaggctatttcttgcctttgaaacttaatattggtaaggccctttcagcatattagccttattagcatgaagccctctcatagactttgaaaatgttagaactagaagaagactcagaagcctctagtttaaaacacttctttgttctctaaaagaagaaactgacaac

SEQ ID NO: 15533 - DNA, 12608 bp, Human
ctaacagtcctacccagggcctcattccagctactcccccaccatcagccatttatcttctcaacttcagttcattttgcacattcatctcagattaatattcccaaaatgccttaccctgtggctatcccactgtttaccataaacttttgtgtgtatgtgaggttttctatgacttctggccctagcaactttgtatctgctattagtcactagagcttcctctatttttaaatttattcactctacatgtgtgcatcgcctccagctgtcctccatactggactgttcttccttctgagccatctgcaagacacgtatctccaaagtccagctctcacgatctatgatgagcctttcctaatccagtatgtatatctttgcactgagttctttgccatatcttttaaatatgaaatcattctattttgtcctattcatcagtctcagaattgattgttgaatgttcccaacatgtactttcatctctttactaagatatatattaatttctttgtggtgaggaaattggccactagagagggctttcaaatgtgcaagtctccctttggcccaggcacagctaatctgagcacgtcaatgccacacatccttgccttcaaagagtaattgggccaggggtgggcccatgacttaataccagccagtgaggttcattatggggatttttgctggaacgattagaaagaaaagaggtactatttttcctgggtttgctagatggggacagtgaaagtgtggtgccttccttcataccactagagaagtccatctaccaccaaggaaaatgaggctaatctcaggaaaagcagaatcaaaacaaggaggatgagagccccaaaattattatttgggtaattgaattcactagtttaaagtccctggacttttcagttacacaagccaatatattaccttttgcaatattcagtttaagtgagttctgacaaatacaatggtgtacaagaataatgacgtattaatgatacatggaaaaaagcaacacaaaaattttaaatatagtaacgatcccagttttgtaaaacacttattaaaaaatgcagtaggcctataatgccagcactttgggaggctgaggtgggaggatcacctgagcccaggagttcaacaccagcctggccaacatcgtgaaaccccgtctctactaaaaatacaaaaattagccgggcgtggtggtgtgtgtctgtagtcccagctactcaggaggctgaggcaggaggatcacctgagcccacgaggtggaggctacaaggagctgtgatcacgccactgcactccaccccgggtgacagagcaagaccctgtctcaaaaaaaaaaaaaaaaaaaaaaaaagcagcagaatagaaacaatgatgacagttaaatggtgagatgagagtgagaaacgctgaatttaattttattctgtatgtttcacaaagatgtcagggtctgggattttatccaatttaccatactccaccaaatcaactggtaggatctccgtgaaacagtaacagggtcatttagaaacctgttgctgcctcatgaaaatcctatgaactctccttggttccccggtgatactgtctggcaaggccccttatctctccaactcatgtcacaccttggctccagttctcatttctcaggggtgcgtgtttgctgccgcccactccatcctcgcgtcccacgccctcgcgattcctgctcatcctaggggcgccagcttcgctggaggacgccgcgctctgcgggtccccgcctcggttccaggcccagctgcaggtgccacccaggtttcaggcgctgaggagcggagagcactgccagctcgctggggtccccgctgtctctggcaagcggctccgcgccgggtgggctggggcggcggggcgggcgcagctgcttccccgccccggggcggcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtgcgggccccgggtacccacgctccggtccttccgcccgcggggcgtgagaagaggaggccggcggcccggaccgggcgccagcgggggactcggtggcggcggcgaggcctcggcggggcgcgggggcggtggggtccgcggtgagggagggcgcggggcaagccgggggcccgggcctgacgggaggaagccgcgcctggggggccccgcggtcgtggtcggtcccggtccctgggggtgcgcccactccagaaggcggccgtggtcagttcctcggagggcgcaagggatgccggcgacgcgcgggccgggagggtggacccagggctggggaggccaccgcagggcggcgaattggtgatggattggtaggatgagagcgagagggaggagagccaggatgctcgggtttctgtcgtcgtgacagggtggacggcgctgccacccgccgaggtagagaggagggggaacaggtttggggaaatgatgagttcggctgcggacctggggactccggggagtcatccgggaggtatttgtcctcatggcctgaagctcagcgcccagggctgaaagaggtcattcaagtgcattggggcgaaaaagcctcttctatgaagagcagagctcagagcctgggacccggggaccagccacaccgatggccggtggccgagagaagaggaaataagagacagcaaggtttccgagcaaggcctagagaagaggaaataagagacagcaaggtttccgagcaaggaagtagggatttccaaaaactgggggctcagtcaacatgtccagcgtttagtcagttggctaaaaggcgtctgttgtagagctgtgtttagctacgagtgcagcattatttgcagaagatctgtaagaaggaacacaaccaggatagtccctgtgcctcagtttctcctttgctgtgtgcctggcactgctacagggaatagggtggttctggaggggaaggtaaacagcaacttaacggatacatagcatcgcttcatgtactaagtggagtgaagataataaacagggtaaagggagagagggctgtggaatgcagaggtctggtggcttatgtgttagtaaaagcagaatctggactgtcatagggtaggcagacgttttttctttttaaagaaacctagttttaaagaggaaataacgtgtttttttaacttaggaaatgaaaagccatgttttagggttgagaggaagtaacaaattatatttttaggttccagggaagaaacaaatggaagccaattgctggtagaggagacagggctacgggggggtgggggattggtggcacagcttctgagacaggaagaaagaaggtaagggtgtgtgtaaagataagtttctagatatgggctaaacttgtatggtgacacttttctttgtgaaataggaggccaggttttcttctaaggcagaggaaaggggactaagggagtggcccctgagcaggcacgcagatgcgctgtgactgaagacccagctgctgtgacaagggagactgctggtcatatttgtgattttttttttttcctgcagcaatctttaccatcctggaatgtgagtgctgaaggtgaacggtagttgaaagaggagtaagttagcaggggaggtatgccagaaaggtggaggtggggccggagggcaaggcgtgtgaaggtctggccagaaagaggctgagcctagatggatagagaaggaatgcagccagcctcctggtgataggtgagacagaaggggaggaggtgatgcctggtgatctcggtgaggtcagagcagaataaaggaagaataaaggaggcagcaccctggatgggaaggagagattgtgatcagagagtaggatactggagtgtaaaatttcagaagtggagcagttacaggtgttgtaactgtatctgttggcattgaggagaaggctgtttgaggggaagaagtcagggaactgaaatgagggttgttggaaattcacaaagacaatgtggggacatgaggtagaaaggaaaactgtgagccagtcagatgcctgtctacccgccaagtagctaagaaagaggaaagatattctttttttttgagatggagtttcattcttgttgcccaggttggagtgcaatggcatgatctcagctcactgcaacctctgcctcccaggttcaagcgattctcctgcctcagcctcccgagtagctgggattacgggcacctgccaccacgtccactaattggctttttttttttttttgtatttttagtagagatggagtttcaccatattggccaggctggtatcgatctcctgacctcaggtgatcctcccgcctcaagctcccaaagtgctgggattacaggcatgagccatggcacctggccggaaagatgtgcttatctaccttttaaaaatgatgatgaaactgagagccatataattcaggtgaattgcctgagctcgcagtaagcttatttacaaataggataataagcctatttaagaggtgcgctcatggaagtatgatctggggtacttggcagggcttccctcagacaataccttagagagtcacaaccattccagggtctggtctacctcacatcctcattcattgttggatgtgcttagcatagccagaggtgtcttctctttgacagacttgctatctgaaaaataaaccaggacaccaattttctagcatataatagaggacatcccttcccagctataggaatgcttggtatccttccaagaactcctcctttagaggagcctcacagaagttgctgggtaaacatgggctcaaaccaaggaaagtcaggtaacctgggtggaggttatcccaccaccaatggcaggggacagcttgcaagtatttgggcttatagtctcccagcccacagcctctctcccttgctagtgttagagagatgctgatcacgtttactcttctcttattttctctgcgtatccccttaccttaactttttgaccatgttcttgagcctagagttcagttagtctcatttctccaggagtcctggagacagtgtccttccacctaccatgtgtggagtttacctgccaccccaatgcaaagatagtaagcctgagcataattgattctcgatttcttttgaattaataactggtatatataaccattaattccaattataattcacatgaaaatgtcagagcttctattgagagcaaaagcaaactttagcattagcctggtaatattatattatggttttatattcatataatatggagtaaactgtcattacattaatgcaaccaaaattcctggagctgtccagaaacttggtagcaattgtaacataaacagttaattttccagttatttggaggcttggaaaattaacacaaactagtagtaatacctgaacagcaattggaaccatttttgtacaatatgggtgaattgtattcaaaatgccttttaatgcaaaaaaaaaaagtacaatgaggaaaacctccaagtagaaatatgcatcaaatggaagataagaaaagggataatgatattgtatcagttagtttttgctgcctgacaaaccaccccaaaatttagtggcttaaaagatttatactcacagttcttagatggacaatttgagctaggttcaggtgtacagttctgctgatcttctgggctctcccatgcatctgcaatcagatagagtgttaactggtgttggctggtgtctgggtgattgagaatggcctcactcacaggtctgcaggttgataggcaggtgctggttgtagcttaccagttctcctctacaagacctccaggaggctatcttgggctccttcagatggttgtcttacagttccacctgcaccaagagagataggtgcagagactcttgaggactagcttggaacttgccctttatttctaccacattctactggtcaaagtcagcccagattcttttctttttttgtttttttgagacggagttttgctcttgtcacccagcttggagtgcaatggtgcgatctcggctcactgaaacctccgcctcctgggttcaagcgattctcctgcctcaacctcctgagtagctgggattacaggtgcacgccaccacacccggttaattttttttttttttttttttttagtagagacagggtttcaccatgttggtcaggctggtctcgaactcctgacctcgtgatctgccccctcttgggctcccaaagtgctgggattacaggtgtgagccactgcgcccggccacagtcagcccagattcaaggggtgcgtcaatagactctacctcttcgtggaaggagctgcaaactattgtgatcacgtttgcagtctaccacaaatgtattgctatatgttagcgctattctaatagctttatatgtgtgaactcacttaattgttacagcaacccagagaggtgagttactatttctaattatttctcagatgaggaagcagctactgagacgttgagtaacttgcccaaggttatataggtagtggcagagctgaatttgagtccacgcagtctggttccagaggctatactcccaaataataagctataccgcctcaaaagcaaggcggaagaactttatcacttgtttggagcagactgaataaggcttcagacttgtaaacattaagacaatttgctcatttggcaaacttggatatattgatgcatgttttatataagtaaaaatttgtaaagggaatgctagaatgagctatttctttacccgttcagtctcaaaactagatttctaaatggatcaaagatacagctttttcttgtcttcgttgaataagcaactaaaccaaaaaatatctaaattgacgttcatggaaattgtaaccttttctctttgtagttcaagtattagaactttcagcagaaagagacttttggaggtcacaaaaagttgatatttaccaagttggatgatcgttttcagaatatccttgactgccgggtggcttggctgtgagcagggtgccatgttgctgtccctttgtttcaggtctctcaggcagctgcagagcttcaacagtactgtatgcagaatgcctgcaaggatgccctgctggtgggtgttccagctggaagtaaccccttccgggagcctagatcctgtgctttactctgaagactcgtgagtaatgatacaccatgatgtcttgggcccatagcattatcacagggcttcccaaaggacttgagcaactgagttttgaatgtctcctattcttggggaaattaaaacaagagccagcaaaatgcacaactttccctgaagtgtgattctagtgtatatttaccttgcctgtagaatacatctaatcaggacagtctgaagtctctctggcactaagtcatgagatgccaacatccttctgtacttgagctctttgagttggctggtagtaatttcttcctttctttctttctttttttttgagacagtctcgctctgtcacccaggctggagtacagtggcatgatcttggctcactgcaacctccatctcccaggttcaagcaattctcttgtctcagcctcccgagtagctgggactacaggtgcctgccaccacgcccggctaatgtttgtatttttaatagagatggggtttcaccatattggtcaggctggtctcgaactcctgacctcaggtgatccacccgcctcggcctcctaaagtgctgggattacaggtgtgagccaccacacctggccagtaatttcttgaccttaagcccaccctctctgtccttatagcatccaagggttgggatttgctacttagtgctatcaactgacttgctactcttgggaataaggactccccagagtgggagatgtgtgcctaccacccgctgtgatttctttcccaatggttttcagaatatatctctgttttaatggaggaagaaatatagctattgggaaaaagtgtgagtggggttaaaagagctttaaaaattgataaatgaaaacacctctctggtggcatattagaaacttcttgggttcgaatgctttgtattggggtcattttcacaatgtgtttcccccctcatcgccgagacatcttgctctgtcacccaggctggagtgcggtggcgcgatcttggctcactgcatcctctgtctcctgggttcaagcaattctcctgcctcagccacccgagtagctgggattacaggcgcatgccaccatgcccacctaatttttttgtattttagtagaaatggggtttcaccatgttggctaggctggtcttgaattggctggtctcaaactcctgacctcatgatctgcctgccttggcctcccaaagtgctgggattacaggcgtgacacaatgtttttttaagaggacaagggcatgaattattagagtcttttgggaccaacatatttcaaatgatgtgttctaaggggtgtttatacagtgagtaattatcttaggtccttcttcacaagtagcaaaaggaaattgttcacatttaaaagaaggaagcaatctatcaaatcttattgtactttttaatggaaaatgttcatatttatggtgttaagataatagtcttatgttggcatagcatttttctttttacaaagcttccttcttccctcccctcccctcccctcccctcttcttcccttcccttccctccttctttccttccttctctttattaaattgagatggagtctcactctgtcacccatgctggagtgcagtggcacaatcttggctcactgcaacctccacctcccaggttcaagtaattctcctgcctcagtctcccgagtaggtgggactgcaggtgtgcagcaccatgcctggctaatttttgtatgtttaggagagatgaggtttcaccgtattgctcaggctgttctcaaactcctgacctgaggtgacctgcctgcctcggcctcccgaagtgctgggattacagtcgtgagccactgcgcccggccttacaaagcactttcatgggtgctgctcattcagtggtgtggtttagatgtcttttgtattcacctgttactttcattttttttttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccggctaatttttttgtatttttagtagaggcagggtttctccatgttggtcaggctggtcttgaactcccaatatcaggtgatccacccacctcggcctcccaaagtgttgggattacaggcgtgagccaccgcgcctagctcacctgttgctttctatttcgtgaatactaaagtaccctattaaatgatgactagttaattttataaagaaatcttactaaagtgaaaaccaaacaaactctttttccagtaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaatattttgtgtctgattttgtattaaggactcaaggatttctgtttgcctgtgagattgagtgctggaatgagagagtgaaattgttgtttttaagtctttgtagaattttgcaaatgtcctgaaaaatagataactgtataacatgaagaaaatatctctattaatggcaacatttgttctctgaaatagctatatataaactcataaataaacaaaaatatctgtgagtgtaagtagtgttacaatagagaaaatagaagttattagatgggaactcccttaacttttagctactaaacttctagatctagtgattggaatcccttccattcagtcataattcaggcatcccttttataacctatttgttctctggatctgtttcaccttctctgaaattgcacactaccagtgatcctttctccttcatcttcaagttctctgctggatgctttattttctcttttcttctcttctcttttcttttttgagacagggtctcactttgtcacccaggctggagtgcagtggcgctatctcggctcactgcagcctcaatctcctaggttcaagtgttcttcccacctctggcccccaagtagctgggactacaggcgtgaaccatcacacccgactaatttttgtattttttgtagagatgggatttcgccatgtcgccaggctggtcttgaactcctgagctcaagccatccacccacctcagcctcccaaagttctgggattataggcgtgagccactgtgtctggcctccagtggaccctttctatcacaatttagcatgttccattctgtcttaacaacaacagcattttttaaaatcctcattgaaaaacaaaattcttttttgattccactttcccctttcagcaaacatttggtaagatagcacaatgaaactataagcatctcacttatagatgaatatagatgcaaatgtcctagatataaacagataaaattcagtagttagagaaagtacagccggataaaactactttaacataactaaatctatcaatgtaattcattacttgaatcacttaaagaagggaacctatgccaaaaagtcatctgataaaattcaatagctgttctgggctaggtacagtggctcacgcctgtaatcccagcactttgggaggccaaggcaggcagatcatgaggtcaagagattaagaccatcctggccaacatggtgaaaccccgtttctattaaaattcaaaaatcacctgggcatggtggcacgcccctatagtcccagctactcgggaatctggggcaggagaatcgcttgaacctgggaggcggaggttgcagtgagccgagatcacaccactgcacttcagcctggcaacagagggagagaccctgtctcaaaaaaaaaaaaaaaagctgttctgaataaaaactaagtggattagtgaaatgagagtagaaagaaattactatgatgataaagacaatttttcaaagccaacagccaatatcatactacatggtgaaaggctgacacattcagattatcaggaacaacacaagaataccttttatcaccactattattcagcattgctttggaagtcttagctaatgcagtaagctgaaaaaatgaaatgatgtaaacattttagaagaattatctgtatttatgggttatataattgtacaccttgaaaactcgtgagattctcgtacaagaaatacttgaatttataatagaatttgggaagctagctggataaaaaagacagaaaaataacattttctatactgacaatagctagtttaaaatggaaatggaagttatattccctttctactttaatgatacaactataaaaatacttgggaataaacttaacaaaagtgcaaggtccctaaaaaagattttattgatgttataaaacggagtgtaaataaatggagggacatggcaattctaggatattaagac

SEQ ID NO: 15534 - DNA, 16935 bp, Human
  misc_feature (1)...(16935): n = A,T,C or G
ttcatgtagcattcactacacaccaggcacggttctaagcattttacatatattttagttcactcaacccttataatagcacaagctattattacgcccacttctcacataaggaaactgaggcacaaaaaggctatttagacttgcctagagttacccagtcatgaagtggtagagtagggatgaggacaacggagtcaaattgcagagtccagactggcctcccagttccttataactgtaccatcctccacatctactctgcattggtgctgtggaggtgggagagagggagtacctccttcactgagtcactggacatttggaaggtctttggagagaagtcagctgaggatggcctgcattgccccttcctggaactcaatgatttgttgttatcacccatgcaaattcaccaacaaacagataaaagtcaggaagctgggatgcagctgaactgaaaacccagcagcagaaaagcaggttatagattctgctctgggtgctccatacagctccttcctctctgccccaataacctccctctctttgggaacattgctgcattcagggcagtctgtcttccctccctatgggctgtctttagaatgtgtcccttgcctatatccatattcatgctccgtgctcctcagccccctagaaactttgcacaatagattcaaaacctctggtttcctcccttcctctgtctgaaagagtgaaagaaggaagccagggatttcagggggcagccaggcagcagtatcaccacccctaggcaatcacacctagttgcagcttcatcgggaacagctcagctctgaaaacacagacctgggactctccctcccagccttctagctctcgttcctgtgagcagcttttcaacctccacttccagccgctgacaggccctcctggctccacaaggccagctaacatacccaccttccacaatccccagccctgccagacataacctgcaacaggcattcctggatcaatgcaaactccgacttctgttccaggagtctgcctctgttagaagaatctcacacaagtgtgcgtgctgtgccattgtaaatgctgtataaggtggccaggcccaatcagtccctgcaagacaccgaacagtaagaactatctatggagtgtttactatgtgccaagcaccgtcctttgcaagcactattaaccctcaaaataccaccaccgtgagattgagaccatcatgattcccgttctacagaaggaaacactgagacttcaggaggtcaggacctttccagggtcacaactgcgtaactaagttgcagagctcaacccagtggcacttccatctcacacgcagctgtctgatggtcaagagcccaaccagtcccccggtcgtttctaccgcactaaaccgctgtgtcaagctggagcagcgggctcagcagtgaaaatgaaagaacagaaggaggttacagagaagagaacggtcacggtaaattccggagaggaggcaaggacgtacacaccgagatacttcccggtcaccgttactcagcactttgtggggttcacgtggctgggggggccggggcgtggcggcccttttcgaggaatccagccctgcctgggcggtccccatctcgagcgtgggcgtgttcgattcaggcccggcggacgcatccccaggtgacccgggagggaccttgtgtctctgggggtgactgtccgtctccccgcctcccaccgtcacgcgcagtgctgatccccacttccagctggagtgcgagctgggcttggggttacaggagccgaagccctggagctccgccccacgcttgcgccagccccgccccgatcccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaaggtacgcgctaccggggaaggccagggtgccggcgccgcgcgcggcctctgtaactggggaaggcggtggcgggaggtggggaaggcggtggcgggaggtgcggaggccgcccctccgcatcgccaggggaaagggacgcggcgtctcggcctgggactgcgggaagcagcggcctgggcgcgcccgaggcggtggagcctgccctggaggaagggaggagaaggacgagggtcccctggagggcggagtggcggtgcccagcgtttctcgcaccctgttcctcgggggattgcacgcacgcggggagcgtccgggggatgtgagagcgcagacagcgtgaggagtccccacgctgcgcctcctgcaccctcccgtccgggcagccccgactggaggaagatgagggaatggaaggggtccgcccttggccccccatctgtatccagattcaggccccaggcaaggatagggagggcccttgcagaaggcacgggtcggtggccgccgctgcctttccgtatgtgaagtgatccacccgcagcgggggtagtgatctccctttgggagcgggtctaggccggagacccccgcctgcctccacccatgcccgaccccaaaggtgacgcgtgctgtatccgcactaagggggcggattgcggctggagaccccctggcacgtgcaggtctgtccaggaggcccgagggccccaggtgaccgcgaggaagtgaggtccgggccgcgcccacgggactcctgtggcgcagggcgcgtttccggcagcagtggctttggaatgactgagtccccaaggttgggcccgggggcctcggctgccctgcccgtccatgattcaccctcagtcggtgggttttgctggagccagggttcctcctgggagcagccgcgccctgctgcctgctcgccgacctatcggtatcccgatcgttgttttgtcctcttaaaaatgcccaaggcgaaacagccttcccatgtttgaaagttattgcaagcctaaaaccttgtagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattacccctccctacctgcgggaagcagaggagggcgggtcctcgcccgcctcgggtgccctgacctgtttggtgccgggtgggcttcggaaacagaagtgtgtctgcaatgtgtccccgatccttttgttcctttgattattattgactctcagtgttttttcctcatatgttgattgccactgtcatcttttatcttcctctcaatcagttttttcttagtgggattctcattttagcagccctcatgtgttgaaaagatccttagtagtgaattgtctttcatatactttttttccaagcacctattgtgtgacaaattattaatccattcctggggaagggagtggggctgggattctgttctccagggtctggcaacctcagtataacccaactgctaagaaccccctccactgagccagaagacctttgagtggtctatgttagttgtcccaaaatccagacactacaaacaaagttgattaggatttctggagcacacagtttagtcctcccagttgtcagagcatgtcagagcaccttcctcctctaccagtgacaaaggtgtacaagggtgacaggaactttaaaaaaagcactacagcctggggcccaaaggccctgataatcaattaatcctcaaaataacaatccaaagtcattgatcgaaagttacactaatttgattgttatttgtctgttagtttgtttttcgagatggagttttgcccttgttgccctggctggagtacagtggcgcgatctcggcccactgcaacctccacctcctgagttcaagcgattctcttgcctcagcctcctgcacagctgggattacaggcatgcgctgccaaaatgcccagtaattttgtatttttagtagagatggggtttcaccatgttggtcaggtttgtctcgaactcctgacttcaggtgatccaccaacctcaggctcccaaagtgctaggattacaggcgtgaaccaccacgcccagcctgttatttgtaaatgttgaatacatgttacattttcatcctaatgggctaaatttgcaccatttgccattcagaacaattctgtttctgaggtactctgttggtgctttagggccaactgggatctatttcagagaggaatggaataattgactgtaaatgtgatgaggaagaaataaacacttttaaaaaaaatgacacctaccatttattgaactcccatctacaaggcacttggctaagtacttcagaaaccactcacacttattaccctcagagtaggtatgttgaggcaacgagatcttagactcttgctcctatttaccccaactacactgttctgcttcccccagattattggtgtcagtgatggagacatttattaatcctgttagtttctgggagctagaaattgtgatttcttcttagtaatacaatcttgaataattttcaagctgatacccgtttagaagtatcagaagagaatttgtacatgaagcctgcacatacgtggggtgtaactcatgttcagttaggctaaaagttattgttgcgtgcctcttttcagaattttaggtacttgtgcttaaatttgattcagaactgttttggaaaagccttgagtatgtttgaaataccttccctcttgaaagtaatctcaagtttttaataagggttaatcatgttaaaaaaacaaaaatgtctattcaaccagacattggcatttcttgaccttttttcctgtcttacctggatcttgcaataaaggatgcctggtttaactttcttgaaaatcacattagggaaggctttgaatgaaattgatctggaacaataagtgatgatttggaaaaacaattgctatacttctatgtaccctgctgcagctctccccatgtctccacctctagaggtggggttcagggatttgcataactaaaaaatttatgaaagtgttgtcctacctttctcaggaacaccatttgtgaattattttcccaaaaacgaggtagaaattagaaatctagagaagtaactattagtacatgaggtcatattagtgttttcttgttgggtttttttttgtttatttggttttttatcttatggttttttatttatttgatttctttctttacgagacctcttgtggcggtggggggcggggaatgttcatttttttttaaacctatttgaccagcattgtttccttgaagaaaacctagatttcagatacagatgtttatgttttgatttatcttaattgctctggtttggtttttgggtttggtcagcactaacgtactaatgtggttaaaatgagtcctttgttttgggaggccaaggcgggtggatcacttcaggtcaggagttcaagaccagcctggtcaacatggcgaaactctgtctctactaaaaatacaaaaattagctgggactggtggcagaggcttgtaatcccagctactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatcaaaggttggtaaacgtgtgatctcagctctggaaaccccattatgcttatgtcaacggtgatgtctgagtgttgaggtttgggaaaggtgagtttccttgacttttcaaaaaattttagattttcgtatggtccaccatagacaaatgagtttaatcaaaagtcatagcttttttttttttttttttttttgcgacagagtctccgtctattgcccaggatggagtgcagtggcacaattttggctcactgcaacctccgcctcctgagttcaagctattctcctgcctcagcctcctgagtggctgggactacaggcatatgccaccacgcccagctagtttctgtatttttagtagagacagcatttcaccatattggccaggctggtctcgaactcctgacctagtgatccgcccacctcggcctcccaaagtgctgagattacaggtgtgagccaccatgcccagccaacttttatctttaagtaacttgtgatgtttcaattgcaaaatcctatgcctttgtgacttcaagtgacccctttcataatccataagtgtttaatgaatgtctaccatatacctagccttgacatggaaacatttttaatacaaatgtctatttttattttccttttgtttggtgtagagaaaaaatagccagttcacaatattttataaaatagttatgaagagaatgtcagtatactctacacatatcttgtttcatcttatcaagtaacactaccaacaatgtatagaatttcttcaaactgagttttatttggcttgtttggggattttttttttttttttttttttttttttggctaaaaagtaggtcctgaaaggaggacctccagaatgtgctttgtgtcattgtgtcgagtctttcttttgaaggtttaatatttaactatttatttaatataagcttttcttttgctgttagactgcttttcaggaagccttggacgctgcaggtgataaacttgtagtagttgacttctcagccacgtggtgtgggccttgcaaaatgatcaagcctttctttcatgtgagtattaaacaatgtctgctttgtaagagatttgtgttttttgagttggtggtcacagtggtaggaaagaaagacagttaaaggattttggtttcggtggggggatttctttggctggatctttggtctaaaagtagtagtataacaaataatttaggtttgatacatgtagcccattgaaaacaaattttagaagttaattttgtcttaaatagttctttttttccccacattgaaacatgggccttatttgaaatcccagcctcagaatttgatatgccaagctgttttatactaagaaaaatttgatttagagaaaatttatgtctcttagatctatgtctccaaagatctaaatttttggatctttaattagtctctacttttattaagtttccatttaagaagcttgggtatgttgattgccattacctagttctaaatctttttggatttttcattttaaattttccagtccctctctgaaaagtattccaacgtgatattccttgaagtagatgtggatgactgtcaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggagctgtatatcacatcctaaagtaaacaaaaataaatgagtgagacttctgaatcttatcggccacccacctttctaaaaccctacattctactttacactctgagatgtgcaataaatggagattgaatttagctatgatcattacatccataggcttgatggagtcaccaaattatgagaccgcttgtagggctctttgtgaacttgcagtagcatgagaacctgcatttgcaagcctattctagtcttggttgattttagtcaattagaaaccacaaatgttttaacaaataaacaccaaggtacctgagagaataatttggaagaaattccagggttggttgtatttaacaaatacttgttttgcactaggtatataccaggcactgttctgggtggtttttaagtatcagttcatttaatcctgagtgctgttatcatccccattttatagatgagaaaactgaaacacagaggttgttcatgaagtttcagtgagtatgtggctgaactaggatttaaaatgaagtggtctggcttcccagcccttgaccttaagcactacccatcggaggatgctctgtcttgtgggtgtagatcgggtgcttagcacatgaccacagacctaggagagcgggttgaggaggtatcacttcggggccctttacagatatgtgagcattttcacttagccctagtggagaaggaaaggcgatgggggaagggtgcagtgtggcaacagaggcgctggacctggcttccagtcctggctcactagcatctgcttaggccagtcactcctcttccttgagccttaagacctgccccatcaacctcccaaggttgcttattcattgagcaaacatggaatatccaataaagggtgaagggtcacttaaaacaggcatatggcagtgctctctaaacatgggagggcgcaacaaccccagattgtgtattcttagccagtttttgactctgtgccttgggcaacccctgccttggcttgtgctgtcttctccatctggcctgtcctttcctttcctacctgactaactccttgtcatgagcttcaccccttctccacttaccgccttgtgtgccctaagtacccagtgaatcttggcaattattataatgatctttatgtctgtcctttaccattagtctcagtagattcctaggatcagagaccctgtcttaattcacgttggttgccccttcacctagcacacctgccttgcatgtagtataggtgtggaatgaatgaatgatgaatgtgatatggttgttaagttactattctagatgtgtcccagagttgtttttttttttttaaaaagagtgtaattgcatttttgtgaaaaatccttatcccttgttttaatcaaacttagtcttattaaggtcaatttagctaggggaaaattgcacctggaatagagaaattctaactgccactgatcctatcagatagcaacttgattttttttttttttttttttttttttttttttttgagatggagttcactctgtcacctggggtggagtgcagtggcatgatctcggctcactgcaacctctgcctcccgggtttaagcaatcctctgtctcagcctcctgggtagctgggattacaggcatgcaccaccatgcctggctaattttgtatttttacaaaattaaaaccccagtagagacggggtttcaccatgttggtcaggctggtctcgaactcctgacttcaggtgatccacccacctcggcctcccaaagtgctgggattatccaccacgcccggccttgatttttatttgaaagcaataataggtgccagatgccatgataagccctttgcatgcactatgtcatttaatcctcacgataactatacgagtattttttattagcaccctcattgaacaggtaatggcactgcagcacagaaggtaaagtcagtctcttgaggcagaccaatgcaccatactgtactgaggacaggtcttcttactgcctttaggaagtacagtcatgcatcacttaatgatgaggatactttctgagaaatgttaggcaattttgttgtgcacacatagagtgtacttacacaacctagatggcatagcctcctgtacacctaggctatgtggtaaagcctgttgctcctaggccacaaacaggtaaggcatgttactgtactgaatactgtaggcagttataacacaacagtaagtatttgtgtatctaaacatagaaaaggtatggtgaaaacatgatatgaaagattaaaaaatggtatgcctttataaggtacttgccataaacgggacttgcaggactgagaggtgctctgggcgagtcagtgagtgggtggtgagtgaatgtgaaggcctagaacctgtagacgttataaacactgtatgcttacaaattttatttttaaaatttcttttttcagcaataaatttattgtaacttttttactttatagtttttttatttttttaactctttaactcttgtaataacacttagcttaaaacacgaatgcattgtacagctctacaaaaatattttctttatatccttagtctataagctttttttaaaaagactttttaaactttttgttacaaactaagattcaaacacatacattagcctagaccaacacagggtcaggatcatcagtatcactgtctcccatccccacatcttgtctcacagaaaggtcttcagggacagtaacatgcatggacctttcatctcctatgataacagtgccttctcctggaatgcttcctgaagggcctgcctgagcctgttgtatagtaactgtctttttaaaaaaataagtaggagtacactctaaattaataatgaaattaaagtaaatacaaaaaccagtaacgtgggtgtttattatcaagtagtatatactgtccataattgtagtgatatgcttttttaagtgaaagcaagtttattaagaaagtaaaggaacaaaagaatggctattccgcaggtaaagcagtctgtagtggtatactttgtatgtaattgcagcgcagatttgtttgcaccagctaatgcgatgggctatgacattaacccatcactaggtgagaggaatttttcaacttcattataatcttatgggaccaccacatatatgcaatctgttgtcgatctaaatgttatatggtgcattactataggtgtgcaaagcactcgaggacttccgtatgacagagctcctccttcatgtctgcttggtgcaccctgatcaccctgaatgtatcttttttttttttttttttgagacagagtctcactctgtcacccaggctggagtgcagtggtaccatctctgctcactgcaacctccacctcccgggttcaagcgattcttctgcctcagcctcctgagtagctgggactacaggcagccgctaccacaccaggctaaatttcaactttttagtagagacagcattttgccatgttggccaggctggtctcgaactcctcacctcaagtgatccacccgtcttggcctcccaaagtgctgggattagaggcatgagctaccgtgcctggcctgaaagtgtcttttaaaaccttgaagtgaccctctgacaaactgaggaactttaactttgcctccatagattgatagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaaaaagtaaagattacctagaaagaactcctcaacagtagtgccacccaccatcctagaggtcgtcatagtgtttgtagctggcctttcttccccttgagaattctccgttggtttccgtgatttggttatcaacagtcctgcctgctcgcttgctgtcctgtgtagcttttgctgcttaggtgctgagtggttctatatttctttcccagtcctcttttgagtgcctggctgacattttcaatctctattgggctccaaaccaaaccagtttcgtggtattgtcctccaaaccttgccctcttatagcatgaacaatgtgttgagcatggggtattataagagttctcatttagcattccacagttgaggaatgtgtgttacttcaattacctttgagctgtagaaaaatctttagctgtggtaacagccacttctaggagaggagaaaatacggatcaactagcccaatttgcgatgttaggaatttgtcgattttcttagtaggatggctttcaaaggttagagcatcagagtcacctgaagcccgactttaactgtaatggtttaagatggggttgatggggaaacttgtagtacccctcaggtaattctgatactgcagcaaggtttgagaattcacaaagtctttttatttttcctcccgagatagtctcattctgtcgcccaggctggaatacagtggcatgatctcagctcactgcaacctccgcctcccaggttcaagcaattgtcctgtctcaacctcctgagtagctgggatgacagatgtgtgccaccacacctggctaatttttgtatttttagtagagatggggtttctccgtgttagccaggctagtctcgaactcctgacctcaggtgacccaccggccttggcctcacaaatcagtttttaattaaaaataagcaggaggctgagtgtggtggctcacacctgtaatcctagcactttgggagcccgaggaaggtggatcacttgagctcatgagtttgagaccagcctgggcaacatggagagaccttgtccctataaaaaaaaaaaaaaaaaaatatatatatatatatatatatatatatatatatatagtgtgtcagataacatatatttccacaaatttttaaattatctgcttcaaatttaatgacagtttgctctacatttgttcataattttatattacttttcttcttaataaattgcaagattaatattcttgcatgaagaacgaggtttcaaaaacaggaaaacactccgaatgtaatcaccattatattatcatcttttttgaggaaagaagatatatataagcctggtcccagactgcatatacctatcatatgataattcttgtactgcatggtcagaaaataatgagacatgcaaaacatttaacagaaaagtggcgatgagatggccaaataggaacagctccagtctacagctcccagcgtgagcgacgcagaagacgggtgatttctgcatttccaactgaggtaccgggttcatctcactggggagtgccagacagtgggtgcagtgcactgtgcacaagccannnnnnnnnnnnnnnnnnnncaggtgtggtggcgtgtgcctgtagtcccagctactggggaggctgaggagggaggatggcttgagtctgggaagtggagattgcagtgagctgagactatgcccctgcattccatccagcctgggtgacacagccagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggattaaagagcatattggatcgctggagtatctgatgctagtaacattctgaacattctgcctgttaatgtgcccgtcaaaggaagtaaatattaataaaacttcttcattgagaatataaccggtttggcttttgtactgccattatattcattatattaattttcatatgctgaaaaatgtcctcatgcggaaatgtggggtacatgacagggaaaagtttctggttttggattacttctgtcaaagctcagtactcgcagtcttgtatttaatcctctccctttgctactttccctaccaggatgttgcttcagagtgtgaagtcaaatgcatgccaacattccagttttttaagaagggacaaaaggtacgtacatctgacctttaaaactctaactgggcaataggaaacccagtataagtgaataaatcactggagtgatgttccctttaaagattgaggcatatcaccaagttctgcttttaagaatttttaaatatgccaaaattcattggcttaagtacataatgtgacagctaactgaaaatcaatctttcctagaactagtcctatttatatcataaagcacatagaatttcttagacttgggcagttcatttgttgttaagtattgtgtaaaagaaaatttgtacttgagccttttgacttttctcttgatattttttctttgtttataacttaaatgaactgtatgttattcagggaagtttactttaaataagattatacttctttttccctccacccctattcttccttcattctatgctgaatacatatttatacatatgtatatatatacatatgtatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgttatcttttgacagagaaaatagcattctctgttttagcaggtgaatcctctatgctctccaaaagatcagcatgaccaaaattgatgtccactcatgaaggacttgttcgttttgtttgtttgttttgccacgaggatcggatcttgattctcctcgaagtatctgagaaagtctagttgtataggccagacataggttctgtcttgagtggtaaaagttgtgggaaattattacttatatcattcaaagaacattgtttcttgtgttctaagcacagtaaggggttgggggtttgaagaaactttttgagtttacataataatgaagagcagaattatcatatgccaggtatcatctttctattaattcacttaatctttgtaacaatcctattagatatagacactataatccccatttacctgtgaggaaacagacaaagggtggtaatttccccagcatcacaactagtcattggaggagctgggatttgaaccaaagaagtctggtaccagaatatgtgcctttaactactacattgccctcagtgcaacaatctgagtaagcaggaaaatgatgggcccttagttgagtttctttcctcatgtgaaattaggatgccaaacttagatgatctctcaaaatactaatggaatgcctgttatgtgccaggcatcatgctaggcttgggataaagctgtgactaagacaccctcatcctcatacagcttacattctagaagcagagacaaacaggtgaataatagactggtatattctacaaggcaaaaccaaaaactgggcgcagtaatgagaagaataggggaaccagctgtgcatcaggtggttggacctgggttctttgaggtgactgtaaacagagctgttggataaaaagtactccaacctgctgagagccagggaatcagctttcaagcagagagaatgacagacacaaaggcttgagtcaagaaagagcttggtaccttgtagaatcatcagaggagcatgaaataaagctcgatagagtggcagggccaggtcagccagggcgttatttgttctagaacggatgagaaaccatcgaagggtaagtcagggtacatgctttgttaacaagttattttggcacctgtatagaaaacggaaactaaaaagtggaaaaccagttaggcttttttgtttgttttttgagatggagtttcgctcttgtcagccaggctggagtgcaatggcgcaatctcagctcactgcaacctccgcctcccagggtcaagccattctcctgcctcagcctcctgagtagctgggattacaggcacccgccaccatgcccagctaatttttgtatttttagtagagatgaggtttcaccatgttgaccaagatggtctcgaactcctgacctcaggtgatccacccacctcagcctcccaaagtgctgggattacaggcgtgagccactgtgcccggccccagttaggcttttgcaattacctagatcagagataatgatagctgtgactaggaggacagtggggaagtgacagagatggaacaaagcctaagggcctgtgagaggaagacccaggagtgaatctcaggtttctggcagaagccctgggtgtcggggtatgatgtgatgtcatgagtgaggtgaggatgggagggagaaaggggtggtggtgagggagtcagtctctggcccttctgagttgggtgcttctgaggtgcacatcccactgaaggtgctgtgcaggctgttgggtacctagttgagagct

SEQ ID NO: 15535 - DNA, 131332 bp, Human
ttgcacctgtgttcacagaccagcaatgccttcctcttaggggcagaagctaatatggagattagattgccttcactaattgtcaagaatgtcagtaaaggggaccaacttaagtaaattaatgttagtctcacaacctattgcatatttaagatttgatttgctggtttgcagctgaaataagacggcttccttccctctaatgcatcccttatgcagatggtcctggcttccagcatcctaaatacaattccaatagttttcattagtaatcatcaaatctagctgaatcttctttcaaagtgcctctttttgcctttcactactgacctaacctatctctagcctctcccagttccaacccaccttgattgctgagggcaaatttactttcttaaaacaatgcttggattaagttacgcccctttgcaagaccctttcacctccccgcaagtacctgcagaataaagtccaaacctctagcccaccttttaaggccctgtggagtcctcacctgtaaatctcccccgccctcaccactcctgcacacaaggcaacaaggtctccttggcagcttctgagtaaggttgtccttatttctgccacagtgctttgtccacacctccttgaattcctcaattcctccctctgtcttaaaagaacatttctgagtctgtctgctccatgaagtataagtccgagctcatttttgcccatgccctgctcactcctctccattccttgcagtgaattgtgctaagcatctctggcttccttgtgaaaaaggtgatgccgttctccatcagggtgctgtgtacccactatgtgtgagcggtacagaatgaatgaacatcccagggccctagaaaggcgcctggcacatcctggacactcaacaagtatcttttaattttaatgaataaattcaagatattcgactgtattcattttccacccactttccccctaggccagggactctcctcccaggtgagaaaaaatcatctagataccttaattttgataaagttagcgttgatgtataaaaagcagaacttcctctgtaaccctgtgagaaatgagaagcctccaatcttcttccccacacctaccccctactgagtttcgggttccttggaaataactgacctggattgtttctgacaaaataaaactttgcatcttctccacagagcaaaggtaaccttacctccagccaacccaatcatccatacatttttcttactagaaaaaatgtttttaaaaatggaggtgtggccgggcgcggtggctcacgcctgtaatcccagcactttgggaggccgaggtgggcggatcataaggtcaggagttcgagaccagcctggctaaatgttgacaccccgtctctactaaaaattagccgggcgtggtggcgcatacctgtaatcccagctacttgggaggctaaggcaggagaattgcttgaacccgggaggcggaggttgcagtgagcagagatcgcgccactgcactccagcctgggcgacagagcgagactccctctcgggaaaaaaacaacaacaacaacaacaaaaaaacccccaaacaaacaaaaaacggaggtgtgagggtaaaacgtctacaggcaagaacagcacaacaggtgctgagctgcaaaatcaacacactaaactcccaaacagaccttctcgacaagccaaaagctctttagctaacctaatattctttagctgttgtttcagaggcttttcgagaacaaaactgccgccccgtcttggccttgccgcttttcacccatcactctactgagtgtgtgtctgacttgtttatctggacgcaatctttgtcgcacccagttatctcgctcagcgaccggggcgaccacgtttccttaaatcagagccccgtggactccgccggagaactacattacccagcggccttcgcgcccttcgcaggaaggacgtctgcgcactaagatactcagttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggtaagaggctgtttgcattagttgcaaaaatgcaaagggttgtgcatgcatttatgaatgcatggatgcaattttcgcctggcgagtgcatttttaagtttgaggttttccacagctcagttgcatttcctgtttagtatgtgtctttttttgcagacacagagagttcctgtaaggcagggcttgcagttcagctgtgcattgacgttatttgcattcttctgctaggattactgagctctttttgccttttgcacagtcaggagagacagagcaggttggtagcgtctaaatgtgcaaggctttatataattgtaaaattctttactatgcacagatattgtaagtaattttgtatgcaacaggaatagaaacttttaaaaactctataggtgaagatgaaaggtaaaacttgagttaaactactaggaaattaatgtaatcttatattctttgggggaaatagaccgttgcggtgccagtatttagctaaatttccattgatatcgccttgaacattaggtaacttttgatttttaaaggaagtaaaggtgaagggtgaataacagcatatcacaaaaaagcagacgagtcttgctcttctgagattttgcactttacaccaattgcttattggctcgcaaaatttagaagcagcagtgaagacctaatgttttatgtctgcccatttgggggatgctttgcatcttgggggaaaatattgggggtaaaactgtacttttaagcattacagtagtgtgaagggactgcactgtttcattgacaagcataatgaaatattttaagtgtgtaactgcgtgtatttagtcagctgtaataggttggaagttcacgttatggttgttttctttatgttcttttattttcttttcttaatttttgtttttaaacacagttgtattttgcaggcttaatgtcaccctgggaaggggatttaaaaaattcctgatatgacatcaaagagcagactaggtgctgtcaggtgcccctgggaccccaaatcacttgtttcagaacaattgtttctttaccatggagaaagcatatgccatatgagaagtatgggatgatgaagagaggtgttagatactattgaattaggctacccggggcactctttgagtaagacatggtgaaattaaagggtctaacaagctttttgctacttttttgggagggagtgtggggagttgttgcactgctttttaattctacctgatgggagtcatatatctcagcagcccaagaaggaagtagtaatctcaagcattcaaagtagcactctgcttttctttgagtattaggggagaatggaaatctgaaaagttaagagtgctgaagaacctaggaattgacatatcaggtggagatgttcctcaagtggggaaaacctaaaaatctccttattgagtagagaaataatagttcagaagaggcagtccatgctttgatgtattaaagagatggcatttagttactttgtatttggtaaacattcgctcattcattcaattcagtttaatatatgtgtaatatattgtgatatgcatgtatatacatatgtatgtgtgtatatatatgcatgtatatgtatgtattgtgtgtgtatgtgtgcacatgatttagggacacacaaaaatatttaaaatgaagtttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagaaggtggtgtttactgtgatcttatctttggactttagggtctaaactaaatcaggctcctttttgcatatttttgggctcactatgaacgtagctccctcttagtagagccagtttttgagttgagaagccaaaggagatattagcactgtactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagctacgctattctcaaatggccaaaatactttttgcagtaccaaactccttttttaatattctaacccaagaaatgggaggaaaagtgaaaagtggatacaatctcatagtattgaagaatttaacaacatgttcaattcaaggacctttacgaactttctagatcactataattcggtttaacagacctctaatttaaggcacagcagaggcaaaggaattacagactctctggaagctggaaggactgggttactgctctacagccttaccaacagtgagattccgagaaagaatttcttaaaaagaaattttgttttccacagttgtaactttaggtggtatgcttttcagcttgtttatattagctgtctggggttgagttgacatttttcaaatattaaagcagtagaatgccttttgaggaaatctgaaatgtaagttaacaggaagggcacccagaaagtgcaggaattcctgcacactacaggaagacaagctacaggaaaaatgtgtcatctacactacccgggagagaaaaactattgttatcagccataatgatctccggagggagggagagaaagagggaggtagggagatctggcatcccccagttcacctgaaaatacacaaaaagtttgaccctgttaaaatacacttttctcacttctcctcctattcacctttaaaaaatattagtttattttagttttagagagcaataagtaaatcatgtaagaaatgcctatgaggcacaattcagaagcatatagcagagtggtaggaaaggtcttaactctactggggttctttgcttctgtaattcattccacccttgggaaatgaaatgtgtaaatttcttgttctctataaattcctttgttaggttgtaccagacggacttgtcatgcttagcctgtaatctgagccagtatgttttataaccccgtacatctcaggacacaaaatcagaataggtagcttgggtttcctgagcttgctttgtattagcattgcattcagttctttagagcatgcggcctgttaactgtagggggcttcaggggtctctggttggtaaatttaatgttggagaaaagagttgagattctcttgtctttgtttttcagattagtgttactttaatgactccccagtattttaaaatctgaaagatctacaaggaatatttttaaaacttaaaagaaatttcataaataacccttgttcattatagaaacatttcatagaaaaggaaaaataagaatgactagttactgcagtctacactttggcatttattctcttggacttttttttctatctatgtgtatgaagcatccaaaatgtgtgtaaaactaagtctatttcgttccctcttgtttcacttaccaatatatggcaaaatattcccaagtttatatatttctacattcatagtatcctcttccattgtatttatttaaatagaatcttaatgtttattaactttcactattgtgaatatttccgtgatgatcataccagttcctacattatcatgcatactatgcccttagattaaattccagggagcaaaaccacaggctttgaatgtccagttcttcttcactctccattctcttttcttccttctgaaaatagctttttattattgcaaaaaaaaaaatgacatatgctaatcaaaacattcaaaccaaagataaattcacaataagaatataaaactcactcaaagtcataccacccagagctaattactgttagttttttgggtactatctccatatttgtatgtacatgttattttacacactatatattgtattttgtaacttgcttttttatactctaccatatatcttggatatctttctgtagtagtacacataaggttacctattttttaacaaccgtggattttaatttgtaagaatgtagccatttacttaatgtcatattgagttttcaaacagtttccatttttttgcacagctatacacagtactgtaaggaatacctggaacatacatctttatacatttgcccaattatttctttaggatgattcctagaggtggaagtcctgggtcaaagggcatgtatagatatattgctaaattgcccttcatagaggtaacactaattctcatttctaccaataatatttagacgtgcccattctgtcctttcaagcataatggtacatattgccaagtaaattgctcttcaggaagatggtacctttcttcatcctgggtataacaatttgaaaaaatctttggcagtttgatgaaagctattaatattctactctaatattattagtgataaggcagttgcatttttcagtttttttgacatttgtgtttcatgtgcccaaatttctttttttctcatgaaatatatccttaaaattttaatttgggtggccaggcatggtggctcatgcctgtaaccccactttgggaggccgaggcaagtggatcacctgaggtcaggagttcaagaccagcctggccaacatagtgaaaccctgcctccactaaaaatacaaaaattagtcaggcgtggtggtgcacacctgtaatcccagcttcttgggagaatcgcttgaacctgggaggtggaggttgcaatgagcagagattgtgccactgcactgtagcctgggtgacagagccagacttcatctcaaaaaaaaaaaaaaattaattaatttggggatcaaattattttcaaagttagccagaaaatagcaatattgtagaggttaggtaatcctggattgatagttgggttctgtgtatctaaacaatttaattccttgatgagttctaattttaattttaacctaatgtcttaagctgctatcacatattttataaactcattttatttatatagtctatagctatccagacctatatgaaaataataagaaaaatgtagtgatctgattaaattccagtctgagaaatagcttacttttgggcattcctgcattttcagttatcttttcaggcaaaattagtttttctttaggtttataaataattcttacatagcacctggttgtgttatatgcattgttgcagagaaatttaatctaattttttttagcttcctgtgcaatgcctaatcacaaaaggtggttgacttaaatttcctacatttgttaaaataattaagtctagaatctttaagattcttgttaagaatcaattttaatgacctcacaagtcatataagtcaatcagatttaacatatccttaacatagccttaataaatgcgcctatttatgcatcctgatattaagtgatagaatttagagctatgaaagttttatagtccaatcacttcattttacacataagctaactgaggccttggaagtgagtgactttcctgaagacagtagagtggagtcacagggagaagtcagatctacagattctctgtccgtaagttcttttcactaaaccacacgtgaacactaataatccacatttataaaattttttttttcttcagaatctttagtatatttcacatttttagctttgcttgtttttgttgggagcagtctggcaagggggagctgatggtataatgagcaggggttatttttctgtgtccaagaaatggtgacatgtgaatcatggtggtggggtttcttaccagttctctgccaaaggatattttgcaaatgctctcattttgattcccagtgcctacatagtacagctgcaagttttaaccactgtaatggttgtttgccttttatggactgtcttgtttgaaagcccttgctgggtaactaaaccttttcttatatatctttacatctctgactcttatagcattgtccttataaataataggtgctcaaaaaatgtctgacaatgaaagtatttttcatcagtagggataagctctcatttgctcctaagttttatgaaagatttcgggtaattaaattacaatgcaattttcttcttgtgcttcttctttgtttgcactgatattcccattatgtatttgcttaattatttggaagttgcaagaacagcatgaaaagcaacttataatggctggcgaagtgtcatttctcctacctaagccttctgaacagatttaaaggttgcacaattctctgctaactttctttttaaaaaatatgagaagatgaattgtccgaagaatcccatccaatagaattgaagtgatttctgcatcctgtgctggttttaggagctggtttttaagtctatgaggcttctgaaggattgtcagagacaatcctttttttgttgttgttttttgttttttttttttgagacagagtctcgctctgtcacccaggctggagtgcagtggtgcgatctcagcttactgcaacctccgcctcctgggttcacgccattctcctgcctcagcctccggagtagctgggattacaggtgcctgccgccaccatgcccggctaattttttttgtatttttagtagagatgggatttcaccgtgttagccaggatggtctcgatctcctgacctcgtgatccacccgcctcggcctcccaaagtgctgggattacaggtgtgagccaccacgcccggcccagagacagtgtttttaacagctggctgccctctaacaaaacagggaacttcgcaaggatcacctcccagtgaaatgattcttcacttcctccttgaccacctccactgcctctgcccagccccttcctccctggcttgtaccccactctgtctcctttgatggtcttcctgagttggcccatgcggttcagtatgtagtccataatctccctctttctgagttgaggaggatattcaggttataatccccatacaatgaagtctatcagaaatcatcgtaattttttttttttttttttttttttttgagatggggtcttgctctgtcacccagactggagtgcagtggtgcaacctcagctcactgaaacctctgattcccagtttcaagcaattctcctgcctcagcctcccgagtagctgggattacaggtgcctgccaccataccaggctaatttttgtatttttagtagagacagggattcatcatgttggccaggctggtctcaaactcctgacctcaggtgatccacccacctcggcctcccgaagcactgggattacaggtatgagccaccacgcctggccaaatcatcgtaatttagtcaactccagtctgagttgaagcattaaataagcatttgcagcatccctgtcatctgttttactttctggtctgtacatcccttcttaagtcagattcttgagattagtcttctttggacagaccattagccccaggtggagctgctgatcacaacccctccctgtaccactcccaaggctgttgtcatcatcacttaccctaagccagttacttttcatatagtatgctttaggatgtcccataaacactatggacaaagttggtgttattatccttaatttacgagtgaggaaatcaattgttgttaaccaatttgcccatggctggatagcgagtcagtggcagaggcaggatggatgtctgactggtgggcctgtgcagcaaactgcagctcctgggccaaatctagcttcagctgttgtttttgtttgtttgtttgtttgtttgtttgagatggagttgcgctcttgttgcccaactgggagtgcaatggcgcgatcttggctcactgcaatcgccacctcctgggttcaagcgatcctcctgcctcagcctcccgagtagctgggattacaggtgtgcaccaccacgcccagctaattttttgtatttttagtagagacggggtttcaccatgttggccaggatgatctcgatctcttgaccttgtgatccatcctcctcggcctcccaaagtgctgggattacaggcgtgagccatcgtgcccggccaagcctcagctgtttttaagtatagcccgtgagcgaagatggttttcccatttttaaatgattgaaaaaaaatcaaaatcaatgtttcatgacacatgaaaatgatacgaaattcaaattcagcatcgacaaacaaagttttattggaacacagctatggtcattcatttatatgttttccatggctgctctttgctcgacagctgtcgagttgagtagttgcgccagagcccctatgtcccacaaagccaaaaatatttgctatctggtcccttgcagaaaatgtttgttgaccctttcctttatgactttattccatcgaatactggggtctcttcatgacagagctcccagaaacattcctctctggctttaattggaagttgttaacctggataactactgctctgctgctcagccagagacctcttgggcccagcccacaggaaacgtctgagtggtgtctctcctagttataagaattgtaggtcattgctcatttcctctgaactaagttacccgtctccttttgcccgtcctggggtcttttccccttagttgtgttcttcctgtttgctttatatttctttcctttttttcttcccttcgatgagaagctgcttattaattcttccctgagactcttcatcctccccttattgatcccacatttctttagaaagtattaggttggtgcaaaagtaatattgttttttatcatcacttttcatggcaaaaaccacaattacttttgcaccgacgtaagaaatcaaaaataactctcctgctaccaccattgcctggcttgttggttatcatcatgacccagctcagaggttccatcatttcttttgtgtcaacgtgaaagcctccctgcatgggaccagagaggtttccagttatcatctcctgcaaagtttagagctgttttcttacattaaccccctaaccccgggtgggcaattttcttttgaggacgaatattctttgtgctcacagagtcgcttacatcgtggatattgggtatatttaggagagaaggttttgatagagggtctgaaaatgaagggaggtgaaagctacatgtagacagaggagctttggtagaatgagcccagatttgttcaccacatccagaatgatgtaaatttaagtcacgtacaaagaagtgctaatttctaccatcccagatggtatcactgctgtgattctttctgtgctccagatactgtgcttagtgatgaatgtgaattctatcatttactctcactatggatcagtgaggtgatatcccattttgtagatcagcaaactgaggccggagaggttaagaacttgcctcagttaccaaaccgatagtggcagagcagaggttttagccaaggtctgtctgacctcagaatctgagctcctggcgactccacttgagacgtcactccaaaataaaggtatgaaatccattacaccaaagacatggtcgaagaatgaaaaacgagtgtattctgtaggaatttggatagatttgggcataccagggccaagtatggtaattaagaagggctgacctgtgtctagctatttataggttctttttgacatgtccctttatatgtcttttgatcacagagtacagagtctgactcattttgactcttaaggttgagttccaaatagaaactgcccattggttgaaggaggctgattacaattggcccactgatagttactggtctggatatacaggaatgttatgttaaaatgtaggtaacaaatattgcttccatttgctgttctgtaggttgtatcacacagaaactaagccgactcaaaccttgtgtgtttccttacacatctaagttaaattgtattaaaactaacaagaacgtggccagtgtggcagcatacctaagtgtggggattttgcagcccctttttggcttagtgactttttttcttcctggttgtttctatgtaaatgtaacaatttccttgaaatgatgaatgaacccacatctccagtgttttcctcttgtactggacagagtggaggaaactggaattgcctgtttttgtggcagaggaggtagatggggatggaaatgaatttccttttaaagcaatgaattctttttttttttgtttttttctgagatggcgtatagctctgtcacccaggctggagtacagtggtgctatctcagctcactgcaacctccgcctcccgggttcaagtgattctcctgcctcagcctcccaagtagctgggattacaggcgcccaccaccacacccagctactttttgtatttttagtagagatggggcttcactgtgttggccaggctggtgttgaactcctgacctcatgattcgcccgcctcggcctcccaaagttctgggcttacaagcatgagccaccgcacccggcctaaaccaatgaattctttctcggctttctctccagccaaagcagaacagctatacctatgcctcagttgtttttcatgatcccatgtcgaagctgcggaaatagatggtctggttgttgagtgacaagttatttattcccttcctttattctccctcctccaatttcaaatgggatgagaggagatagctgtaagcgtagggctagaatctgaagaatcagtgggaacagaatagttcagagtatggaaattagtttgaagtaaatgtagagataacctttttgtgatatttgtaaaccttgcgaggcagtcttcacagtttatttaccccttcctgtacccgaaacacctttgccatttgaaaaaaaaaaatcacaaactctgcatatacctaaaaagaggacttggataaggagtttgtttagatcaattcaacaaaggtttttgtttgtttgtttgcttttttcattcagggtcttctatgtggcccagtctggcctcaactcttgggctcaaacatcctcctgtgtagctgggattacagccagtgccactgttcccggctcaaataatacatttttgatctattgttatgtttaagacatcatgctgggtagaaataggcagaaatgcatttgactttactcttccagtgattagccatgtggccttggaaaatctacttaacctctagcttcggtttcttcaccttctaaataaaaagactgacactcattcacgaggtctttatgaagattaagcaaggtcatatatgtaacatgctttggccagtgcttggcattcatttattcaacaaatatttatgagtgcactttatatttgaggtactttgctatagtactctctctataaacatacatttgcttcactcttcctttccttccagcccttaaggaggttattgtctaggaggaggtaagaaaagcataaaaatgtgtagaatctaaactggaatcctagattagcttaaaagaggtactattgagtgggaaagtcctatgaataagagagagatcaggaaagtgttgacaggtgtggaggtatcaatgtgatttttagaatcaatgaggaaattagatccaacataggtacgggaaggactcttgacttctagtatccagtggcacaatagaacaataaaatagagcaattctttagaaggatttaaaaaaaaaaaaagaaaagaaaatgccccagcaaagtatctgaagcttaagagaccttacttgtgttttctaagaacttcctttttcttaccaagattaatactgtagctattgcttgtgattgcaataggtgaataaatggaatatatcatatctcatacttttaggtgttttttggattgtggaaactccaggaaatctagaggttaatagttaaacaagtatatcatatcaaccaggtttatagacacactgtaattatataagcaagctgttggttcaataatcaacgtctagctgggtcagggaatattttccagagcttggccacggctgtaattttcattttttataacctgctaacatgccaacctgccttttccatttctttttgtttttctcgaatcatctgaaatcagtgtaagagaaggaaacctgttcaatgtacttttgaattctcattttatttacctcaagtaaaatagtgttctggaaagttcttcgtattaccaaattgactttctcaagcatgatactggatattagcaagggagttcataatttattttctatttttaatttcagaaaaatacagttctaagagataaaaagataaacatataaaaataaaaaggaagataaaaatacaggataaaagataaaatatttaatacaattaatagattaaatacattttttcttttattattttggtttcaaaaacagagtgacgtatagctctggggctcacagtgggctgtttctctgtgaacctagcatttaatcaccttctttccctcaataactccatttaaacagagtcagtacagtgtgaaggaggtgaattgagtcacccctcctcagattcatgtaagccacagggcagttttggcctcactttgctgtgtggttaaagataacatatgacccagccaggtagaagacctgtcagccatatcatctcattcaagtggcctgcaaagtcttcttgcttgggactttgttcctgaatgagcctctatttttgtaaggaaagtagaggaaaacaatgcagatttaattctgaaattggtttaagaatgggattgagaaattttgatatattcagtctggaataattgttttccatcccgagtttcattctttctttttgatgtaaccctatctaaggacaggatagctagtcagtgttgagcaagacatggcaggtagaggactagctgtctctggattgcatttaacaagcattatagaacaaccaaataaattatctgtacctcactctgtgctagactgatacaaaaatgaacagaatcctcttactaccctcaagaagctcatattctagtgggatgtctatgtttgctagagctactgtaacaaagtaccacaaattgggtggcttaaaccacggaaattaattgtctcgcagttctggaggccagaggtccaagatcaagttggcggcagggctggctccttctgaaggccataaggaaaaatctgttttgtgcttcttccctggcttctggtgtttgctggcaatctctgcatttcttcccctgtatactcatagcccagactttgccttcatgttcacatggcattctgcctgtctgtgtctgtatccaaatttcccctttttataaggaagccagtcatattaaagttagggcccgccctactccagtatgacatcatctgtcatcaagtaagatcccattcagagatgctgagggttagctgagggttaggacttcagtatattaattttaggaggacatagttcaacccataacatggcaggcaaacatggtcagcaaactaatgatactctgtgtgaaatgcatgtaagttctggtataagatacgagtaggataccaaagaaggtgggtgcataactcagcctgggaagatcaggagtctgttggtagaggaaggaccttaagttggtatagcagaacttgcagtgtggttctcaggagaataaggaagtaaaacaagagacttcccatctggtccttgaacggacagactacctgccctttcttctgtttttgtttttgttttttttttttttaattgttaatgacagactggatggttctaaactggggtgtgttaaattagagaacacacacacacacacacacacacacacgttgttgtattgattcccaaaactgaatttgtgtttagtggtaatgagacctacacaacactccctgtggttgtcacaggcagctttgatgtacagatacagggacaggacttggtggttgggagaaaggatcatccttcccattgtaacaaatggtcctagtcctactgggacaaagtttcagagggagagagtgggctgggctggtggctcatgcctgtaaaccccagtcaggctggaggctgagacagaaggatcacttgaggctaggagttttgagaccagcctgggcaacatagtgagactctgtctctacaaaaagtgaaaaaaaaaaaaaaaaattagccgggcatggtggtgcatgcctatagccctagatgcttgggaggctaaggtgggaggatcacttgggcccaggagttcaagtttgcagtgatcattccactgcactccagcctgggcaacagggtaagaccttgcctctaaaaggagagtgagagagagagagtaagaaccaagccatggcaaagctgatttttagataaggcctgtaagtcttaaaaaaaaaagtattcatgtgttaccaagctcttgcaatattgattattaacaaaggtcttttcaactatgtgtatatttcctagagctaatatgcagctttattttctttatgtgatctgggtacctttagtataaaattatgagtaaaatatcagaagctgtttcagtaagaaagggcactaaggaaagaaattgttaggcatgttgtgtgaggtggttgggggtcaggtcagtggaaaggaacttttccagctgagagctgatgtccatcatccatcagattatcctgctggggtgttgatggcagcaggcttcaagtgtgggggccaggtgggcaacccagagaaagtcacaggaaggtgaagctggggtgtggggcctgggcatcccttggagctaggtagagggatagtcgtgggacaggtgatccgaataacaaaagaacaggtgagcagcagaggctcagcagaaagtcaagaattagatgagtcaatgtggaaggggaagaaagaaataataaaataggccgggcacagtggctcatgcctgtaatcccagcactttgggaggctgaggtgggtgagtcacttgaggtcaggagttcgagaccagcctgtccaccatggtggaaccccgtctctactacaaacatattaaaaaagtaaattagccaggcgtggtggcacatgcctgtaatctcagctactcgggaggctgaggcatgagaatcgcttgaacctgggaggtggaggttgcagtgagccaagatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgaaagaaatgattatacatctctgattctttcagcttcagcagcaatctttgttcatctagctattatgtgaagatgcactcataagaagcctgagtaggtagggtgtagaaggacacacagaaaaagagcaacagaaactagtttggggcttgtttcaaacaagcccggacttatcttccatgctgagtacctgtacacagctctctaagtgggaccaatggagtcagaggaaaacaggaagcagtgaatcagctggactgtcaagccacttcgtttaagacagaaaccagctactggttttctctgtcaggttagagggagcacgcagtctaatgtgaacaagcaaccctgagctctggacttctacattcaaggcaaagctggatagaagaaacgcaagtgctagaggaagggttatactgctactctattctaacaatgtatcagggggatgtagagcgactcactcagtctttgggaaagcatttggcccgtatcaagaacctggacaattttcgtaccctttgatccagcatttttatttatgagaatctagtctataaaagtgattattgagtgcttactgtgtgcgagtctttgtgataagcactttgctaattaggtctaatccttctcaaaacctgggcagtaggcaatatttatcttctttttacaaaggaggaagttgcaactttggtgcataacttgtctcagattataccgttaatgggtgcagagctgggatttgaatctagtttatttaaacactaaagttcatgcttcttttctataccactgctgtgtccaaacagtgaaaaatagaaacacccttattgtataatatacaattatactatattgtatattatgcatataattatgtcttataattatatataataattataatagtaaggggatagcttaagttatcaaatactcacttgatgtaataggttgtgaggagatggcagtaccattaatggaaagatgcctgtgacccaggaggagtggatataaatatatctggactatgattacaaataagtgcatgtgtttgtgtatttatgtgtattttgttttaccttaagtaagagtctgcgttaaggagaatttcatggagtccagttgcaggaggtatagctaggcctggtaggagctaagtaaggcattctctgactccctccctctttctttatctggtctatcccctccctttgcagggtccctcattcggcttttctctgagggtcttctctgctttctgcttttcttgtggaccaggctttttgctcactcatcaatcaacatgcacatagtttaaaagactcaccttctgtgactttcttgcatctatatgatgtgtagttgttccagtacccaccatattttggctaaactttctggtctgagatgacattctctgtctttcagaaaaaaagagaaaaatgggataatgtgatgaggagtggctgccggattggctggatctgagtcaggtgttcacccctgtgcatatgaggcattaaccccatggctcactacccacttggaggtgctgtagatccagcttatctgggtaggggtcacagaaggaacagtcaaatggctgatgtcatacgcagactgaaaggaaatgcattaagcaaatgaaaggaacgaatatggctggttagactgatatttaaatgaagctttgtagtgttgtgacatgtggcattttacatcattcttttaatacaaactctgcataaggttacatactattgatcatgaagaacttgatttttactccagatatatcatttaacccagcattcccattactgggtatatacccaaaggaatataaatcactctattatgaagatacatgcacaagtgtgtttattgcagcactattcacaatagcaaagacttggaaccaacccaaatgcccatcaatgatagactggataaagaaaatgtggcacatatacaccatggaataactatgcagccataaaaaggaatgagatcatgtcctttgcagggacatgaatgaagccggaaaccatcatcctcagcaaactaacacagaaacagaaaaccaaacaccacatgttctcacttataagtgggagctgaacaatgagaacgcatggacacagggagaggaaaaacacacatcggggcctatcgggaggggtgggggagggagagcatcaggacaaatagctaatgcatgtggggcttaatacctaggtgatgggttgatgggtgcagcaaaccaccattgcacacgtttacctatgtaacaaacctgcacgttctgcacatgtatcctggaacctaaaattaaaaaaaaaaaaaaaaggatcttggttattacagatgcatctccttggatttgcttatattctttgtgaggggaagagactcagaccatatacactatgatttgttctgttgctgattacttttataacaagaccactggaacagtaaaaagggctacaataccctctggtgaacaaactgaggcaatgctcttgaaccaagagaaccagaaaaggcacattgatgctctctaatggttaagtgacaagtacaagcttaattgtccaatgatgtgacagttgcccaatgatatgtggtacaaagagtcagggcaagagatatcaggcaaaatctaaagacaagacttcagaatcatggaatattacacatagcagggactttggaaatcagctagcccaaccacctcattttatagatgcagcaattatgaccgagagagattatgtaactggaaaggccaaggtagcggtaagccaagtgtggaacacagatcttgtaaaactcatgcctgggctcttgttaggatctcagtgcatcttgaagctaagtcagactttgactctctggggagcccttatagtcttcctataaagacagaaactaactgctgaggcttaaagatataaaacaaacaagaacaccaggcatggtggaaatcaggacctctgtttattcagtcggtcatctgctgattgagtgggtctgttcaatcgtgcatgtagccattcctctatttattaattccttggacatgtattagctgcttcactgtgtggttcactgctaggcatggagagtgtaaagagagatgattcctactttctagaaactcacattctaatgggggacagatgtctctgccaatgtttgtgatgtaatgatacctcaaagggaaagtgattattaactgcttggatcttgaaaggtgaatgggagaatcaaggattgggagtggacagtcaaagcagatacagctttggtctgtggggcaagtgaaatgacacgagtatctagaaaattctaaagttctgtatggttgggatgtaggggtcacctagcagacccgtgagagatgagataggagaaatagacaggagccagggtacagaaggccttgcagttgaggaggcattgattgcttgacttcaatatactatgaagtgctgccgagagagggtttcttccagcagctagattagcatcattttgtattttagactcaactatgcatctatgtcccttagcaacaggtttttgttaatattctgagctcagaatggaatggatagccaaattggctttgaagagctttcctctggcaaatctacccctaaaagataccaacctttacagagaagagagtttgcatgggttgattagtactgaatgtagttttctttaactaccatttgatgactcaactcataatgacattttgttggcatttctccaacttgcacttgcctctgttcaacagggcatgccttgaggtctgattatacggttttcattcatacgacatgtctccccctctgctttttgtaacttaacattcctgcctgccaagaacgagggagcttgctggctctccccattggcctcttccatgaggtcatgtgagtgctgctcactcacatttgagtgcctgccactctggaggttttacagaacagaaaactcagcctctgtgttctagagctggagcttctgggcctttggaagtcagtcttaatctctgaaacaggagagtgctccagggttccagagtcttacaaaagtgcaggaaaatgcaccaaggttatgataaaatgcaaagccacacctaacatgggctcttccaaatttcataagcagttcacattattttttatttttccactttcttttttttaatcttgaaatttccaaagtctgtatccacagccttgcatagttcttagcaacaaacttagcaacaaatcagagaaaaaaattagttatctatatttttaacaagatctgtgatctcctccacatcctctaaccgccttgggcctcagtttttttgtctgtaactggacggtcactacatactattatttaaagaattacctaatttgattaagaaaatccattaagcccaaaaaatgtgaatacagagatagggtacaaaagcaaaagtgtaaaattaagacaggtgaatgctagcagatgaaataactcaaacattttacctttcctgcactccagttgggctcaaggatatcatccatgcttttgtttttggttgaagcttgaaaaaataaatgacttaaaccatattctaatagtaacctgaatttatatataaaactgacccatgtttgttttccaaaatgcatttttccattttcactctgctaggaataaaagataaacaatggagatagaggaagaatggcctttgaataagaattgtaaatgcggccaggcgccgtggctcagcctgtaatcccagcactttgggagtctgaggcaggcggatcatgaggtcaggatttcgagaccaacctggccaatatggtgaaaccccgtctctactaaaaatacaaaaattagccaggtgtggtggcacatgcctgtagtcccagctactcgagaggctgaggcgggagaattgcttgaacccggaggtggaggtggttttgagccgagatcgtgccattgcactcctgcctgggtgacagagtgagatcctgtctcaaaaaaaaaaaaaaaaagaaaagaaagagttgtaaatggtagaatgtaaaattaagaaaggttgtgaagttttcaaggaaagaacagcattggctttgtgagttggtttagatctgatgttagtaaaagttaaaaaaaaaattttcttttcttttttagacagagtcttgctactgtcgcccaggctggagtgcagtggcgtgatctcggctcactgcaacctccaccaggttcaagtgattctcccgcctaagcctcctgagtagctgggattataggcacccgccaccatgcctggctaatttttatatttttagtagagatggggtttcgccatgttggctaggctggtctcgaacttttgacttcgggtgatctgccctctgtggcctcccaaagtgctgggattacaggcgtgagccactgtgcccagccgaaaaaacaataatttcaaatatgttccaatcatttggaatcgatttaaaataaaaaaaaaaaaaacaaatgtgctgccagcattagattgttagactgcaaacaacactttaaaagaagtgaacagctgtcacacttctctgtcctctgtagagatttagctttggaaagataacaagtttgtaaattaacagatctcatctaaattccatccttttcctggagcttctgctatcctaatccctcaccctccaagagcacagccctttgatttacttgatccaaagaacttttacttcctttcgctcactgctggatatgctaataggtagggttaaatgaaaattgataaaaaaaatactataattatttttgttttataatagtgattgtacagtaaatattttttatatagttttacaaaaatacctatatgggagtttgtgctttggttatttaaaccttggaaagaattttaagaattttaagaattttctatcttgtttacaatgttttatcctcagattcaggctcggtgcctggcacgtagtaggtggtcaacaagtacctttagaataaataaattatttttatcagtatccagggcgagccttatgcaaacttataaagtggactaagttggtttttgctaaattcatcttcccttttctagtctttcctcttccttcttctcataggagaatatcttgtcacacctgcagaatcctcatgtgtcctctatatagttgaccctgaacaatgtaaggattagggacactgacccccccatgcagctgaaactttgcatataatttttttttctctctctttcttctttttttcttttcttttcttttatttatttttttttttagacactgtctcactctgtcacccaggctgctggagtacaatggtatgatctcggttcactacaacctccatctcccaggttcaagtgattctcctgcctcagcctcccaagtagctgggactacaggttgctgccaccaggcccggctaatttatttttatttttagtagagacggggtttcaccatgtaggccaggctggtctcaaacttctgacctcaggcgatcctcccaccttggcctcccaaagtgctgggattacaggcgtgagccaccgtgcctgcctgtatataacttttggctcccctaaaacttaagtgtcaatagcctactgttgaccagaagccttaccaataacatacacaattgattaacatatattttgtatgttatgtgtattatatactatgttattacaataacctaagctagagcaaagaaaatgatattaagaaaatcatcaggaagagaaaatatatttactaagcggaaatggatcatcataaaggttttcatcctcatcgtcttcacattgagtaggctaaggaggaggaggaagaagaggggttggttttgctgtcttggggtggcaggggtggagaggaaggcaggagaggcagacacatttggtgaaacttttattgaaaaaaaatccacatataagtggacttgtgtggttcaaacccctgatgttcaagggccaactgtatatgtatatatttttattgtggttaaacacacataatgcaaaattcaccattttaatgattttagagtatacaattcagtggccttttgtttattcacaaggttgtgcaatcatcaccactatctaattccaaaacactatcatcatcacagaaggaagccctgtacttattaaggtgttgctcttcaacccttcttcctgcagtccctggaagccgctaatctactttctgcctctttggattcacctattctagatattcctataaatggaattatacaatgtatggccttttgtgtgtgacttctgccacttggcaaaaagtcttcaaggttcatccatgttgtagcatgtatcagtggttcatcccttttatagctgaataataattctgttgcattgctttaccacattcttctctttatatttcctatgaaaacctagtatctggagagccgctgaaaaagtagccaataaattacacgtaagtgtagctaatagaaagtgagttgagaactcatccaggggaatgtgtgttgctcctgtggtggaatctcagggatgaggaaacctttccgagggggacaggagactttctggtgccacatgaatggctgacttgttgtaaagctaagtctaccaatagctatgggactggaaaaagcattgcattgagtagatggacacacaggttttgattctggtttagatgtaactaattgggttgcctgcatttccatgggtccaatgtttctgcttgttgttttggttaccttgggtttggctttctatcaggccttctgctaagctcatttacatgcattatctcatttaattcttcacaaaaaattatatggaagtcatagaagactaaatacaatagctgaagttttactttcagtgaattgtgagggagagattcaaactcatatctgactctctttagcctgagctcataatcactatatggtaggagctggcaaactatgaatctctgcatttttttgtacatcctctgagctaaaattgttgatacttttattttttttctttttaagatgtggttttgctctgtcacccaggctgtaatgcagtggcaccatcttggctcacttggcctcccaggctcaagccatcctaccacctcagcctcccaagtagctgggactacaggtgcaccaccacactggactaatttttattttattttatttttgtagaaatggggtcttactatgctgcccaggctgatattgaactcctcggctcaagaggtctttccaccttagcctcccaaagtgctgggattgcaggcatgagccaccgcgcccagctggtacattttaaaatgctttacacgagtcaaaagaatattttatgaacctgaaaattacatggagtttaagtttcagtgtctataaataaagttttattggaacacagccctacttgcatagctctgtgtttgtactgcaatgatagagttgagttattggcacagaaactctttggttcaaaagctctaaatatttactatctggccctttaaagaacatatttgctggttatcattcataaaatggaggcagagaaagaattaagtcattcctcaggtccctttcaacttaaatgttctgagaattgcagagaaaattgcttacatcttctgttttcctatgaggtctccatctctccctgccctctctcattctcaacagttgagtttgcctcttttcttaaaaagattgagtctatctaaaatagatgcctcatctccagtcatacatccatatgctgacttcccatctctctctctgtatgtgtcctttcatcaattctcgatttcctctattctgagaaataacaatattaccatttattagatgcctgagatttctagcattctacagagttgtgaagaaggttcagagatgataaatgtaaggtcaggcttattatttccatttctggggtgagggagttgaaggttgaggaggtcaaattgcttttctaggttgtgtcaattagtaagttgtggtgccagagtttgaacacgtctttctgatcaaagggactttacttctcttgtctgatgttatctttgctctctgtgcaccaaaagccatctcctccacaccacactccaccctgttcttctgtgtatgccctcttgatttcttcccttctttttctaatcatttcttttggtattaagtttgcctcctgagaacaacattcccttaggccagctcgtcttctagctaaaatagctactttagctgctaagaataggaatagcatttcttgagccattacattcacacaccagacactgtgctaaatactgtataagtgttgtctcatttaaatttcataatagttttacgaagttgctactattattaccattaaaaagggggaaaccaagccttggaaagggtaagaaattatccaagggcatatagttggaaagaatctgaatagagacttgaaccctctgtactttctttttttttgagatgaagtcttgctctgtcacccatgctggagtgcagtggcatgatctcggctcactgcaacttccacctcctgggttcaagtgattctactgcctcagcctccagagtagctgagattacaggcacctaccaccacacctggctaatttttgtgtttttagtagagacagggtttcactgtgttagccaggctggtctggaactcctgaccttaggtgatctgcctgccttggcctcacaaaatgctgggattaaaagcataagccaccacgcctggcctagacttgaaccctctgtactttccaatcagtatgccttacttccctatccctaccccagcctcacccaatataactcatctcctcttgtgacttacagtggtcccctctggcttcttccttttcaataccacccattctgttctgcatctcatagtgtgatacttactttctctttaatactaacattgctttcacagctcacctgtgacttcttttatcatttcttttcactttagagaacttcttttagccattttttttaaaaaaacagtagatctgctggtgaaaaattctcagagttgttcttcatctgaaaatttcttgatttttccttcatttctgaagggtattttctctggatatagaattctgggttgacaggttttgttttgttttttttttttcacatgaaaaatgtgctgaatccttctagcctccattgtttctgattagaaatctattgttactcaacttattttctcttgatacataatgcactgtttctttctggctactttcaagattgttttctttagttttctggttactatgatatgttttcattaaatttctttgagtttaaactatttggagtttgcacagcatgaatccataggggcacatgcgtgagtgtgtatatatgtgtgtgtgtgtgtatgtgtgtgtgcagataatatatacctttctcaaatgtcagccattacattcgtgtgttatgtgactataggtatagtaaacatatggcattatacttttatggggccacccttgtgtatgtaggacagaaatgtcatgatgtggggtgtgactgtatttttgtttgtttgttttttagtccctcaattaaccaatgaagattgtatgtctttgaatacttttcagcctcaaattctttctcttcttcttttgagatttcaaatgttatatctgttgttatagtttcatatgtccctgaagattttttttcaggtctattttctctctatttttcaaattgggtaatttctattgctatgtcttcaaatttattgattctctgctttgtatcttccattctgctcttgagaccatccattgagtttttgaattttggttgttgtatttttctagttctaaattttccatttggttcttctttgtatatgcgatttctttgctgagatgtcctcttgtcatttgtttcaggcatattcaaatgctcgttgatggctgccttaaaattcttgtcaggaaattctcacttctgtgtcgtttcaatattgattgtttttcttattcagtttgagatgttcctatttcttggtatgacaagtgacttttgattgaaatctggacattttgtgatatccgattcttacttaattcttatgattcttacctaaaccttatgatttagaagatctcctctgacactaacctggtggctgaaagggggtgctgcctccttactgccaggtgggtgtagacatctagattctccacggggcctctgttggcacctggagagaagggactccctgttactgataggtgggggtgcttcaggcttcctcctaggcctccactgacagttctctggctgggagggagaaaggcacttggtttctactccccatctggcctccactgatgctgtagagagggtggttttgctaccactgaacagtggtagaggtcttgattttttactaggtcttatctgacactctccctgtggggagaggaagtaactttcttctggacattttctttgatttgtgctatctgtacttattgaaaatccatttagttacctttttataaacacagtgctattcttactttcctgttagtttgattattccttctgttacctcgactccttcttcatcttttaccttccaaatgtggacgcttcccagagtggcttttctcttgaggtatgctgttgctctaagagcacttcactgtttccagacctctggattttacctctcatgatggcaacttccagatcttgctccctagatcttgcctctccttggatccttaatcctgatggtctccctccttgaaagacacttctgacttcatctgccaccacttcatacttgataactatcacaaaaaaatgcagttgttttgctttctttatcccaattttgtttccttctcaatttcccaacctctgtccataatagcattgttttcataagcctgtggacattaaatcatctggtttctttcttttcattcacaatatatatcacacagtgaaccacagggatggaagggggaaatccaaaagtaactaaattgcagttcaatggtacagaaagacaaacctagttccctttgtccctttgtctttcaacatgcattacctaaggtgtgtatttagggcaaaaagcacaagttaaatctggttctgccaattgtaagctgtgtaaccttgaatacttgacttaacttcagtaatctcagtttccccatctgtaaagtggggatgatgataatagcaactgcagaggtttgattcaaggatgcaataagtttatttatatgtaatacctaaacatatctggcatctaatagagattcaataattatagctcttggtcttctattaatataaaacagtattttccatcctattgctcagtcccaaaccccagaattttcctgcttgattttccaaggtgttttattgtctcttcccacccagaccatccagtttatattcagcttgtttttcacacccaaacatgcattctttcctctagtcagcctcttatctttatttaccttgaatttattgtacctctctcataccttatgtttattcttagaatgtccatttcccctccttccccttcaaatcccatccatgcatttgtcaggcctcagcacaagtgctggagtcttctgtggctgttcccttctgtcctgatctcttcctctgtgaacttcctttgaacttggagtaaccaagcaatagaccatggcagtgtaaggcgccatggaggctgtgtagttcttcccatttggccaggttacaagcttcaggaaggttatccgacctgtttgtggtagtgttagaccctgccctctctacgtcatataaaatattctctgaatcctatacactttgttatattattgaccattcagttgataaaaatctgagcggttattctacagtagttctctgaggtagttactgaagaaagaaagatgggtaaggaccagttttatgtacttgcatgaagtttgtgccctaggtgccacacttgtcttaccctaatccttgccctagtaagactttcacttgtcttgggagctcatcactggggtttagggtaaaggggttgactgacactctcaaaaccgagggaagcacagtggccacagtagagattccgataatgcagagaaagtagtgataagttggtagggggagaggtggaattaagaaagattcacaaaggaaggggttgttgagctgtattttgaaggataagagttctccagaaagaggaatgcattttagtcacagtgataggcctgggaaaagcaaaggaggcataaacatgtcctgtgtggggtatcagtttgttgctacaactgggatgtgtctgggtgtattgtccttaggatattgaaggacaagagatgatgaagggaatgaccaaaactagatttttaaagattatttcactaaaaagtccatgctcttcttctaacatcccattctgcttccatataaaaggtctgagtagggttggtcctaaaatattttagatgatctaatctcctaggtttgtctttctgtaccattgaactacaatttggttacttttgggattcccccctttcatccctgtggttcactgtgtgatatatattgtgaatggaaaggttgaatggagtcaggaggtttagtggcacctcactgggaggttttaggatagagcagggtactctgctggtcctggttgatttcttggccttgaggatgatttctgggtcaatgagttttttgttaaaagaaacgaattcttaccaattttggcaagaaaaagaatccatcaaaagaatttggtgtagctcactccacagggccagagaactagaatcagaagcaatccagctggagtgaagccccgaaacatatcgaaggaaggggtctggtgcaatataacacagctaccaccagttcaccaaactgctgccaataaagcctccccaaccggatggagctgctgctatcattgtcaagtcccaaaatggatcctttgcagtctctccatgtctgcatcactggggactgattctgaggtttcagtggttgcccagggcccacactttagctgcaatgaatgctgggagatgagtatccagcactttaagcttctataagggatagcagactctgcctcaagaggtggaagagtcaccaaacataaaagggaatgaagatggcaaatgcatgacaaacgtccactgaactctccaagttggctgttgcatacatgccactaactttcatttactggagacttactggaaatccaaagcacattttcttttatttttatttttattttttgagatgaagactcactcttgttgcccaggctggagtgcggtggcacgattttggctcacagcaacctctgccacccgggttcaagagattctcctgcctcagcctcccaagtagctgagattacaagtgtgcaccaccaggcccggctaatttttgtattttcagtagagatggggtttcaccgtggtggccaggctggtctcaaactcctgacctcaggtgatctgcccacctcggcctcccaaagtgctgagattacaggcataagccaccacaccagccccaaagtacattttcatcagaaagaaattttaccaactccgaggtagaggaaggaaacttgactcagggaagttaagcagtggagagaaaactcttgggtcttagattacttcctgacctcaaaagcaaaagggctggctcagccttagctaagtctgtctgtcagtaagctaattctggttcatttaacaaaagtgaaattgtaaatgtggacagccctgccttgatttgtgaacaattttcagaaatcaaagatcaaatcatggataaatgttgtttggttcatattaaaaagttaacaaagaagaatacatatttttcttgttttgtagatgggaaaacttctgcatatttaaaggaagtaacgtgttttgggcttacatgactaccagttggtgaacccaaggctaggaccgaatctctccattttttttttaaatattcttctcactgaaccatgagtatttccctataagaattctctttgggtaacaatgaattgtttctaaagcctgcgtcattaagaatactaaaagagctcctgatttatgtgtaataattgggttgacaggacatacacactacctttatttctcattaatagttatttagatgagagatatggtgcatttctctaatctggcttggaaaagtaaagcttgtgcaggtctctttttcttattttgagatatttatactatcagcttcagtttcaaatgcatcaatcttaggtttagttccaatttacttcaatttattaaaatatgtattgaacactgcataagaaatcaaatgggtacacatacacctaaggagttaagggttttaagcaagaaaagaagtgcttattttttaccctgcaataaaggtattttgggtatgcagcatgttgttttaccagctgctaccttagcgttatatttacttttattgctgtagtctcttctggtgattaatagacaccaggatgggggagggtggatctatcatttggcctaagaatatcaagaatcaagccaataattgacagttttccattaagcaacagaactctagcattctgctagggaatgggaacacaatacaaggatacagcctggatttacattagtcaacaagctttttgagtgacacacagaaagcctaagctatactaaatgttaagagattgaattgctggattaagaatcatgttactcaggctaaatcagaagtaggactggctgagctaagccattttctgtacctcagtttctccaccaatgttgatagatatttactgtattccagagctctcatgtgtatcagctcattgctccttcactactaacctattaggtatgtgttgtttcttcctttcacaggtgaggaaaccaaagttcagggaggttaagtaattttctctgaagtcacagaagtagttaattgcagagtcgggatgccaacttcgatcaggggcactctagagccactcagtctcattgcttctgcttaccctgccttttgggtatcatttgagtaccccccacagacgccaaagtacatgcacgaacgcctcctccacccttttacaattgctgtgctttgagcttattgcagaatgggtactggaaaacacaattgctagacttaagaataaggttttttttttttttaaaggtattgaattatgcaattatctgaagtggtcattcattggaccacttgatgttgtggatgatttatataactttgtattttattataacctctgtttcttttttttttttttttttgagacggagtttcactcttgttgcccaggctggagtacaatggcatgatctcagcacactgcaacctccgcctcccaggttcaagcaattctcctgcctcagcctccctagtagctgggattacaggcatgcgtcaccacgcctggctaattttttgtatttttaatagagacggggtttcactatgttggccaggctggtttcgaactcctgacctcaggtggtccacccgcctcggcctcccaaagtgttggaattacaggtgtgagccaccacacccagcctaacctttgtttcttacatacaaaatagtttcatgtagaagtaggtttgggaattggatttttttaatgtcatttttatatttttgagatggagtcttgctctgtcgcccagattggagtgcagtggcatgatcttggtttactgcaacctctgcctccgaggttcaagtgattctccagcctcagcctcccgagtagctggaattacaggcacccgccaccatgcctcgctaatttttgtatttttagtggagacggggttttaccatgttgaccaggctggtcttgaactcctgacctcaagtgatgtgcccatcttggcctcccaaagtgctgggattacaggcgtgagccaccgtgcccggctaggaattggaatttgatgattgcatggaaggcagttgagtaaaaggcattggaggaggaaggagatgaagaaagaaagaaatagagcaatggcttagtttgggccattggggcattcagaagggtgagcattagtgggccagggaagagacagttaatgaaggtgtactaggagtgagcaggagctgagggacgcttattcctagcggggagcctgtgctggggagacttgctgaaggagagactgggctgagtccaggggagtgcagaactgccagactgttgaggtcagttggcaaacagggctgtttcaacccgaaattgagaggctgcatctggaatacagcagaaagaggactgagccgttcttggggtagagatgaagggaagtcagcccgttagcctgggactgaaacagggaggcatctttaaatgcctcttctatcaataaaccctgacagactcacctaaatattgttacagcgtttccctaatttgtcttgttgtttctaatgtatatccccaggaccccttaccccactagcaatggctcaattatctagccctgtagggaaatattgtaatatggttttgtttttgttttttttttttttcaaattcaagtttagttttctgagtgcagaggcctaatttgactctgtttttcactggactctttctaaaaaatcactgtcttttttttcttgtcacttaaatgtagtctaactttttatttaggaaacacagtcattttgctggtctgcagtgcatggagagtccgttaaggttgctaaggtgcggacctttctgttcccagcccgaagctggaggtctgtggttcccccatggctgtcttgctgcttgctgccgagtctgcccatcactgccttggcctcactcccagttgcagccggccctggccagggctcttttcattctccattgtattttctttctgcttttttttttctcagccacatctccactcttgaccccctgtggctcactcttttagccatccccaggtaatgagaaggctccttctccctggtcagtgaactgattgtttgcggggccggatgtcctcctgctgctttaactcatcctggcgctttgcagcattgctcagagggatttgtcttcattgccggaggtggagttgcctttcctttttcgcctctcttttcttctgtccttgggattcatggcatttccacacactgaagttgttaaaaataaaggcttccttgacaacggaggtgttagtaggtgtagggctggctgggtgtagctgttgcaggtgatcagccatgtgtggcgtgccaaggttaagggcaaaggccggcactcccgggttacagtctttgaaagggatactaccgatctttcgatgacagtggagaaaagctgtaaaggagcgtttttctctttcttttagcattatgaagggcatggattttggagccaggctacctgggttcaaatccctgctcttccacttactagctgtgtagtcttaggcaaattacttaacatctctgttttttaatctgtaaaatggggatgatactggtatccaggacatagagttaatactagtattatatgctatataatatacatcatataaatgttacatataatatatagtacataaactatacatagatagttaatatatgtaaaggctttaaaaaagaagtggtatacagcaagcaggtgctgtggaagagtttactgttatttttctttgttttgcagaagtttttttgtgtggggaggtatatttgagttaaaagcagggatgattattactcctcagagtcctctgaggtgttggttgtcctttctttcttttttctttctttctttgtctttctttctttgtctttgctttctttctttctttctttctttatttctttctttctttctttctttctttctttttctttctttctctctctttttttttttttttttttttttgagacggagtctcgctgtcgcccaggctagagtgcagtggcgcgatctcggctcactgcaggctccgccccctggggttcacgccattctcctgcctcagcctcctgagtagctgggactacaggcgcccgccacctcgcccggctaattttttgtatttttagtagagacggggtttcaccatgttagccaggatggtctcgatctcctgacctcgtgatccgcccgcctcggcttcccaaagtgctgggattacaggcgtgagccaccgcgcccggcctctttctctctttctctctttctttctttatctttctttcaagatggagtctcactctgtcacccaggctggagtgcagtggcgcgatcttggctcactgcaacctctgcctcccaggttcaagtgattctcctgcatcagccttccaagtagctgggactacaggtgtgcactaccacacctggctaatttttttttttttttttttaataattttagtacagacggtgtttcaccatgttggccaggctggtcttgaactcctgacctcaggtgatccacctgcctcggcctgccaaagtgctgggattgcaggcctaagccaccacacctggcctttctattcttattttaaagatacagcattttacaagcagtaggcactgcatgaattcatgtagtttgatttaaaaatgaatcacaataaagtactcggcttgactctgagtctgaggcagtagcatccgaaaaggttggtctccaagttgcctggccaggaggtaaccagatggtgcacctgcaccctccccttggaccagcaaaaattgctcctgtttccacaagtgcttttttccttgatacagagacccttgggtttgggatgaagccttagaggtcatgccctgtcccagccttcatccatgctttgcctctctgaaacaatctggaagtaggacgtgggaggtcaaacttatgattcacatttggggcaacggaatgtcttttccttgagacatttttaagacttgtacttcatgataaagttgagctaggaagtggggccaatttttttttttttttagtttattcattaaacacatctcatgagtatactttttgccagttactaaaaatataaataagaccctgccctcagagtagttacagtctagacagtagagttttgtaaacagaaatatgtaataaaatataagaagagcactatgatagaaagtatttatgacacatgcagacacacaaaaaggagggttctgcttcacctttgagtgaaatgggatgggtggaggtgaatcctgaaaatgtttatggaagagattttatgtgagctggatccagagcattgagtaggtttgcatgagtcagacagggaaaggaaacatactctagacagagaaaacagcgtgaataagggcacagaacctcagcgcatcctggaggtctgagatttgcaagaatttgtcatggctgaagcgaaggcaaacaattagagttaacaatagcgaatggtcaggggctatcagtggtgtgctcaagctggcttgtgtctggcttatgggaactgggtattaaatagccagtcattttgcaagccggttgcaagccggtggtagctggagatcaacagtggtggaaatatttgcaccgtggaaatcagcaaatgctacacattagggccttctctccccaccccacaaaccaaagagctgctttcgcagcagatcactgattgtgaccccttgatgcgactctaaaaattattttaggactcttcagtgcaggcgatgagaagtgaatgtggaaaggttggcagggaagaaacatggtcaggtttgtaatctagaaagacagctctctgtttttggtcttgcccttcaggaaagagacccaagaggggagatttgcatacaggaagtttactggggagtgttcttgggaccagcatttgaggggacgctaacaaagcaggtttgggcaaaggaggagttgaatgaggaaccagctgtaacagattcacctggtcccacagggaagctttggaggtggagtggccctatccagagaggcagagaggtcaggcctttatacccctgtgctgagcatgactggatacaggctgcccctgcagaggggcacataaccatagtgaagtggttctctttccctgagggcagttcctggagaaggctcagcaactagaggagagagtgcctcaggctgaaggtgattctggtggtgcactccagcatgcactgcacaccgctggcagtctggagaatgtatgagatccctggaggtgggtggcaaggaggctgttgggagtgtactgtaatagtccatgttgaagatgatgaaggcctgagctaaagtagcagcggtggggatggaggcagtaggaatgcggcaacaagagtgtaggtagagtctatggacaagttcccctaacgcagtgcttctcaacggagggtgggaggttacccctagggtacatttacaacatctggaagcagtttaggttttcataactggggtagggggagggtgttactggcatctagtgtgtacaggccggggatgctgctgagtatttgatactgcccaggaccatccccacaataagaatgggcaagctcaaaatgtcagtagtactgaatttgacacattctgccctaatgatattaggagtaagggaaaggaagtataagatgcctaccttctctgttcctgccttggatgtctgagtattgaatccacaattcattaccagatagctaaagggaagataataatttacaggtggatagagaagagacctttcatcttgtaagcaaatgcgtatcacattgtttttaaagccctacctgcctcataggaaaatttcaagaaatctagataacagtagattcacatgtctttcccactgtcttccttccagaagattaaagtggagtttcatttctgtttaaaaacacagagataggtgtaggtgaaagcaagcaaataataagacagatgaggggctcttacaatagcctctgttttttgctaccatagtaaaaattttgcaaagaaatagtagaactatggggataattttaaaatggattgtttaggttttagcaaagtagcaaagcagatgatgacaattaaatttaattaggcaaaagcagaagttgattagggcgataaggatttaggtcgtaccaaagcataatataaaatgtctttgtttgcgtcttaacattggcatattcaattatagtcagttggtgatgactttggtgctgtctttcatttggccgaaagctggttattgcatagagtgacagcctcaaccaggtgctctgtgatgtccctgtcatagctaagaagccaacaccatttaagcgttgggacgaagtgactcatggagacactttgccttttgctgggaattacctgatgacgcagagcaggagtttggcaggaacaggagtgcagatttctgggataggcactagtgggaggagaataaaagggagatgcattaattcctggtatgacaaactacgtgatagaactagagcagtggtctgaaaactttttctgtgaaaggccacatagtaaatatttaaaattttgcaggccatacagtctctgtggcaactctgctgctgtgaaggcaggcagatgacaggcaaatgaatccaagtgctgcattccaataaaactttatttaccaaaagaggtggtgggccagatttggcccttgggcagtagcttgctgttaggtgtacttgaaaaaatgattttgctgcacttaaaggaaggtgtggacatggagatgtaggttcgactgtaagactgatgattaagggggtcaaacacattcattttctttcctttattttggcctctttctcctgctcacctctctccttttaagtaatttagaatgcatatgtatgcatatatatttgaattgcttattgattgataattttctattcttttttggaagtcttgaatagtaggagaaaccttttctagtcctctcttttagccctttgtaaatgcaatttagcaatttttgtcttgggtatagttcttagttacattttcttctacttgccattcaccttgggtgtaaattacaattacctgggaaacttttagacatctcaatgcccaggctgagtttggaacaattaatcagaactccagggatagcccaggcatcattatattttaaagcttcccgggggattccaatgtgcagccaaggctgagaatcacgtccttggatttaaagaagaaagaaaagtcctgaacatttgctttagatgctggaataaagaaggaaatttacccatgtaggtaacctttatggccctccagttatagccacaaacataggagttttcagattttaaaggctattttcagaaaaacgtatttcctagtgacacggtcaaaaactctttgttgtggtttggtaggagcaataaaagaaatatcaggaagctattgggatttgactgatgtctatatttctagccagaagcgcttcctccatcagtgagtgtggtgacagcctttgagctttgtgaaagcttccaggttccagtgattaagccattactcctagaagccagtcttaccagagaaaatgatcagggcagatgttctcactgtgtccggagggcatagccttctaacattatcatgggtgcatacataaatgatgatatttctttctttctttttctgagaccaagtcttgctctgttgcccaggctggagtgcagtagtacaatctgggctcactgcaacctccacctcccaggttcaagtgatgctcctgcctcagcctcctgagtagctgggactacaggcacgcatcaccatgcccggctaatttttgtatttttttttttttagtagagatggggtttcgctatgttgaccaggctggtcttgaacccctgacctcatgatccacccgcctctgcctccaaaactgctgggattacaggtgtgggctaccatgcccagcctaactgatgatatttcttagagataacctatttgactaagctaaaggtaatttttgttattaaggcaacataggacaattcaaaaggtaaattcaaggactatttgataaaaatatgtggaaattcatttgaagatatagatatgggtataataatattttgcaggtaggaacattttaaagggatcttatggcattttgcttacaaacatcgttcttttcgttttacaaatagaaggtctaatcttatgacactgaattgctcaagcatttaataggctaaatttcaaagacttagtgctttctttcctaagcaagagttggagagtcattcttactattattatttttttttttttttggtggaggggaggtaagggtacaatgttctgaagaattttccagctaggagcaaactatttttaatgcctattgcaacttcccaagctccattatattggagatatgagagttgcttcatttagtgagggataatggaaagagattaggattctgtccactgcatgtaaacaaacacccaacaaaagtggttgcaacaatagggatttattacaccctttatgaagataactggatttatactgttccagggctgattaattcagtagtttagccatgccctggtgagggatggtatccctgcaattcctgattacctgactttttctttctggtcacaggagggctactgtagctctaaatatcatgatgtaatatgacaacctcgaaaggcaggaagagaggacagtatttctcccctgagtctcattatttttaatcaggaaggaaatcttttcaggagctcccagccgactttctcttaggtttcgaacctggagcccaaagctgtgtcactttttcattctcaaacctgtcctgtcaaaggcggggcattatggttggcgtaaactagggattagcaaactttttctacaaacagtgagatggtgagtatttgaggtgttgtgggccacatatggtctctgcatattcttgtttgttctttttccctccgcccttaaccctgtaaaaatgcaaaaatcattttttggagcttaagttctaaaaactgatttgtttagttatagcatgaccaaccctgcagatatgcctgggactgagtgggttcctggactttcagtttttttttttttttttttttttttaagacagagttttgctcttgttgcccaggctggagtgcaatggcgcgatcttggctcactgcaaactccacctcccgggttcaagcgattctcctgcctcagcctctcgagtagctgggattacaggcgcgtgccacaacacctggctaatttttgtatttttaatagagatgtggtttcaccatgttggccaggctggtctcgaactcctgacctcagtagatccgcccgcatcggcctcccaaagtgctgggattacaggcgtgagccacagctcctgtcctggcctttcagttttaaacccagaaacatccagagcaaactgggtgtagttgatcatcctgtttagtggaccttctaggaacctggctgtggctggtctggagcggtgagtgcctatgcttcgggcctctttggcggaaaataacacctgtgtcttgagatgtctcttctgttccattacagagaagaaacttggttagggatggcctggggtttgtattgagtcttattttaaagtaaggcaattttatgtctttagaacttcaggaaatcattgattctagagattggcttgaattacccttctccattgtaattatcagatattgaaactcattagagtttggtctactcagagctacccaactgtgacgttcataaggtggatggtaattggagggtgaggtgttgttgtgtacagagatttgcttgactggatcaattgttttctcagtggggtctaggcatctggtgatgtctgccctaagtgatttttccccactggtctgtcaccactaaaccctgttatttctacccagagatgtctccccacctagccttcctccttcatcctagttaattgctttcttgtgggtattgaccatttcatgagtactcttaccccacctgcccttatctagagatgtttttcatcactctacaaatccctgccctgcactgctgctgactatcttcctacaacacatctgtccccacgcttccgttttaaagttgtccctgctgcttcctttggacacttccatttgactgataaatgccagcttcttagcttggacgccctacctgacctactgcttcacggccgtgcatacggaatcctctcacaacccacgtttttgcatatgctgttcccttctagaacatctccttttccttgtggaaccatcctctctgatctaaatcaaatgtcttctctgtgagacctcctcagcaagagttcctaccccagagagacttcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatcccctaggttgagtggtatttacctggaaatcttcagtgtttggcccacagttggtatttgtatgaatgtctgaatgaacataggagctcaagttggaattttcataggggatcctcttcttattaaagtctgtccttccctgggggcttgctactccaagtatggtccctggacttgcagaccagcagcctggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggctggaggattgcttgagcccaggagatagaggctgtggtgagctatgatcacactactccagcctgggtaacagagtgagatgctgtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccttctttctttcatttttttcttggaggcagaatcttgctctgtcgcccaggctggagtgcaatggtgccatctaggctcactgcaacctccgccttctgggttccagtgatcctcgtgcctgagcctcccaagtagctggggctacaggtgcccgccatcaagcccgctaatttttgtattcttagtagagatggggtttcaccatcttggccaggctggtctcaaactcctgtcctcaagtgatctgcctgtctcggcctcccaaagtgctgggattccaggcgtgagccactgcaccctgccgctccttctttcttaaaatgtacattcaaggacctgccctctacctactgaatcagaatcccagtggggagggccactgtattttaaacaaatacctcaggagattcttatcaccctgaagtataaggaccacattccagggcaaattttaactctttagttgtctctgattttccccaaaaccgtggactgaagatgctcaccttcaaaattagtgttaactctgttgtggtctatacccatctacctttccagtttccctgttgctgttaatagcactatcgttctcctactgtccctagatttctacctggctttcattcccattattgaaatactcttaccttgtgcagtgtctccacgtttcaggaaagaaaagaagaagtttttgttagcatctgtggccttttctagtaattgtcctgtttctttgcaggtgttactttcctgtcaagttcatggtgtgtcgcccctgtcctcgttctctgttgtagtctgccttctcttcccacttctccaccaaaactcttctctcaaaagtcaccagggacttccttattttcaaattcactgaccttttggagcacattaaagcaaacctcttagaggttggcaaccttataaaaaaatttgtatttggttctaacctcctttgctggtgtgcaaagttgaacatgaatagcaacctctaagccagagagaaattggatcttactgtgtctttacttgccagcccccagggtaggaaagtagttggtcactgaaagtttttatacttaaaaacgtgttttacaaattcaggtttactgtgattttttttaaacattaagctagttattttaatttctaattcctttgattactgaattccttcaggcaaataattgcctgtacttttcttgtgatggttaatattatgtagttgattctaactagaattttcccttgttttctggaatgcacccatattcagagtaactaaataagtcattatctttcctttgagaatatgggaactaaatctttacaattcaaggaaaagagaagaacttagattaaaaggaaatagaataagaaatacatacactggggatcatgcctataatcccagaactttgggaggccgagataggtggatcacctgaggtcaggagttcgagaccagcctggccaacatggtaaaaccctgtctcaactaaagatacaaaaattagccagatgtggtggtgcgtgcctatagtcccagctactcgggaggctgaggcaggagaatcgcttgaacccgaaaggcggaggctgcagtgagctgagattgcaccactgcactccagcccgggcaacagcaagactctgtctcaaaaaaaaaaaaaaaaaaaaaaaaagaggaaaaaaagaaatacacaagaaatacatagattgcaaggtgtctttcttaaaaaaaaaattttgtttccttcttcgctgcctccttccctcccttcctctttttcttccttcctccctttccttcatcctgccttctgccttccctttctccctccctttcttctttccttttcccctccttcctcccttcgttcctctttttcttccttccttcctttccttctccctgccttccaccttccctccctccctccctccctttcttctttcctttttaccctccttctctcccttcctcccttcatctttttctttcctccattctttctttttacgtattcatcagacacatcccagatagcacattaggctctggggatagagcaatgaaacaaaagtggccccttgcctttgagatgcttccagcttagcatggggcagtcctgtcatcaaataaacataacagattgctaaacatactgggaaagtcagggtccagtggtgaggggagggtgtcatgaaggtggggtacatggagaaagggtggaaactcatattagaaggacaggtgcttgagctgaatgtcaaaagtttgcaccattaggaagacggaggtatttaacgcactgcagatacatgagcaagacccggaggtgtgagattacctggtgcagctgaaggagtattgagagatgaggctggggcaagcaaggaggaacgtgttgggattttaatgtgggaagtagcatgaacatatgtctgtgatggaggacagtggataggagaagtttactcctcaaaaatgagagatcagtaagaaaaccagtgcaaaagtctagctaagacttgttagaccagggcacagtattttgttgttgttgttgggatagggtcccaatgtgtcaccctggaatgcagtggcatgatcatggctcactgcagccttgacctcctgggctcaagtgatcctcccacctcagcctcccaagtagctggaactacaggggtgtgccaccacccttggttaattttggtgtttttgtagagagggggtgtccccatgttactcaggctgattttgaattcctgggctcaagagatccacctgccttggcctcccaaggtgctgggattacaggcctgagccaccatacctggttggggtgcagtattaagaagtgacatagagtggtagaaacctggagaataggttgccgtgggtgagccgcacggggaaagaataggctgaagacagaatcaacctttgatcaggaggagtgaaggaagagctccttagagaagtaggatgtgatacagattcaaaacactcaatatccctttctgactaacaagaaagtcctttttctactataaaaagcatatagtaaaagatgtgagtggtattcccttattcctttgccttctggagtaactcacagcaaattgactcccctttcaacaagacagctcttgaaatgattgaaagaaaactctcatgactttccttaatctcttcctccctggtttatgtactcctgggtgtcctcactgctctgtatgtgacatggtttctaaaccactcacctgccctgtgaacatagccagcagcacgtggtcccgatgcaatggaaagaatgagggcagtgactggccctgtcttcatccttttctccttcagcggagatttatttcttccaatttctgcagccaactctgtgggagttgttgggttggtgaacccgaggggtggaagagacagctctgggaccactgaatagcctagctttgtttaggggcatgttttcctgactgtttatggtgcctgacagggttgtttttgttctggggagagctcatttgataaagcaggctgctgagaaagctgtggggctccactttttctggggatatctccaaggccccccagggagctgcgatttagcatcccgcaggcaccccttgctcacggaggtcatctgaggccctttgcatcctcgtcccaagtctaactcagatagtggaggggagagaaactgttgccagcttcaccagcttaatagtagtcaggaaggagttcaggccagcaagattccattttaatcgtcaatcacacattaccaaataaaaaagaaagaaaaagctgcagctgtgtgccactcttcataacttttcctccgtggttggcagtcagattgctttcttttgcagaaaacacgatgtcaggtttagtcagaatttatgtgtagaaattcgcaaggaggcagtttggaaaggaaggtgaaattagtgaggttttagttcgcacttgggacgaattacagacattcgggatggtggcatgcgaaagtatgctgcattttccttctcagcgccccctgcttcatctcatagccctgggcacattgcagaatccttcacaggcagggtttaaatatagcaaggcacaacactggccatagaggacacgagaacctctacctcagttagcaggggacaggttagcacctcctctatccaggggatggactctggtcagctgattggtggcacgtacattattacgagagtaaagagatgcttggctggtctctgtggactccagcacatgcagtccctccataaaacgacaagagaacacagtgtgctactgaacgccactagatctgtattgagccatctacgttttcctctagagccatgacaaagatggtttttcaagtgaattctagaccagccatctaaggagctttaggttcaagtcccatttccaccccatttgagtttgacggccttgggtcaccttctcaaccactcagaactacggtttctttttcaatatgtgtataggccatggatatttttgccctgcatacgtgaccctgtgtgattaagtctcggcctcatttctgggcctctcctgcactgttctcctttttcacactccgggcgtcagctagatgttctgcaaagcccttggattttccaccttcatgctcttgttcttgctgctttccttccccttgcccttagaatgcccttttctccatatttgcctttaagaagtcatgtttttggccgggcatggtggctcatgcctgtaatcccagcactttgggaggctgaggcgggcggaaaacgaggtcaggagatcgagaccattctggccaacacagtgaaaccccatgtgaaagaggcccagcaatgacttgtctttttttttttttttttgcctttcatgggcagcacgcagggtgctttctggctgataaatccatacggtcaggattggctgactccttcacggtaatgggagatgtatttgacactgctgcccctgctgacctgtgggtgcaccagccaccgggacacctccatgagacacagtgttagaggtttatggctaagaaactgatttgaagtgtgtgaacgtgtgccaagaaaaaatgattcggcttttgttattttataatgttcagataatcaatatgaagcatttttttacattttgctttcacgtacatatatgtatgtgtgtatatatatgtgtgtgtatatacttatatgtatatatatatcactatataatagtgaatatatgtatattattcactaatatacatatatgtatgtgtatatatatgtgtatctataattatatgtatatatatcactatataatagtgaatataagtatattattcactaatatacatatatgtatgtgtgtatatatatacacacatatatgcacacacacacacatatgtatatatatatacacacgcaatcttggctcgctgcaacctccacctcccacgttcaagcgattctcctgtctcagcccccagagtagctagctccctctctctctctatatatatatacacacacacatatatgtatatacatacatacacatacatatatgtatatatacacacacacacatatatacacacaaatacatatatgtatattagtgaatctacttagaaagaattttattttgaaaataagctataaccaacaatttgggaggccgaggtgggtggatcacctgaggtcaggagttcaagaccagcctggccaacatgatgaaaccccatctctactaaaaatacaaaaaattagccagggatggtggcgtgtgcctgtaatcccagctactctgggggctgagacaggagaatcgcttgaacctgggaggcggaggttgcagcgagccgagattgcgccactgcactccagctatacattgcataggctcaccagtacaacaaaaccagtttgttgattgataaataaatatttaaaatattgtatgtttttattttattttttaatttatttacttatttttttgagacggagtctcactcttgctcaggctggagtgcagtggtgtgatctcagctcactgctgcctctgcctcctgggttcaagcgattttcctgcctcagcctcccgagtagctgggattacagtgtctgggtcttaggttcctcatctgtcaaatggagacagtaatagttgattacataattttcatgaagattaaatgagttattgcacgtttagtatagtgctttccccttataaacactcactacttatttttattttttattttttacttttgagacagagtcttgctcttttgtccaggctggagttcgagtccaggctggagtgcagaggcacgatttcagctcacttcaatctccacctcccaggttcacgtgattcttctgcctcagcctcttgagtagctgggactacaggcgtgcgccgccacgcctggctaatttttgtatttttagtaaagatgaggtttcactatgttgcccaagctggtctcaaactcctgacctcaagtgatccgcccatctcagtcccccgaagtgctgggattacaggtgttagccgccgctacttatttttgtaagatgtccttttatctttgatagattatgtacttatttatttatttgagacagagtctcgctctgttgccccagctggagtgcagtggtgtgatctcagctcactgcaacctctgtctcccgggttcaagcaattctcctgcttcagcctcccgagtagctgggattacaggcacgtgccaccacgcccggctaatttttgtatttttagtagagactgggtttcaccatgttggtctggttggtctcgaactcctgaccttgtgatccctccgcctcggcctcccgaagtgctgggattataggcgtgagccactgcccccatccagactgtgcatttatttaagagaataaatattgtgttcatttttacagacccccacagagcctgatgcataatagctccttgataatatttgttgattgaatgaatggtagctattttaatggtcagagccacctggactcatttaagttgcaatctatgcatacgagattggaccatatccaggcaagaattccagattcatcctgtccttgtcagtaccctagttgggttaactgaaatgactgcctggaacacaaagtctttaataaaatgatattactatgctctataaatctataagttacagcctgcccttatttcccttatttaaatttttcctgccctcttgcattttgtatcaaaagcaacctaagtttaataacttcagcaaaggtaaacatttcttccttttgctttaagattcccagtgtatgtgtattcaatcagcaaatgtttgtgaagcgacctactgtacacttggcagcaggctgaaagacaaaaggccacctcctgatacatccttattgctgattttgttaatggtagaggtgacaaggtaggggatgcagaggagggatgtgcccttcctggtgatgttttgtttttttctttttttttttttgaaacaaagtttcgctcttgttgtccaggctggaatacaatggtgcaatctcggctcactgcaacccctgcctcctgagttcaagagattttcctgcctcagcctcccaaatagctgggattatagacgtgtgccaccatgtccagctaatgttttgtatttagtagagatgggatctcaccatgttggctaggctggtctcaaactactgacctcaggtgatctgcccgccttggcctcccaaagtgctgggattacaggcatgagccactgcacccagccctggtgatgctttttagtgcctctaattcttctgagccttttcctccacttcttagaaatatatagacctttggctgggtgtggtggctcatgcctgtaatcccaggactttgggaggccaaggtgggtggatcacctgaggccaatagttcaagaccagcctagccaacatgatgagaccccatcagtacttaaaaaaaaaaaaaaaaatgcaaaaattagccaagcatggtggcgcacagctgtagtcccagctaccagctactcgggaggctgaggcaggagaatagcttgaaacaggaggcggaggttgcagtgagccaagagcaagccactactccagcctgggtgacggagtgagactgtctcaaaaaaaaaaaaaaagaaaagaaaaaaagaaatatatagacctcctctttccacccccttcctctagtagcttgtcctttatcttcccttcctctatggaaaagcatattgtaaattaaagaagtcaaaaatgcaagagggtattctgtatttttacttttactatgatctccgttttcccagaaagtgtgtagaccctccttatcatccctcagctctattccttggcccattcctttctggaatttgtttctcaagccatcggcactgcatcccctccagtggtttgaaaccgggcaagactttgcattccaaagcaaaagtggaaatcagatgctcttagcaatccctgtgaatgccgggaaatcccatggcattttcttacagaaacaggttatactgggtggatgggtttaaagcattattcacaggactaattgtatgacttggagcagcctcggtttcctcatctttcctcatttttcctcataaaatgacttctactcacttaaggcctgttccaggttcaaagatctaggattcacttatgttatcagttaaataggcttttgttgggctgatggtggaggctccccattgaaatattgtgtatctgggaaatatatgcagagctaaacaatcagattaacgagtgaacttttgatgtaccatctgtttattatggtggttctaccatgaaatctgttgcaaagataatactaacaaagcagaaaagtgcatcttaatatttacatggattacaataagaattggtaatgactcatgaactggtaatctcagcggctcccattctatccttctggttaatgctttacttgaagctgagttttgttccactaattatttcttcatacctgcatcctaggcagtaataaaggggtctctatataaggcaaagaatatggaattaagtaagcgaggtaccatatatgaataggtacaagaagagactgaaacatgttagaatttgtgttttgatacttgtcagggagaactcctgggatgatgttttacctaatacttaatgatatctgactgctctgctctgcagggagcacagccatgtggtgctcattggctgatgtttgttaggaagtgggccatctgtagccaggaaggcttgagataatcaggagggggaaagtgggaggagaatggattgtatggagctgtgaaatgccattgtggtgagtttcctttcattgtgtattgattgggttttctagaggacagctctggactgagtctttttccattttcactgttgctaggttgactgttaagtaatgcttttagacttcttggtgagacaactgagaacatcctggaactaccatactataaaaatgttaatgtgtacatatctatgtataacagtaactcccaaatctcagtttttattcagtcttttccttgaagcttaagaattgagtaagcagttgtttgctggatttcttttcttagtttcgtgttttttttttgttagagtctcactctgtcactcaggctggagtgcagtggcatgtgatttcaactcactgcaacaacccaggttcaagtgattctcctgcctcagcctcccaagtagctgggattacaggcatgtgccaccacgcccagctaatttttgtatttttagtagagacgaggtttcaccatgttggccagactggtctcgaactcctgacctcaagtgatccacctgccttggcctcccaaactgctggaattacaggcatgagccatcacaactggccttggatttctttacctggttggtgcctgaatcttaacctgtttcagcccaagtgcaccccttcccgcattcctagattgcttctcctgtgatagtgttctcagttgttacctgctatttccctagaaggacctttagtgtaattcagagttccttctccccatctctaccatcactaatccaatccaggcccttctcatccttcatttgagcctctgctgtaatctctcaattagttttcctgactccagtttcatcctctatttgacccactctccatctgccaccagaatgactaaggaagtaattcaacaaccatttacgagccaattactcttttcaggctgggataacacagccaacgaatcactgtttctgctctcgcaaaacttagtttctagtactgaaggccaataaagctgtgtacgcaaacataactaatgtgtttataaactgttgcaaaggaaacaaaccaggatttgaggtggaggatgaaagggaaggtatcctttgcgtagggttgatgaacaagggctgtccttgatgatgacatcgaagctgagttcgaaaaggtgcgaagaaactagaagaggaatgaagggagccaggggtgtccaaaggagagaatacagttatgggttcttagtttctgtttctggttgggccagtaaagccccttcatcatccctcttttctgcttatcactagagagagaaactaaaaaccatgatttcaggctgcaaaaagcctaaaacaaaacaaaagaaaacagaacaacaaaaacaacaaaaggcgggttgaacaagcaatccagacagaatgaacagtctgtgcaaagatgtgtaagagcttattggtttcaaagaactgaacactagaagagagtgattaatgcacagagcaattgaacaagtcatgggagatgggatcagaaaaatgggcaagaatcgtgttacagaggcccttgtggtctgcagcagagagtgcaggacctattttctaggggagaatagaccccactttcttgtaattgtggaaatgagatccctgttttcttgctggctgtcagttgaggactgtcgctaggttctaggggccacatgcattccttgagttctgtccccttccttcatcttaaaagcctgcaaggctggtcaagttcttctcacattgcatctctctaaccaacccctctaccttcctcttccacttttaaggactattttgagcccgctcaaaatatccaagtaatcctgatcaatcattaactttaatcacatctgcaaagatcgttttgtcatggaaggtaacatattcacagaatctgggaagtaggacatggacagctttgagagtggagtggatattattctgcctaccacaaaggtagagtcaaatgagaaaagtatctataggggtccaggtgcggtggtgcacacctgtaatcccagtgctttgggaggccgaggtgggcggatcacgagatcaggagttcaagaccagcctggccaacacagtgaaacctggtttctacgaaaaatacaaaaaattagccaggcatggtggtaggcgcctgtaatcccagctatttgggaggctgaggcaggagaattgcttgaacctgggaagcagaggttacagggaatggagatcgctccactgcaccccagcctgggggcaatggagtgagactccatctcaaaaaaataaataagtaaataaagagaaaagtatctttggggtggttgatgaccttgacaagagcttttttggacatatgatggcaaaggagagccacatcatggtcggtggagcaatgaaagcagaagttagaaagtagaaacaatgggcctggcatggtggctcatgcctcatgcctgtaatcccagaactttgggaggctgaggcgggtggatcatttgagtccaggagttcaagaccaacctgggcaacatggcaaaaccccatctctacaaaaaaaatccaaaacgttagctgggcatggtggtgtgtgcctgtagtcctagctactcaggaggctaaggtgggaggatcccttgagcccaggaggtagagtttgcagtgagcctcatcacaccattgcactccagcctggataacagagcgagaccctgttgcagaaagaaaaccataaagtagaaacaatgtagtgtgtagacaactctttagataacttggattatggctggaggggatgtggaatgaactgaagcatttttttaggcaaatacaaatgatgtttactgataagaataaaccaggcaaaagtagcatgatgatgatactcggagcatcaccaagatgaggccctggaatccttcatccagggaggatagatgcttcatccgtcagggaagggaggaaaccctgcaaggaagcactggaatctttcccaggacaagagtggatgaatccagagccagcagagagcttggcctttgatgggagggacatgcccccttgtgtatagaagggaagatggaggatttggatgctttgtgacattgtgatgggagataagtgaagtgccatctcatggcttttattttgtcaatgaagtatgaagcagggcatcatctaacagaactgtgaccataccaaccttgcttcaaactcctcaacggcactacctgcttacctctgtttttgtttcctggtgctgtctgcctagaacttgacactacctcctcacacattctgcctagccctctggacacaccacacctctttgcttttgatggtgtgtttgcttatggcctttaccagaatgccttgcctcttctcactttcccttttaccgtctcccatccccacctcccaatgcacactccttttccaggaaccagccttgaaacacaccctcaccctggctgtttataggggcagaggccctggtgctttcattgtgaaattcacagcacctaggacagtacctgcacacaggaagagctcagtatatgtttttcaatataataacttcattgcaggtaaattaattgattgagcatatatctcaaactatcaaaatagggtaggaaaaaaatgaactgtattaagcggaaaagaactgttgttatactctttgatgacttggtatgatttcattttgctcactctcaaccaccagctttcagtgggctcaagcattcaaaatgtcaactttacaaagtcatgaaatcaacctaagcatccatcagtggttgactggataaagaaaatgtggtgtatatatatgccatggaatactatacagccacagaggagaatggaattatgccttttgtagcaacatggatggagctggaggccattatcctaagtgaagtaactcagggacagaaaacaaaatactgcatgttctcacttatatgctggagctaaacagtgcatacataaagatggaaataatagacactggggactccagaaaaggggagagtggaaagtgggtaaggattaaaaatattacctactaggcgcaatgttcactattcgggtgatgggtacactggaagcccaaacctcatgattatgcaatacacctatgtaacaaactagcacgtgtacccttgaatctaaaataatagaatacaataaaataaaggaaaacaaaaaaacccaaaatagcaaataaaaaattccataaataattcatatgttaaaaaacacaacaaagtgtcagctttaaatctgtattattctgtaggctgtaaagtctgtgagagaaaagattatggttcagccctccttgtattgtcagtacttgacacaaaatataaagcctgtagaaagtattaaaatgtttagatgaatgatttcgtatgatttaaaaattactatctgtttctagaagctgcagtatctagcacatcttccccgcggggatgtccttctgttctgattggcctttagagaaagtagtctgataccaccctgatttttatctctttatccatttcagaggccttgggttattctgagcatgttgatttcaagtcctgtaaagctgagtgacttaacatatcgttcttcaacttggtgtttttaaagagccaaacatattcacacatgctacaaatgcatgctagctctgcatttggttacttgatgagttcaaaagaagctcaaatctcagcattaagcaccatactccctgttacaaggccgcacatgtacccccgaatctaaaaaaaaagtttaacattaacaataataaattacaaataaatatgcatcgttataagcaagatttgtagtgcagtaggtccttgaataatgccatttcattcaacattgttttattatagtgttgatgagaaaacaaaatcggttcccaaccagggccgctgtcagtgtggagtttgtacattctgcccgtgtctgcaagggtaacctctgggcactcaaatttcctcttacatctcaaagatgtgcatgtggattagtgggcatgtctacattgtccccatctgagtgagtgtgggtgagggtgggtgcaccctgagacgggatggcatcctgtccaggttgggtcccagctcagtactctgagctactgggataagatctggccaccctgaactggagtaattggcaacatcattatcttacttgttttattcttttgttttgaaatggagtctcactctattgctcgggctggggtacagtggtatggcctcggctccctgcagcctctactccctgggctcaagcaatcctcctgcctcagcctcctaagtagctgggaccacaggcatgcgccaccatgcccgtctaatttctgtacttttgtattttcagtagagatggggtttcaccatgttttccaggctggtctcgaactcctggactcaagtgatccacatacctcggcctcccaaagtgctgggattacaagcgtgagccaatgcgcctggcctattcatctttcttaaatgtatgcatagcccactttcacttcagtgttaatattagatgtgtcttggtctttatttagaaatctggttattttttgtgatcagaaatatgccgtaggaaacttattcttgtttatattaattagcctgtggtaaaattgatttcattatatgttgttttgcttaaagtcacagttttcaagaaactgttgaaaatgttaagtgagtacttaactgtattttgagtggaataatttgcaactgaaaaaagtttacaaaaataggattaatttctgcagaaagtgttcacagtaaaatgccaagggataaaaatggtattaaaaattatatacacagtatggtcttaattttaggagaaaattctatatctatgcaagcatatatagttataggtttgtgtacaaaaatggctgtaaagtaatacaccaaaatactaatagcagttttgcctgggtagtggaatttgggtaatttcagctttcttccttatacctttctttattttctaaattttataataaatattttctttttgaactcaggaaatctatggtatttatttttcaaggtaaatttttctttaagcatcagtggtaaaattacttttgtccccctccagtgttgaagagtgcaagaaattgggagtcctaggtttgaaatgtttttagctaagaggactagagaatggcagttaatgtacatcaatgataattgatccaggagacgctttggagttgacttaaaatgtaaaaatgtgttcagggttcaatatatctattttcaaggtgttattgatcagatctgtttggtttcatcacctctggcagatgttccagtggtttcttaggagagcctccctctaccctggtatgtgtgatcgtaagccagactttctgaatgcagcttaatgcccaagaccaaaatagactagtgagtcacttggacatattctgaatcaaagatttaaaaaccaaagcatgcaaataaatgctcctaatgccttagctcagagtaaacatcagttaattttaattttaaggctagccaaatggctattgcttaaggcggccagagtgatgttaatgtgaagagctggctccgtatgggcaagggctacatgttttggtgtgttatggtatttatggtatgctatttcattttaattaattttgtgtattctctatgatactaacacaatgttgggcatgtacaaagtgctgagtcaatgacagagaccagagcagaggagagtaatataaagtactgattgatgaggatgtcataggttggctgagtctgccctgcttcgtggcttttgtcttggtttaatcattaatagtatcctcttttactctcaaaagtctttcatttggatgattgttttatagggccactttttgactgaggtggctgagtaaaatcttctagattccatgcgttcatctctgcctgaacagcagttgtctgcctggcaaaaatgtaagagccacacccaaaagcacatgctttttaatgctccctctctccttcttaccctgcgtaatggctgcagttttgtactaagccttttcagatagattaaatggaactgttgaagaagccctagaggattaaagctctggacaagttgatctctttctatgaccacagctgttccagatggtggtaatacttctaggaccctgaatgctgcatttggggccaatgggatgaaatcccaagagcacattgaaactgacaagctgccttgacatttgctctttagctcctaagccatggattcacttcttctttatggcggtttgcacttctgtttcctttattccttcagggactcctgctccatcccctttttgctttagaagaatgagaatttaaaaggcagcatgtctaattcactgaggattcagtgccccttaattgccttagaagcctgaaaagtcaggctctaggaataagctcagaggactcaaattgagacaaacatttgtattttgacaaaagctgtgcagtcttctgattcctgccctcaaagcagagtgtaataaatgagattgagaaaacacttgtattttctgaattagggtttaagttcctggaaacctcttgttcttgtttaatttaagattgaaatctgtgttttttttttttttttttttttgagacggagtctcactgtgtctcccaggttggagtgcggtggcgcgatctcggctcactgcaagctccgcctcccgggttcacgccattctcctgcctcagcctcccaagtagctgggactacaggcgcccgccaacacgcccggctaatttttttgtatttttagtagaaacggggtttcaccgtgttagccaagatggtctcgatctcctgacctcgtgatccgcccgtctcggcctcccaaagtgctgggattacaggcgtgagccaccgcgcccggccctgtgtttgtttaaaaatgaaaatggttctaaacttttcttgggtcactgagccctctgagaaaatgatgactgaggattttctcctctcacgtgtgtacacacaaagaacattttatatataacttcagaagtcttatgttgcctattccactctggattgtaggttaatataggagatagttggttgcctttcccatatccatgctctgtagcctgcattccttcttcctaggagaaaccttattatctccaggtagctcaccctcctccatgggatggtgtgtttgagagggggccctggcctctggtcccaggggtggtggggatggaggagaatgattggtctaaaccaatcatgatggtcccctgtctcctttgctagagactggttcagccatgggtatgtgatacatttctcacaaataagaggagtgtaatcctgccgggtagctttgggacaaagtttcatcactcttaagatgcgaaccatgtagtagtatggatgaagcaatctcgaaaccctttttaggtgtataataaggttgagcaaatgagaaaaggcagaaatagccctatggagtggattggaattggcatattggtgtgaattgaatttatgatttctaaaatatgcaagtgaatgcatatatgtgtgtttatgtgcagatgtatgtatgtgtatatttataaatatgtgtgaagacatatatatgtatagtatacatacggtcatatatttcctagctctgcctcttaaaaggaccaagaagaaatgagatcccaataacaatgagaacacctgctacccagattctgacaccattcttcactaaaaaacccctcaaaaacaaaaccaaaaaaccaagctaccttgcagaaattccagggccggggcgtgaatcaaggtgatactggaatcgcagattgtgtttctcaggctagtctcctaactaagcctttaacaggccaatccagtcttcagttaagctggatgcttgtgaatgaggtggtatatgagaaaactcatggagtccctactcatacactcattgctgcacctcctttgacatatatcgatccctgggtctgaagcaatgttgtgtgggatactacactgatagattaggcattcttatgttctcaaatagtggcacttgcagagaccctaaaggcagagaaagcaaacccaaacctggagtacatgtcaatttatgtaagcatgaatttctatctcccctctcctttttggggtggaagtggtctgttatgatcagcctttccccaagggcctggctgatatccgtgaaggtgctatagagattggcatctccctctgccattggttggctggaccattcagcagtggtaatagctaggtcattgctaagagaaagcccacaataccgagcccacatacagcctttatcctgccacctgagccatctcatccatgggcccattgtgctagcactggttgtctgagaagaagactctggctgacatccacaggggagtcatgcattcaaccagccaccactggatcttctcattcacatggcttgagtgacagggcagattgtaccagagcctgctgctgctgagtcctctcctgctttggaccacatttctgctgtctgctaactgaatacagagcttgaaataaagaattgcatgcaagagacttatttgtcaatgtgatcccaaggagtaggagggacgaggggggatgaaatagggaaggaaggaaagccagtacagcggccatgctaggtacaactgatgttcaatcccatcagatcttctaggagactcatgaaatttatctcagcactgtaaggaactaatggggttatcgtctcctgtccatcattgttcattggtcacagctggtcccacatgttttagctcccaggttgtgcatgtcagctgtcccagaagctttcttcaggtgtcggagaagtctgagggcaggagtccagagatagaaggcatctggtacagccaaaaatgaggtgccatcaagttgcacctgtttggaagttggttggaacctctgctggattggaaggctgcatcggggactgaagtgggaggtgagaggagataaattaggagtgttacataaattgtgtcccatgcacacactacactccaaagggtctaatgaggaaaatgcaggctttgaacaagccacacctggctccactcttatctagttgtaatactttggtttatttacctgactattctaaagttcagtttctcgtctgcacaatgaggatatcaactcgttatgcaactgggagagttagcagatgtgacatctgttaagttcctgctttgggcctggtattgactatgcaaagcagcagatgcacagataactttctagtcttgtagatggaagggaagggaaggagatagtggatgagggacgggttcataggaagagggcattggacaaaaatgcaggaaaaagaactcttcataaacagagagtggtgtgcatgtgttacagggagagaggacaggtaaaggtgttaaaggtggcaagattagtatggtcaaagtagagtccagaccaagattgggtgtgttccaggaaatagcgggacttccatttgagtgccttatagttatttcttaggagtggacacagaagacagcacagctggggtaggcgcttgaacgccagtttgaatagtttgaattatacttggtaggcagcctagaaggagctatagacaacttctccaaagactggaaattcaaccaaagaggccagtttgctttctagtttccccattccctcagctcattcaggccacgcaggaagttaccattgcatatgtgtccttcttgtagcctctggggatatcactgtgtaacttactcattccagaagagacatatgggaagatggggttgggcaggagtagggggctagctctcattcatgttttactttctttctttttttgagaccgagtttcactcttgttgcccaggctggggtgcagtggctcaatctcagctcattgcaacctctgcctcccaggttcaagtgattctcctggctcagcctcctgagtagctgggattgcaggcgactgccaccatgcccagctaattttttgtatttttagcagagatggggtttcatcatgttggtctcgaactcctgacctcaggtgatctacttgcctcggcctcccaaagtgcagggattacaggcatgagccacggtgcctggcctcatattttactttcaaggcgtagtgtatagtgccccgtgctaactaacgtatagtaagtactgagtaaatatttgaggagaggatgagtgaatgaaagtgctatgtatttatctcttccagttcttttcttggtggcactgttagcttatgtggctccttgggtaagacatttgcctgccttgtgccagagccagccgtgagctagcacaggggcgaacttctcttaggttctgaggttgaagactttggacaggttttgagcttagatgcatattgaatgtgtgtgtctccatttttctttctaggtctgatgtggctgtgtttcagcctgtgcttatacagtattcaattcactgaaaaataatgtggttgtgtaaacactcagaaggaagtgtggtgtgaccggtgatcacagcttctgccagaatatctagaacaggatgcattctgcgatgaaagagatgactacaatagctgtagctatttattttataaaaaaaaattcttagccctagttcatggcctacttcttccaagcagtacaggtcaagcatccctaatctgaaaagctccaaaatgtgaaactttttgagcaccaacatcatgccacaagtgaaaaatgccacactcgggtacttaacacaaagtttgcttcaggtgcaaaattatttaaaatattgtataaaattaccttcaagctatgtgtaaaggggtgtctgtgaaacataaataaactttatgtttagacttgggtttcatccccaaaatatctcagtgtgcatgtacaaatattccaaaattaaaaaaaaaattcaaaacacttctggtcccaagcatttcagataaagtatattcaatctgtattaaatgtaacaaaatttcagtaacatgacagaatctgagcaatgacttggaggcttatgtcactgattttgccttactgtgagaatatttggggagctgagcccaggaaatgtacttttccttttgttcttttttttttttttttgagatggagtctcactctgttgctcaggctggagtgcaatggtgcgatctcagctcactgcaacctctcctgggttcaagcgattctcctgcctccaagcaattctcctgcctcagcctcccgaatagttgggattgcaggcgcacaccaccgtgcctggctaatttttgtatctttagtactagagatgggatttcaccatgttggccaagctggtctcgaactcctgacctcaagtgatccacccggcttggcctcccaactctagctgcagagttacttaactcttggctctttcacagtataaagggatttggagaattaatctgatattcccaggttgaattttttttatttgttcataaaatttaagcaaaaagtattttttaaaatcttccagcaattcagggccttatgttctggagagccgagcattctaaagaacgtagcatcatttcctagaattttgcatcggtaccctgagctccttcatgttctttaactttcgttccccagcacatgaaacaccatggcagcaacccttattgcttgtggctacttctacgtccctcctttttttcacaggacattccgttcttctcaccagccctaacctgtttgccacttggcaagcacggggaacaggactctccacagtcttaccccggggactagtttcagcttttcagagagcaaagcttctggtccaacagtatttggaaattgagacaattgaggagaagtagtaatatgttcaactgcagagaatgtagcctttggcatacaaggaggaagctgtcttggcatctgtcattagagccactgggtattttggaaaaagtccatttcattcttcctctttttggatcctgaaacaagaagctatagtgccatcaggaatatagagattgggaagcatgggaatgattcaagtaaccttctgaagaaagcgtacacctccagggtagctaaacaagcagaatgcttgttggggaagcaaaatcatctgaaaacaacctgaatttggaggtaatagaaaaaaaaagtttttttaaaaattttatttaaaatggaaaaatttaatggtaggatgggaaagtagtacttctagcttggttttggattcagacctggatgggaatactaactgttagaacttgagaaaacaatgttagcatctaaaccttagtttctgaacctgtgaaatgagagaataatagttcatttgttcccttttgaaagatgtttaaattgtggtaaaacacaacaacatagaattatcgtcttaatcattatagtataattcagtggcattaagtacatccacattggtatgcatctgtccccagaactcttttttcattttataaaactgaaaatccacactcattaaagagtaactccccagttttttccccctcctccagcccctagtagccatcactttactttctgtctgtatgaatttgactactccaggtaccttgtttaagtggaatcatacagtatttgtcattttatgactggcttattttacttagcatagtgtctccaaggttcatccatgttgtagcatgtgtcagaattccctttcttcttaaggctgaataatcttccatcatctgcatgttgtctttatataccatattttgtgtatctatttatctgtcagtggacacttgggttgcttccaccttttggcaattgtgaataatactgctatgaacatgggtgtacagatatctccttgagacccgtgtgttagtttgctagggctgtcataacagagtccctagactgagtgacttaaataacagaaatttattttctcataattctgcaggctaggcatctgagatcaaggtgttattaggattaatatcttctgaggcctctccccttggcttataaatgactgtccctctctatatcttcacatgatctttcctgtgtgtgtgtctgtgtgtccatgtccaaatttcctcttcatataaggacaccattcatattagatgagaacccatcctaaataccatatcttaacttagttacctctttaaaaatgtatttccaaataaaatgctgttctgaagtactgggagttaagatttcataaattttgtgggaatacaatttggcccatgataccccactttcaattcttttggatatatccctagaagtggagttgctagattatatggtaatcctatttttaatttttttaaaggacatagttcatttttatagggtggctgtgagatttaaatgcccgtaaaatttctagtgtagggttggccccagaaaaagttgacttcaattagctgtataaactgtaaagttaactattctgatccctggatttttaggcaaagaaattgagtccacaaaagttaggcaacttatgtcttcaagtttctggttagcatcagattcagaaaaataacctaggttttggcaatgtcaggactgttgataccaccatgcaccatttcttttcagtccttcatagactgttcagttatttgctattaactattttctggcttttatggtatgtgatttattatttttttaaacttagttttctgaataggtactatattcacttggttcaaaaattgcaaaagtttataaaggtttacagtagaatgtctttctcttatgtttatccaccagcaacagtgtgccttccccataaccaactgatattaccagtttctaatgtagtcttccaaagatattttatgcatgtataagcaactccatttgtgtatttttttttttgccattttcttatacaaatggtaatttgtagtcttctgcatcttatttcacttaatgtattttggagatcgtaccacatcaatacataaaaaaaacttctacattcttgttttggctccatagcattccattgttgaatgccctgttcctcatttagccatctcctgttattagacagttgttattacagacaatactgtgtttaaaaaacttgtacatacatcattttgcatgagtgggagatgttatatctttatatctttagtatatattcctagtggtagaattgctgggacaaaaggactatgcattcataagacagatttttgccaagcgttccttcaaaggactttaccaatttatattttcactatcatcttatggaacttttaatgacgaggagatggcagtagtttccaaatatattagaccaggccctaatttattaatctagtgatgactgtcttcatgagggcttggcaggagtcaaagcaaaaatcagaggacatctcccatagatcaggaacaacataaggatgtcttttcttgcaatctgtgttaaacattgtactgctagacaagaaaatgaaatcaaaaggatccacactggaaaagaagaagtaagatgatctctgtttgtagataacacaaacagatctctgtttgtagatagaaaattctaaggaacccactaagaaaactattagcacttacaagcaagttcagcaagggtgcaggatacaagattaacatacaaaaatcaattgtatttttatacactagctatgatcaatttgtaaataaaatatggtgaaataatttcctttataatatcctcaaaaagaataaaataccttggaataaatttaacgaaagaaatgcaaatcttatactctgaaagctacactgttgaaagattattaaagaagatctaaataaatgcaaaggcgtaccatgttcatgagtcaaaagacttaatattgttaagatggcagtagtttccaaattgatctgaagattaaatgcaattctcatgagaatttcagctgacttctttgcagaaattgataggctaatcctgaaattcataagataatttaaaggcctcagaatagccaaaacaaccttggaaaagaatgaactcggaggaatcacacttcctgatttcaaaacttactgaaagctacagtaatcaagacagcgtgatgctggattaaggatagacacagacaaatggaatagaatcgaaagtccataaataaatccttgcatttacaatcagttgatttttgacaagagtgccaagacaattcagggggaaaggagtagtcttttcaacaaatgttgcttggactgctggatatacatatgtaaaagaatgaattttgacccttacctcccaccatatacaaaaactacaattaaccaaatacttaaatataagagctaaacatgtaatactcttagaagaaaacataggtgtaagttgtcataaccttggatttgtcaacgatttcttagatataatagcaaaaccgtaagcacctatgaaaagataggtaagttagatttcatcaaagttaaaaatttttctgtggcaaagacacaatcaggaaagtgaaaaggcaattgacagaatgggagaaaatatttataaattatgtatctgataaaggacctgtatgtagaccatgtaaagaacctttcatttaatactgaaaagataactaaaaaaatgagtgaaggatttgaacagacattttaccaaagaagatctataaatggccaataaatacgtaaaattatgttcagcatcactgattatcagggaaatgcaaatcaaaaccccagtgagatctacttcacatctaggatgacaattgtaacaaaaacagaaaataacaagtgtaggtgaggatgtggagaaattggaaccctttacattgctgatgggaacgtaacatggtgtagctgctttgagaaacaggttggcaggttcaggaaaggttaaatatagagttactgttggacctagcaatttcactcataggtatatactcaagagaattaaaaacgtatgctcactcaaaaaacttgtacatgaatgtacttagcagcattatttataatagccaaaaagtggaaacaatacatatctgatgaatgaataaataaaaggtggcacaggtattctatacaatggaatattttcagcaataggaaggaagaattactgatacaagctacaacacagatgaactttgaaaatattttgcaaagtgaaaggagccagtcacaaaagtgcacatattgtataatttcattgtatgaaatatctagaataggcaaatctgtagagacagaaagtaggctagtagttgccaggggctagagggaagggtagtgttgaaggaaaagagggagtgactgataatgggtatggtgttttttatgtgggtgataaaaatgttctaaaatggattgtgatgatggttgcacagctctgaatattctaaaagccattgaattgtacaattaaaataggtgaaatacatgttaaataagtgaataggtaaattatatctcaataaaggtattttaataagagtcagagtgcaaaggtaatgtcatggaccaactctaaaattaacaattcaaactcttcagtagcaaacattctaaaatctctagaaaagtatcccatactcacatctcatactcacatgtgtccactgagactcgtgggtagttcttgagatgggaaccacttctgagtcattttttttttcaggttttaggatgagcaactttggaacggaggaggcctttagaagaaagaaggaagttttagatcatgcctgcaattcagccttgcagagttgtttgcctgtttgaattttctcttatctctatggaacattgactacttcctcagaagcttatacactgttagagtactgggtaaaatttcatttgaaactacgggaactcctttgctgacctattgtggctgttcctaatgtttcttggcttcatgctgcttaggaccccatgggaaatcttggcagaacaccctgttatacatctatactgagtgcctctcacagcttcccttcacatcagatttttctgtttgtcacccgcttttgccccttttccttcttgtcttaaagagagacatccttcactcctgtctctgaggctacctgtctcctgtgttcttgatcccacgttgtcccttgggacactgcttcatcatttctgtgtacctctctggcctcttttgaccctttccctcatgggctttttttcttggctcgacagttgctcaaatttcccatcattttttaagaaagtagtaacaaatgtacaaaaagtcccaagcatcaaaactttccttagatgtttatgtctttctcaatagactacaatctttttattttctcacagtcaacttttttttgaaaagtctgtgtattttcctatttccatttatgtaaactttgaatgaagagaccagagttacaaagcaaagagccttgtgctaaaattaagtctagaacatatcatacttggaagcattctgcatgtgaaggagaagtggggtggccacaaggaggagaaggcattttctaaattgtttttccaagttgtggtacttgaagcccaacgactgtaattagactcatattctggctacagggctggatgcagtgagagtgttatttggtgtcccactttgtttgtttatattttaggcattggagaatggaccagtttcttgggggagaaagtaccattcttgagattaagagatggaagttctccctgtacagaaaatgccctgagagagtcatcaagatgtatttggttaagtgtgttcatttcactttgaatgttaaggtttctggcatgaagccagatttcagaatctcagtgatcttgagtgtttagtctagtctgagactgatgagtgttctaccaggaagtgagaagcatcaggttgagaatatcattgggataaggtgagcagggaatccattaagggactaagagccctttactttgatattgagaggggacattgccacacatgatacaaacagcactgatcttgctcagcatctgcaaataaggatcgcagacacaacttttcaaatagtcacttcagccttacccttctgctaaagtaatttatgtcaagtagggaataggcttttcaatgtcatccaaaccccctgcttagggaaggggcattcgtttgtaaacacactacagagctattgaagaatacaaaacttggtgaccttatctgtaaagctggtgtggtacccttctcaaacaccagagcaccgtttagtgagaaaatcagctagtcgattgcccaaacgttttccattttagcatcagaggaaccaaagtccaggaaggtgaaaatatgttgggcaaaggtcgtggcaatttagttttttgattgagtctagatctccctggatagacctgggtcgtgtcaaaacagtttctggtaaacagttttataacctgcctctgtgatccagaagagcctggacatgtgagtagaaagcctgtacagtggatttaatcctggactttttcctttggataccagaatttatatatagccctgacatagttcagcaataatccttacacgagctagtggaaacagacttgtgatgaagagtaatttcagctgaaggactaaatacaattatatgggaaagccgactgcttacatctgtacaagctctgtgtatgtggacaaggtcctcgaaacagaggaagtaataccccatgcagctgtagtgatcattaaattaagcaattcgtgtgaaatgctgagaactgtgccttgcatgtaacacatacgcaataaattctaggtgctattattattctcatgagcaaccacttgttaataagaaggtacctgccagaaacggcagtgtagctgatgggtaacttacagcgttcatttatcccagacatatttattgagcatcacagcctatattgatttgctcctttaatgccaccaaggtagatattggttttcccattttaagggtgaggcttacattaataacatcccaagttttcactgctaatgacgggcttggtcctttcccactaggtctctttttcacagggtcttgttgtgttgttttccaatttactacatataactttgttggagactttaaaatcatctgactttgtatagatatgagtgggtacttccttcagtctttaattctgcttcccaataatgaagacttgtgagaatttccatcaataatatttacttaaaatcaatccaataaaaacctacaacttaaagaaaatcttatgaaattactgtatgcaggaaatattacaaattacctcctcatatttttgattagccattaaaatcagtttgggaattaaagagcttctgtatagcaaaagaaactaacactagagtaaacagacaacctacagaatgggaggaaatattctcaaacaatgcatccaacaaaggtttaatatctaaaatctataagaaacttaattcaacaagcaaaaaacaaataacctcattaaaaagtgggcaaaagacatgaacagacacttctcaaaagaagacatacaaaaaaatgctccacatcactaatcatcagagaaatgcaaatcaataccacaatgagacagtgagaatggttattattaaaaagtcaaaaaatgagatgctggtgaggctgtagagaagaagaaatgcttatacattattagtgggaacgtaaattagttcagccactctggagagcagtttgagaatgtccccaagaacttaaaacagagctaccatttgacctagcaatcccattgctgggtatatatccaaaagaaaaaaattgttctaccaaaaagacacatgcccacatatgttccttgcagcactattcacagtagtaaagacatggactcaacctaaatgcccatcagtaatagactggataaagaaaatgtggtacatatacaccgtgaaatactattcagctatgaaaaagaacaaaagcatgttctttgcaggaacatggaggcaagcaagtcagtgcaggaacagaaaagcgagtactgcatgctctcacttagaagtgggagctaaacacttatgtccacttcggtactcgtggacataaagatggcaacaatagaccctggagactagtagaagcttgaaggagggaggggagaaagggttgcataactaactgttggatactgtattcactacctgggtgatgagatcagtccaaacctcagcatcataaaatatacccatgtaacaaacctgcacatgtacctcctgaatctaaaataaaaactgcagttatagaaataaaataaggctgagtgtggtggctcatgcctgtaatcccagcactttgggaggctgaggtgggtggatcacctgaggtcaggagttcgagaccagcctgaccaatatggtgaaaccccgtctctagtaaaaatacaaaattagccaggtatggtggtgcatgcctgtaatcccagctactcaggaggctgaggcaggagaatcacttgaacctgggagatggaggttgcagtgagctgagattgcgccattgcactccggcctgggcaacaagagtgaaactctgtctcaaaaaaaaaaaaaaaaaaaggaaaaaaggaaaaataaaataagtttgggaacattgcataggttacagtgtatatgagactacatggaacatatttactctaatacgtttcacccacatttctgtgatcacataggtggaacattgttctggtacaatagagaatttatatactttttcttgtgctcagtcttcgcaattaactgatttagatatttcaaggtgactgcctggaacaatttccagacttattacctaagactacagaactccacttcttttgacaccctgagttatggcattgcctgaagcaatagttgttaattacggtaatgattatttcttcaggagttaaaaagttagagtttaaatctttctataggactgtggaattttcactttaagggttacgtgaggatctgaactagttaatattgaaatgagtacacttgcatgaaccaaactacagtactttgaaaataagttgttagtttttgtagattagcgttctctttttagaaaatctcagatttaaattttttgattttcttgaagcaatttctttgtctttgctttttaattgggcatcacgaacccttagccagaagtgtcaccagtgggaaatgcgctaagccaggaaagtatgtagccgaacaaaaggcaaaggctactgtgttcttttgctaggctatggtttgcaaaacatgactctcacaaacgtccagcttctctggaaagaaaggtaactagacattgcagaaacagccatggggcaaaggattaaactgaggttttccaggttgcaggatttgagttacagggtaaagaatcttgccatatattttctattattttggccgcggtttctttaccctcttgtttcttgttggcagggaacatgaagagtttcagaattcatgaggaatttcaggcctggggaaagagctgcatttcttccttatgctttttcctccaagatggcgttgagttagaaagacctggaagggggtcagcctctcctccttccttgctccactgaagagcaggaggggactcctctgctaatatccattctttatagtttgcagttaatttctcaactttggttgttttgccttcttatattgtcaaatggagactctgtagatgtttcttgagtccagggattagccagttctttgtttctgtcgccactagcaatgcaggatcacaagatgcttctgaaggccaaatgctacaggagttaagaaggcaagagagtgaaagtggggtagggaaaggaagagaagagcatgggaaaagcaagaaatacatttgttagagagtgtggcagtgtgggtgtggcaggaaggatgctgcattatttcaataaatgttggaagaaaatttgacaaaattcattgtccatttctgataacagcatattatttaataattttctgtagctgctgtaacaaattaccacaaacttggtggtttaaaacccctgaattttttttttttaagttttgttttacgttcaggggtacatgtgcaggtttgttatataggtagacttgtgtcatggggatttgttgtacagattatttcattacccaagtattaagcctagtacccattagttatttttcctgatcctctccctccccctccttccaccctctgataggccccagtgtgtgttgttccctcatgtgtccgtgtgttctcatcatttagttctcatttatataagtgagaacatgagataatctggttttctctttctgtattagtttgctaaagataatatcctccagctccacccatattcctgcaaaggatgtgatctcgttctttttttatggctgcatagtacttcgtggtgtatatgtaccacattgtcttttttccttccttccttccttccttcctttcttccttccctccttccttcttttttttgacggagtctcactctatcgcccaggctggagtgcaatggcaccatcttggctcactgcaacctctgtctccagggttcaagcaattctcctgcctcagcctcctgagtagctgggattacaggcacgtgccaccacgcccggctaatttttgtatttttagtagagacgtggtttcaccatgttggccaggctggtcttgaactcctgacctcaactattctgcccgccttggcttcccaaagtgctgggattacaggtgtgagccactgtgcccggcccacattttcttatccagtctatcattgatgggcatttggattgattccacgtctctgctattgtgaatagtgctgcagtgaacatatatgtgtatgtgtctttatggtagaatgatttctattcctctggatatagacccagtaatggcattgctgggtcaaatggtagttctgtttttagctctttgaggaatagccacactgctttccacaatagttgaactgagttacactcccaccaacaatgtataagcattcctttttctctgcaacctcgctggcatctgttattattattattattattattattattattcacttttgaataatagactttcagactggtctgagatgttatttcaccgtggttttgatttgattcggactggtctgagatgttatttcaccgtggttttgatttgattcggactggtctgagatgttatttcactgtggttttaatgatcagtgatgagctttttttcacatgcttgttagccacatgtatatcttcttttgaaaagtgtctgtttgtgtcctttgcccactttttaatggggctgtttgcttttttcttgtaaatgtgtttaagttccttatagatgctggatatgagacctctgtcagatgcatagtttgcaaaaattttttcccgttctgtaggttgtctgtttattcataatttctttagctgtgcagatgctctttagtttaattagatcctgtttgtcaatttttgcttttattgcagttgcttttggcatcttcattatgaaatctttgcccattcctatggctgagtggtagtgcctaggttgtcttccagggtttttatagttttgggttttacatttaaatctttaatccctctggagttggttttcgtatatggtataaggaagggatccagtttcaaccttctgcatatagctagctagttattccggcaccttttattggatagggagtcctttccccagtgtttgtttttgtccactttgtcgaagatcagatggttgtaggtgtgcagccttatttctgggctctgtattctgtcccgttaaaacaccagaaattttttctctgacatctggaggccagaagtctacagtgaaggtattggcatgtcaggctccctccagaggctctgggagaggatccatgcctgtggtggctgctggcctttggcattccttacattgcagctgcatcaccaaagtctctgactcagccttcgcctctccttctcctctctgggtgtgtctactctccctctgcccctctgtgtaaggacacttctgattgcatttaagtcccacctggataatttaggctcatcttctcatctcaaaagccttaatttaatcacatctgcaaaaaattatcatgataacattcataggttgcatggattaggatatgggcatgaacttgggaaccatcctcagcctggcccactcagtaaaatgaaaagagtgatatacctcctcaacatgagaaaaatcattcagttggtctattcagctgaatccaaagccagcatcatttttttttaattgtgaaaagcaagaaagaattctcttaaagtgaggatcaaatgaagatgtctacatgaatatttcatatatgttttggacatgtcagccaatgaacttatacaaaagaataagaggcttaaatattaaaaagttgtgtacaattcatttggaaacaagtagacagattaataggtgatattggaagaactatctagccattggggaagcggaaagaatgtttttaccttatgaaaatgcagagaacataaaagaatgtaaaaatttaaaattttatataaccaaaaaggaaaaaaaacagtgtatgtgtttgtgtgtgtgtgtgtgtgtgtgtgttgcaacactaactacaaaaggggcaatgccttcttttacaaagaaaacaataataataacctgttataaaaatgagcagatgacttgaacagggagttcacagaaaaatgaatacagatgacagtggatatataaaaaatactcagctgcagctgggcgtggtgtctcacgcctgtaatcccagcactttgggaggctgaggcaggcagatcacctgaggtcaggagtttgagatcagcctggccagcatggcgaaaccccgtctctactaaaaatacaaaaataagctgggcatggtggtgtacgtctatagtcccagctacttgggaggctgagaaaggagaatttcttgaacccgggaggcagaggttgcaatgagctgagatcgtgccattgcagtccagcctgggggacagagtgaaactccatctcaagaaaaaagaaaaaaaaaatatatatgtatactcagcttcattaaatatttttaaaatgtgattcaaaacaatgagacaccccttgtacccttgtacccatcaaattgacagagatgaaaatgttaatttgctgagggattatttatatttattcatttttccttttttcattaagagtttaagttagcttgctaggttgcataaaattaagcaatttagcataaattaaaagtaagtgaggccacctgcaaagtagtcttgccaaacaatctgatcaagttgaatctgatcaatttctaaccaacagagggatgtgtgagtcaataataagggataagagcagcagaatccagtggaaaaaactacaggacacatggcctgcatttcttcaacaaaataattgcatgaagttgcaggaggagaggaaagggagaggcaaaaagaaatggagggaggtcaggtgcagtggctcacgcctgtaatcccagcatgttgggaggccaaggcgggcagatcacctgaggccgagagtttgtgaccagcctggccaacacggtaaaacctcatctctactaaaaatacaaaaattagctgggcatggtggcacatgcctgtaatctcagctacttgggaggctggggcatgaaaatcgcttgtacccaggaggcagaggttgctgtgagccaaggtcgtgccactgcactccagcctgggtgacaaagtgagactctgtctttaaaaaaaaaaagaaaggaaaaaacaaaatgaatggagagcccctggattaaaagggaaataagaccctgtactgatagcattctaggggaggagttgcagatgaagaacgttcctttgtttctttattacccccttagtcttcaagcagctggttgaattaaagttactatcttggagtttcctttggttaaaagggaggtgatcagagtgctattaaaattgtgggccgggcgtggtggctcatgcctgtaatcccagcactttgggaggctggggcgggtggatcacctgaggtcaggaattcgagaccagcctggccaacatggcgaaaccctgtttctactaaaaatacaaaattagccgggcatggtggcgcacttctgtaatcccagctactcgggaggctgagataggagcatcgcttgaacctgggaggtggaggttgccgtgagccgagatcgcgacattgcactccagcctgggcaacaagagcgaaactctgtctagaaaaaaaaccaaaaaccaaaaaacaaaacaaaacaaaaacccaaaattgtggtcttggaccagaggaaaaaaagaatccattacttccacataaaaaaaaaaaaaaaaacaacaaattcacccctcttattcgctatgccactcttttaactattaaaacagaattttctgtgattctgttactatttaagaacatctttatatattggtaaatttcgttttattttttcttttatttattttttttttgagctggagtctcgctcttgtcgcccaagctggagtgcagtggcgagacttcggctcactgcctccaccttccaggttcaagtgattcccctgcctcagcctcccaagtagctgggactacaggcgcccaccaacacgcccagctaattgttgtatttttaatagagacagggtttcaccatgttggccagggtggtctcaaactccagacctcaggtgatccactcgcctcagcctcccaaagtgctggaattacaggcttgagctactgcgcctggctattttggtaaatttcaaacatattcaaaagtggactgtattataactgccaggtatctagcactcagctttgacaatgaccagctcatggccaatcctattttatctgtatctctatcccccactctgcctttttttttgaagcaaattctagaataatatcatttcactcgtaaacatttcagtattatctctaaaaaaaaaatacttattttttaaaacctaaccaaaacccagtgtgtattttgaaaagctcgagcacgccactaaatttctttgcaacccattgccattttttattttaaagtgatgtttttaacacccttatgactacatttccttgcgatcaatgctaatgagtgaagcagcccataaatgaggaaggagatgaaccgagacagtaggagttccctactgcctgcctcctgccttttccctgggcctagaacataactcagggcattggctgtgatttgcttttaggttcttttaagaacatcttagtcaacaccaaattgttaacatgacataaaaggtctactaggacttttttttttttagctttaatcacatgaagctgtaataaaacccatttgagcacttttattctcttaaaatggggccatttcccaattagcggatggacaggctggctcattcttctttgacaggaacgtaattctttgtgtccttcaccgattcttcgaaatgttcttagcttggctggctgccttcccttcttttttttttttttttgagagggagtcttgctctgtctcccaggctggagtgcagtggtgcgatctcggctcactgcaacctctgcctcccgggttccagcgattctcccgcctcagcctccagagtagctgggattacaagcgtgtgccccacacccggctaattttttgtacttttagtagagatggggttccagcgattctcccgcctcagcctccggagtagctgggattacaggcgtgtgccccacgcccggctaattttttgtatttttagtagagatggggtttcaccacgttggccaggctggtctcgaactcctgacctaaagtgatccgcccaccttggcctcccaaagtgctgggattacaggcataaggcaccgcacctggccaccttctttcattcttcttgtttccctgtctgtctcaggcaactttctacctctctgtttgtcattcccagatctactcatttcctcctgtccctctcttaagctccatttgcctgcttgaattctgccatgcgtcccgtccctgcagcatcttatacttaatacatctgacttggaactcatgatctgccctttccccactggccacccccactgacctgactttcctctttcacttaacttcatttgggggtggaaaagccagatgacgagcatcatttttattaccactactattactagtagcaatacttctactattactattactacttccagtactactactatgcttctgttcctttgttcctcttatgcagtaagtgaccagagcctatagattttgcctctgcaaaattcaagcagcttatttgtgagccagattgctgtggtctctacctcttatttttgggtctagtgcttaaactctgtacataggtaagaagacatgggccctgacttcaaagggcttgcatttttagtggaagacatggatgaacagatgggttcacttaatcagcataggaaggttcagggtactgtggcaacacagaggaaaggtatttattgcattggggactttcatggaagacttcctggagaaaaacatacttgagctgagtgtcgcagttgactggggaaaacaggtaataacaacattctgaggaaaataagagcaaagacctggaggcataaaacatcaaggcatgagagtatgtgggtttatgcatgagtgtgtgtgtagcacagtttcaaaacatcctgatattattagatcagttcatcttgttacatcttttttttttttctgaagcatggatgtggtatgatgttcctctactgaaaaacatacatgacttctctttttacatctgaaatttaaaatatatttgttacagtattttgatctctgactccaacttcctcctccaggtttctctctccaccacttttcagtttgtccagagtagaaaactcagaattctttgaatataccacagtgcttctccttacaaagatatttcatcctcattttactttgaatccccttattgtctctccaagtcttgattgtcaaaatcccacccatggtctttttaaactttgattttggaaatatttaaatatataaagaagacatacagtataacaaaccctcaggtacccttaaatcctaccaaaatcaaagggccacttcaaataccacttcgtatgtgagaccatttctcagtgttgcttgtgcttgcttcttctctgcctgctttcagggtgcaatgctgttattatacatcacagggtgcaatgctgttattatggagttgggttttcatatctcctgatgcttcgatggcagaattgcatcttaataagttttgacccttgcaatgtgtaccctggggaatgattgacaatttcagctcaaagatagagataacacagtgaggagctagcttggaatttaattcttactaatcagaaagaactggtgggttgtgggggatgtgacaagagccttggaggaaagtgacgttggcaacataaagtgagaaatggtaaaacaagacaaacaaacaaacaaacaaacacaaaacaactttacatagacatgtggtagacaagggctacttaactgtggctgatttctcagacacttgtgaaacttaaaaaaatatatggatcctgaagcctcactctatcaacttagctggtaactactgtccccagtagctgagagacctggacaaaagggcatcagcaggggacccacctgcatgggtccttttggggcagtttcacccatagggataggattgcaagtgtggcttcagtgacacaactacaatgtgagattttaagactttttagcacttagagactctgtatggcacccagcacgcctggaagccacacacacacacctggaagccacacacacacacacacacacacacacacacacacgtgcacgcagagagagagagaagggaccactgagccaatgtctttattgggtacagggcgttatccagtttcctgcagggagctttaattgctgggtttaaagcaagcaggcactagttctaggaggtcacagcgtgactgagaggtggtcaccttacgtttgtgggcaaatgtctgcatggtctgtttaaagggagtggcaggaaagtagggaggccagcctgctaggcaggagagatgtctctaagtttcatgtctggccgctgctttggagccactctggtggagtgtggtattagacaccgtgttaagagtgactgagccctgcttctgatatgagatagtttaacttaggtttaaaaatggatactgaggcaatgtaaaattataagcactcactacactcagtcccagaaatcctgagtctatagacctggagaagttcccatagtcagtgggcacaaagagaggtagattcaagattgatgagatgtttgaaaaatgtaattctagtgtaaataacacgaaagagggagaatggagcacggaatttgaagaaataagatgccatccagggaacattctgcttaactcatattttaaaaatgtaagcgtaaacatggaagggacaaaaggaagtatttattgagcacctatattatgctacaccctgctaggcttcttcacacacactgtgtcaatcgagtctcttaatgacctgcggagattgtacatcatctccagtttgcaggtgtggaaactcagtttaagataagaaactttctcaacattacgtcactaagtgggacagctgggatttgaaatgattcttattgatgcagaggtttgtgcaatttccattccattcttggttgttcattttgtttgtttgttttttgaagagctctgtacaaatgttcaaaacagttgagaaaagaataacaaacattcagtcaacaaatatttatgatgtgcaggtgctgggcaaaatcattggccatcatggaacttatattctagtggagaaaggtagataaacaagtaataaataaatgcagaagtaaataaataaatacaaaaataaaataattctagattgtgagaaaaggtttgcgggaaatgagtggaagatggtcatggagatctattgtagagagagtggacatttttcaactaaaatatcaaagtttcagggaagctgctttgagctcatattgtgttgcaggctgagtgtaaggtgccagaatgtgaaagcaggaatgtgtggatagtaatccttagattgtgttcaggaagctctgggaaggttctatgagggaggttttgaatttggaaggttgagttcttgtctgcaagacagctagagccctccaggtagaaggaacagtatgagcaaaggtaaggtcttaggagattcattctgactctgaaatcaaactgactgcaggttttaaaatgagcttttcagctgggcacagtggctcacacctgtaatcccagtaacagcactttgggaggctaaggcgggcggataacctgaggtcagaagtttgagattagcctggtcaacatggcgaaaccccatctctactaaaaatacaaaaattaggcgggtggggtggcacgtgcctgtattcccagtcgcagctactcgggaggctgagggccatgagaattgcttgaacgtgggaagcagaggtttcggtgagcctagataggaccactgcactccagcctgggtgacaaagtgagactctgtctcaaaaaaaaaaaaaaaaaaaaaaaaaaaggccgggcatggtggctcacgcctataatcccagcactttgggaggctgaggcaggtggatcacgaggtcaggagttcaagaccagcctgaccaacatggtgaaaccccatctgtactaaaaaatacaacaattagttgggcgtgatggcgggcacctgtaatcccagctactcaggaggctgaggcaggagaatcacacaaagccgggaggcggaggttgcagtgagctgacattgtgccactgtactccaggctgggtgacagagcaagattccatctcaaaaaaaaaagaaaaaaaaaaagaggttttcagcttttcttctctaaactttctgtaattccagagagatttgtcttcagtgtttggaatctcagtggtatataagagccagtggttttggaagattggaggatggcagagtccctgttcacttttacattgctgttgcaaagccagctttcttcctgcatgcctcttcccctgccctgcttcgttcgttgctttgcatatgatgattgcaatttaataacactgaatgatacttcactgctggttttattgccaactacccttggaacgtaagcctagatgcaagtagtaaggagagggcagccaaggcctctagattgccagttacttggctggaaatcccattcatattgggaaacagatttttaaaataaatttggcactggaaacactgccatccttttgtgaagctgtgtcaataatcataaactctcatagtcgtgcccccaaccctcggccaagctaacaaatatttaggcatcagcatatcttcacgatgccaccttctgttgaccgcgtgggcttctcatgctgtttgggttggcagtggaacataatcttctgttttatgtaatgaggaacatcagaggagtgctttgtgcttaccctctcagagtgtgtgcaagacctctcgtggaccccatcattttcggtgcagtcaaagctagcgaacatttctgtggcctggtaaatattttctaactattggcaaggctttttaaatttttttttccagtgccattttgctccaggccaggattataatgacccagctttgctttggtttcagatgaattttgcaaatatatgtgtgtggtgggattacactattttcagagaacacagtcatgcgggtaacagggtctgatgcaatatagtgctgcatatgcccaatcaggccgacgaggcttaccctttgcagactgtgccaataagcagtcgaggcttgttgcgatctgcagaaatctacagaattctctgtttccgagaaggcttgttgctagcatatgacatcatagaaagcctttttttttttctgacattttttctgctttgctttagaatatcaaaggcaaagactgttgaacatagttggccacttagctttattattcatagtgctccctcccatgtttttttttttttttttttaacagtgttcaatgttagcgtcaggtgttggctgccttcctgggggaacagattgctgtgaagtaaacacagctggaaactgaccacatattgtttttctttcttttaagaaatcaaagaggcatttatagaaaagctgcagaacatggtactgtccagatttatagatttattcctccaagtctggttaatgattaatgtcacgcctgggtgtccacatagacccacttcccttctcccttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagtaagcgaactgcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcagggtaagaatgatgttgatgtggggggctgtgggggtggctgggtgtaacagtgatctggggagagaatcaaaggccttctcctcccacttggaagactttactattattttggtcttttattcctttggtctctgtgctaaaaactttctctcttttttactgtttctttgtatagatgttttggtgatttaagttatggtgtaataattaattgctgttaagaattgctactaattacttgctatattaaagttttccaaaggggttttctcaataaatagctatttctctttacatctatcttgtaagaactgagttagaggtaaagaagagaaagatgtaggaatttaagagtaacttctgcttttggtttgcttaaatgacaactggagaccagttttcataggcaaaatatatgttactttagtttttgttttcgttgagagaactgtagggtcgccttttgggattacctgaattatctgtcacctgcactggaatttgtatgtagttatctgtatagttatctaaacaagttgaatccgtcattcattcctcactgaagaatctcatcgaaagtaacattccctgtctgtttggctgaggtgcatggatgggaattgttggaattaggccatatatctatttggattctcataactgggtccagcacctagcatagttcctggtacataggaaagctctatgcgatgtcaataactgactaatttagtaacatccttaacagctgtttgagttccaagagcaggaaagtgaatggtgagttttgaaccttataaaatacataagtaaacccaaatgaggagagaattgagaaagcctcttattctgaaggtggtcctaaaaggctttctctaggctgattactgtgaagcatattttttcctggctatatacaacttggcagaattgatctgattttggattctgaaggaattgaaaaatttcattatacattatagtgggctataatgatgtggccagttctcttcattaattttttaaatgactttaaaaaaaatgagacagtactgattgtttccctaaatgaatctaattaacagctacttaaggtatcttaatgttttttcatatatgttatctgctttgattctcatatcagtccagtgaggtgagtatggttgttacttcctcattttacaattgagaaaactgagagtcagatgaaaagtgattctagaagttgcgtgatgcgtggaagaaccagatgtcagctgggtattttaaaactcaaaatcccgggtacgtctcacctgccccctctccagtcatctctaaacgtcttctattgcaggatagtagaaagaactcccacctgggtgtcaggagacctggattctgattctgactgggtcattgctgacctctgtgatgtggagcaagtcactgaagtctttggatgttatttttctgcaaggaggttattttaattggtttcttaagtttctttgcagcttcaggatctatccagggccatatccagggcttgtgttatctctgagtgctcatctgcaatgtagagaagaggtgggaaaggaggtaggattctttttttttctttttttttttgagacagagtcttgcactgtcgcccaggctggagtgcagtggtgtgatctcagctcactgcaagctccgcctcccaggttcacgccattctcctgcctcagcctcccctgtagctgggactacaggtgcctgccaccatgcccggctaatttattgtatttttagtagagacaggatttcaccgtgtcggccaggatggtctccatctcctgacctcgtgattcgcccgtctcggcctcccaaagtgctgggactacaggcatgagccaccgcgcctgggcagaaggtagcattctttccagccattctatgcagctctcccttggtttcccctgccaagtgcaaagagacacaggatctccatgcatgaggaaaaccccaggcccttgtttgctctgttctgcttcctgagctggcatttctcagtctgttcttttttactcatcaacaaaagtattcgagccaaattctcttgtaatttcagcccaggtgtgatcaacatcaagttacctttccatttggcccaagaagaagttataacttccttgcataagctcatctgttatcttaatcctttctggaacagggaaaatgtaaataagtattactctatccctctcttaagtttttcaaattacagcaggtggttgggaaaaggggagggcagaacagtggaaaagcattttttattctacttccattgctaactttgtagtagttaacagatcgatttagaaaatagtgggttactaagataagggtgaccaccctttactaacactaaaaagaaaaaaaaaaagctataaccaagtgtctgccatcaccattatagtgtaaaagaaaaaaaaaacaaaaacaaaaaacaaggccaggcatggtggctcatgcctgtaatcccagcactttgggagaccaaggtcagcggatcacctgaggtcaggagttcgagaccagcctggccaacagggagaaacccccatctctactaaaaatataaaaattagccgggcatggtggtgcatgcctgtaatcccagctcctcaggaggctgaggtaggagaatcgcttgaatccaggaggcagaagttgcagtgggctgagattgtgccactgtactccagcctgggtgacagagtgagactctgtctcaaaaaaaaaaaaaaaaaaaaagttgcaatgacaaattctcagtggggagaaagggcagatcttcctaggaaaagagagttggcattctcatcctgatgtttgccccctggactaatgaaaaacctcattcatgaccacagtctgtatttgagaagctctgtcctacctggtgcttgggttcttaacactcacagacttcctgggtaggaagtggcgctttgaatggagacatgagagctgcctgtgcaggtcagctctttcctttgccgcagtctctttctctgctatcttgctatgatttagtccttaactttttccttttgtctttccccataggcaagaagcgaaaccctggccttaaaattccaaaagaagcatttgaacaacctcagaccagttccacgtaagttgacaagaccatcatctgaatccaaatccttgtgctttcagattcctcctgggggtttatttttggactgctgagcaatgccttgactttagaagagccctttaagggggaagccatttgctcactgttctgagacctgaaataatcatcttatcagtcagttacgttgaatgggtagttttgaactcagtgtcttaagttattggttgagtaggaagtgaatgtcacatatatttggcagatggggctctatgtaaggccagaaaggcccctggatgtgaacttccttgccttttccctgtagattggagcaaacaggcaaatccctgtgaaagccactactataaaacttgggttgagatggaaagatggtatttggtgaggacccacatcctgacacttaaattctgtcccatataaacagaaggaagaatgaggtaaaggaacactttttttttattagctgaggttttggcccaaatccctaagtcagctcaagtcctagtgaaggacatcgtgtaaatgacatcctctctgtgaggatgtctccttcttgttttttttttttttatttttattttttatctgtctctgtgtggtgggaacggtacttcctgtccagctggaggtacaaccacctaccaaggcatctgcatgagaggaatggaaattccaaggaaactcacaatagaggtgttagagagacagggcaagggcaaagagagggcatcctaatggaaaagtgagttggtaaggcttttgttcatgtctacaaaagtgcctccctttgtgatgggttttgatcttagctatgatctgctatcaggaagtgcacccctagtgttggaatgtgttcttaaatgggatcatgtctgctgtaagactttgttaaagccactggtccttgcattgcgtgaagcagtatacagacactttccactggagaatttttaaggacaaagtagagttgagggctactcttcagggttctggactgtagctcaagagtctaaactcaagatagaatgttcctttcattagaatctgcaggaggaagatccgtcttcccatacttgctgtcaagattgttttctttttctcttttttttttctttttttttcggtctctctgagcaatttctttttctcgtagacctgtgaactgtgtaattactattgtttcctctctgactggtttctcaagagcttacagtcaaatatgtggcctacttttactacctgtataggaatttatgggatatacttttaaaactttttattttgaaataattgtagattaacaggaggttgcaaagaaacgtacagggaagtcccatagatccctttccccaggccatgccaaactcccccgccatcccaagttaacatcttacacaactataatacattatcaagatcaagaatgtggcagtagtgcaaatcatagaacttaattttgccagctatgcaagtattcctttgtgtgtgtgtgtgtgtgtgtgtgcacgtgtagctctataaagtttatcacattgtgtaagtcttgcataagtactattataatcaagatacttcactacagcaacattacaagactcttttatgctcccctcttataatcaaacccacctcttctccccatctccgtccttaatccccagcaaccgctaatctgttctcctttgccattttgttatttcatgattgttatataaacaaaatcatgcatctctttttgagatttttttttgttcaatgtaattttattgaggttcatgtaaataattgcatgtattgatagtttgttccattttattgctaagtacccatccatggtatggttataccacagttggttcaacaccttagcctttgaaggagatatgggtagttttccatttttggctattatgaataaagctgttatgagcatttatgcataagttcctgcatgagaataggtcttcatttctctggggtgtaagcccaatagtgcaattgctgggttatatggtaagcccatctttagttttgaaagaactgctgaactattggccagagtaattgtaccattttatgttctcagcaataatgtccgaataatctagtttttctggatctctgccagcaattggtattatcagtgtttttcattttagctattctgatgtgtagtgatatatatgtagttttttttttttttttttttttttttttgagacggagtttcgctcttgttgcccaggctgcagtgcaatggcgtgatctcggctcactgcaacctctgccccctggtttcaggtgattctcctgcctcagcttccccagtagctgggattataggcgcctgccaccatgcccagctgattttttttttttctttttttggtagagacggggtttcaccatattggccaggctggtctgctggtctcgaactcctgatcttagatgatccacctgccttggcctcccaaagtgctgggattataggcgtgagccactgtgcccagcctatatgtagttttaatttacaatttctctagtggctaataatgtagaatatgtttttaggtgtttattttccatctatatatttttggtgaaatgtctgtgcatatcttttgcccattgtctaattagatactttttattgtttacttttgagagttatttgtatattctggacacgaggactttgtccgatatatatgtgatatgaaaatatttttcccagtttgtaatttgtctttttatgcttttagcagggtctttcacagagcaaaagtttgttcaacttatcaattattacttttacagatcatgcttttgataataagtctaagaaccctttgcctagtcctagatctgtctagaagttttgtagttttgcattttgcatttaagcccatggtccattttgagttaatttttgttcaaggtatgagtttaggttgagctttatttttttggccagtgggttaccaattattctagcaccatttgttgaaaaggctatccctcctccattgaattgcttctgctcctttgtcaataccaattgggcatatttgtttgaagttatttccgcattgtttattctgttccactgatttatttgtctctccctctgccagtatgacattgtcttgattaccacagctgtagagtaagtcataacagggaaacatgattcctctcactctgttctctttcagaactatgttgactattctaaaggcctttctcttttcatataagttttagaataagcttatctatgtccacagagaaacttactgagattttagtaggaattgtgtttaagctatagatcaatttagggcaaattgacatttttactacattggttcttccaatctgcaaacatggtatatttcttcaactttaaaaattttatttctttcatcagcatttttataatacaattcctctatattagattttgttaaaatttatacctaagttttttttggagcaaattttaagtggaatttgatttgtgaacttggttttcacttgttcattgtcagtatatagaaatgcaatagattttttctgtattgatcttgaattctgtggattctgcaattgatcttctattctgtgactttactaaaatcacttattagttctagaagcttgtcatcgaatcgttagggttttctatataaacagtcatggcatctgtaaatggagactgttttattttttcttttccaatctttactttgatttttactttcattttcttgccttattgaagtggcaagaatgtccagtcctaggttaataaagttcatgagagcaggcaaacttgctttgttcctcatcttagagggaaagcatttagtctttcactattaagtatgaagcgaactgtaggttttttgtagatgttacttatgaggttgaaaaggttcccaactatataaaacctctcagtatactgagaggttctttttgattgtttgtttttgtttttttgagacagggtctcactctgtcacccaggctggagtgcagaggtgtgatcatggctcactgcagtctcagcctcccctggctcaagtgatcctcccatctcagcctccaaagtaggtggaactacaggtacatgccaccacacgcggctaatttttttttgtgttttgtagagacggggttttgccatgttgcccaggctggtcttgaactcatgggctcaagcaatttgcctgccttggccctcccaaagtgctgggattacaggcgcgagccaacgtgccctgcctgagaacttttattatgaatgggtattgaatcttgttgaatgctttctctgcatcaattgatatgatcataagatttttcttctttgatctgtcgatatgtagattatgttgattcatttttatgtactcagctagctttgcataccccaaatgaatcccagttagttatggtatatatatttttgtgcattgttggattcgatttgctaaaattttgttgaggatttttgtttctaggcttttgggagatgttggtctgtggtggtttatttattatttctcttgtgctattattttctagttttagtattaaggtaataatggcttaataaaaatgaattggtaagtgttgcttctattttttggtagacattgtataatattggtgctaattatttggatgtttgctaaaattctccaatgaaagaaaatgagcctggattttttttttctgggactttttaatcacaatctcaatttctttagtagttataggactattcagattatctgtttcatcatggctgagttttggtagtatgtggttttgaggagttggtccatttcttccaagttgtcacatttatgagagtaaaattgttcatagtgtttcctgcctatcctttaaatggctgcacaatctgttgtgacatcctttttttttttccctgatactgataatttgtgtcttcttttgttaaatttgtcaattttgcttgaggtttatcaactttattgattttttttcttctgaagaaccagctttgttttattttcctattttcaattttattgctttctgcttttatttttgctatttcctttgggatttattcttacatcaacctgccaggagtcttacatcccttccccttacaatttttattctttaccttttatattagtttacattatagcataaattatatgttaattttataaattttatgaatttcggaaggctaccataaaccctttcttggtataaacaaggataaaagcagtttatattttccctcgtatggtattaataaggtatactgtgaatatacttatctgtttcactgtgtgaagcaaaaagtatcacttcattattgtagagtataccgctgtagctcaaagagtctcgttgttattactttaatgccaaggcttaaatttgtactcctaaagaagtagctcccacattttgtgtttttcttggcaatttttgaaggctggcttggtgatttcttcccattcataccctgcctccttctgctgcgcttcacaaaaataaataggccttgacaaagctccattctcccgagttcaatgtgtgtggcccctctgtttgagctctttctttgagctaccgatgccagtgtgagctgtcccttcccttgattgatagtgaccaattctaaatcagttcgatgctagttcatattatttcatttaaccaccacaagaaactcagaggcagtgtttgttactctcacttgacatgtgaacaaacagaacgatgcaacggtcaggtgcattgctccaagctgttgagcatagcttcatgggtaagagttcagggtctggagccagaacacttaggtttatatttgggatctaaacttcactagttgaatatcttaggcaaaatacctaactgcgctaagccttagtttccttttctaaaaatacaaaaaattagctgggcgtggtggcgggcacctgtaatcccagcttcttgggaggctgagacaggagaagcgcttgaacccaggagggagaggttgcaatgagccgagatcgtgccattgcactccagcctagatgacagagtgagactccatctcaaaaaacaaacaaacaaaactcaggaataacagtgatgttgctgtcatgaggattagatgtcataatccatatgagtgtctagtgtagtgcctggtgcattgcaattgctcaatgaaaggtaactccaagttagtattatcacacagcttctcggtggaagaactggcatataagctcaggaatctctgactctcaattatgtactcttagccacacatcagactggtagaggctgtgagcaaacagtttatggctagtgaaatgagaggtagtatcctttacagcatactgtgcatgagaagccataatggtgcagctctgggttctaatctcattgtctttctaagtgttttttttttgttttttttttttttttttgagacagagtctcactgtgttgcccaggctggagtgcagtggtatgatcttggctcaccacaacctccgcctcttgggtccaagcgattctcctgcctcagcctcccaagtagctgggactacaggcacccgccaccatgcccagctaagtttgtatttttagtagagacggggtttcactatgttggccaggctggtctcgaactcctgatgtcgtgatccacctgcctcagcctcccgaagtgttgggattacaggcgtgagccactgcgcccggcctgagtgttcttaaattatttagtcactttcaatattaattgttgaaagaggtattaatgaggtattataccttgatttcaattcataccctattctatttcaatagaggtaataacacctctgagagttgtaaaaattaaggaagctattttatgtaaatggtctcacgcagtctcttgcccaaataggtgcttaataaatatttctgaatcaatgaatagtgattgcgatagtaaccagtgaactgattcctcatgtaaaattataaatgaataattatcatactaaaccgaagctggttgttcatataaaaaaatgaatactaggtgacctttggaagacctttggtcttccaggggaagaatttttgtaataagcttggttctttccccagaggactaaaatattgaaaaagtgacagagaacatccacccacagtataaacttcctgcagaatcgcaatgcccctggcaaactaatatgcccagccctggagagaacacagtgtcaactaatccaatctgatttgtcagtcttggccccatcatttgatatttttggcccacttgatgagcccaagggcctgcggcacaggcgaattgattattttcattagaggaggcctgggtattgggagcaagttccttgtattcagtctgcctcgatgggaatcgcaagagcaggtaaaaagctcttagcccagttttttatatttccttctcttcttcctctttctcctccttaaatcaaggctgagattcgggtgacttgagttttattttcagctccgttgatgaccgtatggcttcagaaaatcacccagcttttctgggtttcatttttctcaatctggaaaatggcaccagacccttctattaggttcaggggtaatgcaaagttagtatagggccaaggtcagcaaacttttttgtaaaaggccggatactaaatattttaggctacatgggccacagaggatgccgttgtttattttttgtttttttacaagcatttaaatttggaaaagtcattcttagctggaccacaggctgtaatttgctgagccctggtatatatataaaatataagaatattagacttggaagaactcatttttcgataacctcattggatggcaaaaaaacagttgcagccccaaataattagtgacctttctgttgcttcatatttttaaaaagtcaggatggtgggtgacgcctgtaactccagcactttgggaggccatggcaagcggatcacttgaggtcaggagtttgagaccagcctggccaacatggcaaaacactgtctctactacaactacaacgattagccaggtgtggtgcctgtaatcccagctacttgggaggctgaggcaggagaattgcttgaacccggtaaggcagaggttgcagtgagccgagatcgtgccactgcactccagcctgggcgacagggtgagactctgtcttaaaaaaaaaaaaaaaaatcagggtgttgaataattgcaaaggatttttgttgtttatattagtcacatgtttcaagtcatatttgcctttatttcaaagtgccattacaaattagtacaagcaaattttgacaactgaggaaaaatagctttggaaatcttgagaaagaggaattagaattttagaaatttgattcttccagaaaccttttctgaagaaaaattccctgctcagaaacacaagatatataaacacatcactgctgtttgtggggcatgtgtgtgtgttttgttttgcattgtttttttctctctctccctctcagtccccagttttaagttagtataagaaactttaagtattctatgtattccaaaaggattttgaggtgagagaaggcttgccattaaaatcttagagtcatgtttatatctgtatttgtatttctctttttttttgttttgttttttgagactgagtctcgctcttgtcacccaggctggagcgcagtggcacgatcttggctcacttcaacctctgcctcctgggttcaagcgattctcctgcctcagcctcccgaatagctgggattacaggtgtccgccaccacgcccggctaatttttgtatttttagtagagatgaggtttcaccatgttggccaggctggtttcaaactcctgacctcaggtgatccgcccacctcagcctcccaaagtgctgggattacaggcgtgagccactgcgcctccgcccatattcctactttttaattttatttatgtattcaatttcagcaaaagggttagaatcataatacctgagagttagaaaaaatcctcattggcaaaggtttcttttctctctcactttcatctttccattttcctttgcctttttctggcatggaatgtgcttccagagagacatgagtctttacctgtctgctcaccctctttccctcttttctggcagcaccaggattctttcgtctttagcctctagttgttctttttgtttgatcacattaacaatttgtttctcgaaatttgcttttttttttttttaatacagagtctcactctgtcacccaggctggagtgtaatggcacaatctcggctcactgcaacctccgccttccgggttcaagcgattctcctgcctcagcctaccaagtagctgggattacaggcatgcgccacaatgcccggctaatttttgtgtttttagtagagatggggtttcaccacgttggccaggctggtctcgaactcctgacctcaggtgatccgcctgcctcagcctcccaaagtgctgggattacagctgtgagccaccgtgcccggccagcatttgctatgtttattgtactactgttggtacatttctttcaggaaaatgcctttctcagctcctagttgtgtgcacagccagagccaaacatttttctcttaagtagattgataccacctgagagatcattgaagtggtagaaataaatactcaggaagtgactatagaaacaaaatcagcaaacctctggctcttaagaagaccccagaattgtatatgtgctgtgcacagaagaaatattgctgggcttgataagacagcctggtagagtagagaggatgcagaactggatatcaggagacctggggcagctgtgggctgggaggagtcactttacttctctggaccttctgtccatctataaaagaagggacgagatttgaaattcttatgttctatgaattttgtgagttaacagaatatatgccattactatttgtttcttaaaacaattgtgagacatgtggtgaaataattacatatattggtgctcttgggtgaaagaaaaagcttgagacttactgctgtagcacaatgacctatatcagcggtccccaacctttttggcaccagggactggttttttgaaagacagtttttccatgaactgggtggggggatgatttcgggatgattcaagcacattacatttattgtgcactttattattattacattgtaatacatcatgaaataattatacaactcaccataatgtagaatcaatgggagccttgagcttgttatcctgcaactagatggtcccatctgggggtgatgggagacagcaacagatcatcaggcattagattctcataaggagtgcacaacatatatcccttgtatacacagttcacagtagggtttgtgctcctatgagaatctaatgccactgctgatctgacaggagatggagctcaagtggtaatgtgagcgatggggagctactgtaagtacaggtgaagcttctctccttcacccaccactcatctcctgctgactggtattagtccatggcttgggggttgggcaccctaatctatataatagcacatgtatagctcatacgaattagatatttactgtatgccagacattcagctaagcattttacttgtattgtctcttttaatactcactcctgcttcacaatataggtatattaatatccccatgttaaagaagaaagggagccccaaagagattaagtgatttaaacccaaatgtgatttatttcaaatcccctcttattcacactcataggctgctttagtttactcatgaacttccactttcttcttaaggaaaaaatatcctcagtggtgtgtgatttgggaaggacataattgactcaatagcttatgtttcttcttttcccccttatctttcttagaccacctcgagatttagactccaaggcttgcatttctattggaaatcaggtaagaaaaaatcatgtctgccacctaatacgttggccattttatatgtatgctttctgactgaaaaatttattttccctagcatgctgtcaggggatgagtcaaaaaaagtttgcatttaaagggaagtggtatgcaaagtttttgctattttgaaagaatgttgaattgaaatcaggctattgtggttttgatggaaggtatttgaatagagtagatggttctcttgggagggcatttctcaaagctcagacataatctagttgccatcagtcaatagtgggttacagacacaatgaagggtcatggctaaagaacttcagtgaaatagcttcaactgagacattggcaagctgagtccaagttgggtttctgtgttgcctgggacaagcaggtgggctaccgtgggagctcctagacatctcttggcccttcttgtagcttcttgctttcagaggctgctttgacatgctagaaaatcttctggcccagaaataatccttagaacattgagagaaacgagatagaggataatgtgctctctgttctgtttatttttctctttcccattgcattattccttttctctcttgcagaactttgaggtgaaggcagatgacctggagcctataatggaactgggacgaggtgcgtacggggtggtggagaagatgcggcacgtgcccagcgggcagatcatggcagtgaaggtagagttgacattctcccaaatgttttatatctgctgtgtatacatttgtccacctcaattgtcaaccagcccttttaatagaagcaaaaccatcttccgtagggtaaaacagaaaagattatttgcagggaacagtattttcctccaaaggtatggaaaagtcttccttggtgtgagttgtatctactttttatttgtttttttaactcttaactctccctccacccattcttctaccatttttaatttttacaaaactaccatgtcatcatcacacttaaaaataattaatggcccaggtgtggtggctcacgcctgtaatcctagcagtttgggaggccaaggcgggtggatcacgaggtcaggagttcgagaccagcctggccaacatagtgaaacctcgtctctactaaaaatacaaaaaattagccaggcatggtggcacacacctgtagtcgcagctacttgggaggttgaggcaggagaatcacttgaacccgggaggtggaggttgtggtgagccgagatcgtgccactgcactccggcctggacaacagagtgagactccatctcaaataatattaataataataataataataataatgatacttccttcatctaatccggagtccaaatgaaaatttccttgatcatctcaaagtgtgtgtgtttgttttgtcctgttggattttcaaatcagcatcccaatgaaagtttacgtattgcatttggctgttatgactcatagatctcttttattctatattttgttgcttttaaagaattgcctctgaaaatcaagaaaccagaattgggagagaaaattgtctccatttgtggaaaaaggagggtaaaatatatctagagtaaatttgcatagtttttgagctatgaaaggaaatttaaaatcatttcatattattgagtaggtgttcggaggatcataaagaattaacatctctagctgagttaatagattggggctattgttaggaataatcaggtgacttggatccttttgcttttaaagaatgggaatacttttatcttgtagatttttcagtctgttcttctgctgacttgctaagtaggcaaaaagtgtgaagtcccagtgatattgtatctctcctatcatttaatgacataatcatgtttctgtaaggctacatttcctagtgtgacagattgttcttccctcagaagcactgggataggaatgaacagtttctctatttctctaattgcttctattttgtatagctgtaccaattctcttacagttgctgttccctccaaatactcttacatgttcccaaagaagagcttttggctttttattttcttgggaccccagataagcagcaaagtccttaatattgtgccctctttgcactgaacagacataatacagtaaaccagattgttttcataccttggaaatacattccaaaacattttgtcactctccaaaacacactatcaatttgtttcttaccaggactattcaggaaatcaaatgagtaacagccttccttattttcatgtgttacaaatagctaatcactttgggtggctattcacaatgtcatcgccagaacttgtgtcatgaactattttcacgatgggactccttcaggtccctgcctgcctcatcctcagagtagtaaccataaattttccatgcatttccattcagcggatccgagccacagtaaatagccaggaacagaaacggctactgatggatttggatatttccatgaggacggtggactgtccattcactgtcaccttttatggcgcactgtttcgggaggtaggtgacccttcaattcaaagtccaagaggaacaataacttaaaaagaagtttctttgatcacgtaaatgccttcacaatcatggagctctttcttgtttgacacatcttgtatacgggggtttacgtgtgtgcaatgatgacatgccctggagcaaggttggattgaaattatggtattttcaaatgtggttagcctttttaagatgtggagtttctcgtctcctttcttttttgttttgtttatcttggcagaactttctatatcgcctatagactgatttgcttagatctcttataatttgaaatattctggtcttttgactgctttaggagcttcatctagcctacttgtgtactatatagacttactttgatctcttttctctacctctgttttccactttagcgttatatggattatgaggcttcacctcattaaaaccagctttttgactgactgttgctggtatttagtgtgagagatacgacatggaggaggcatctagacctaactcctagacagtggtatcagtaaaggcctggatatctggggttgtattgcttatgtctgttagtaattagattccatttttcattaaggggtaggagagcacatgcaggttctgcttggctacctactggtttgctctttgtagataaccttgcttatttgtaaattcctttatgatcttgacagaagacactgtatttccccccaaaattcaagaaagaaatagttaattcttcaggatagggtttactgttttttttttttatttttatttctccctttttcatccttttaaacaattcctgaaacaattggtctccagggtgatgtgtggatctgcatggagctcatggatacatcactagataaattctacaaacaagttattgataaaggccagacaattccagaggacatcttagggaaaatagcagtttctgtgagtacattttgatccctactgcaaggataatgtgagaaataaagtccctatgtgtctttggacctcagtatgaagaaatactacctgggccacagctactattcgtacatgtctgttgacatttattggtggatggataaatacatgctttcctttctgagcactgtgtagaagattctagcactgctttggtttggcagactctaggttaaatgactctaagtgctgcattcatcagctatgaccacattcctggtgtctatattctgacattagtttattttgattttcatttatggatttttaaaatgttctcttgagactagtaggcatagaagaaagcagaaggaaaataaatagaaagaaggtcttctaccttcatggctattcaggctcaggagggtggagagaaaaagaaggaggacaaatgaacaagacagatgagggagacatcctctctgatataagatacagtcctctctggtggatggagtccaatttgtgtaacttcctatgtattttcctagataggaccaccactatttgagaaaatatctcactggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttgttagcaagcagagctatgagatcatatcattgagaattttagagaatatgataaaaattgatcttgtactggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccctgagaggtatctgagaagaaaatatattctgattaaattatgcatcaggattcttatagggaagtaagataaatgtacaaaaaaaaaaaaaaaaaaaaaaaaaaaccaccttagaaatatgaaagtaccaagctgggtgccgtggttcatgcctacaatcccagcactttgggaggccgaggagggcggatcacctaaggtcaggaatttgagaccagcctgcccaacatggtgaaaccccgtgtctactgaaaatacaaaaattagttaggtgtggtggtgggtgtctgtaatcccagctacttgggaggctgaggcaggtgattgtagtgattgtggtgattgtagtcagggaaacttctgggaagagataaccagaaccctgtctttgggaagaataatggaatgtattggtaagtaagagggccttgtggtttggataattcttaaactctctgagcctggaaataatgtaaaatgccttccacagtgtgcctattattgttagttgttattattaaaaattggaaaaataggatgaaggaagatgagaagaaaataggaaggaatacagataggaaaaagactgtagattattcacaactttgaaattaacattaagggttatttcaccattatgaaatatgtaattcatattagagaaaatatgtaaggtataaaaataataaaatgaaatttgtgtatcttctagcttaaagggaaaattataaaggataatttttaaagcttttgtaataatcttttacttccaattttatgggtgttatgaaaagtatcacaaagggaaaaattagctgtaatttcaaatgttattatccagagataatcgtagttccattttttgggcatatgggcgggtgggttaaatttttctagtcaaaaggattcgtttaaaatctggtctgtaatactgcttcttcagtaacctgccctgtggtctggaatacctgggtttatgatcctttacactatgtgacctctgacacatcgctagcagaggtttcaatcaaaatctgttgctttgggccaggcttggtggctcacacctgtaatcacagccctttgggaggtggggtgggaggactgcttgaggccaggagtttgagaccagcctggtcaacaaagagacatcctgtctgtcaaaaaaaaaaaaaaaaaaaagttagctgggcatggtggttcccacctgtagtccaagctactcaggagactgaggcgggaggatgatttgagcccaggagtttgaggctgcagtgagctatgatcacaccactgcacaccggttgagtgacagagtaagaccttatcttgaagaaaaaaccaaaccaaacaaaaacaaaggttgctttggtcatatttggtgtatcattgtgtcacagtctgcctttttgttctttgttttattactcctacgttaaatatcaatagatcattttgaattggacatttgattcagtaataattttttaggctcttactacaagtatgagggtaatgaagatcataaaatcagtggagaaaacagttctttgtatggagaaattcacaattctacaaggcatgaacaaaacatgaaatagaaaatcaagttgaaagcaataagctgttgttaactgtgggtcagggatggcagttacttctgtgttgggcaacttggggaaaggaagatgaaggacaaatggagattttaggccctctggtggcagagaaatgaaccttgaaagcaggctgaaatgatggcatcctggttgttttcgctttcagacgtcaagccttctaatgtactcatcaatgctctcggtcaagtgaagatgtgcgattttggaatcagtggctacttggtggactctgttgctaaaacaattgatgcaggttgcaaaccatacatggccgtaagtacattagctagggtggcatctggtaatgtcactgccgacaaatcatgctgggaaacaagaaatggatggccacagagggaaaatggaaatgtacctaagactccagaagtagtctgcctcttagtatttcttcaaaattttatgtctgaaatctttactcacttgcttcatatattgtcttagtttgttcaggctgctatggcaaagtaatgtaagccaggcagcatataaacaacagaaatttatttctcacagttttggaggctaggaaatccaagatgaaggcaccagaagatttggtgtccaatgagggctcacgtttctcaggatcatacatagcaccttcctgcttagtcctcgcacggtgaaaggggcgagggatctctctagggcttttttaataagggccccaatcctattcattagtattccactttcatgattcaatcaccccccaaaggccctgccttctgatgccaccacatgtgcgattaggttttaacctgtggattttggtggggcacagacatagttatatatatattactttaaaaaaatcaagtgaaagagatacgttatttgaaaaaatatatacacaatacatatagcctgcacagttttccacactgtattgcaggggagtattaccttgtttgttgaggacaaaatagtaaatagagcttaaattacccaaacaaggcagttagattagttatgagaggacctcacagctgtgaagattcaccgtcattagcagagaccttgcaatcccctttaactggaggaacggccactagattctacctggaaatggacttgtgctttgaattgaaaagcttcctgtctgtgtttagctaaaaattgctcaggtctattagcatgggacagtagcccagtgacacttgttttattgagttctggactgttcatgttttaaacaaggataattctagatgggcaaagtagctttataatgtataccctgtttcttcttaaggcaaattttaaatttgttatgaaaggaacttgatccattactgtgtccaagaaaagacaaacacagaagaagggaaaccccacggaggcattgatatttgttgtagttaaccgggtcttcttggccttggtggcatgttaacagcttataacaactcacttggcagctggtgctacccccatccccagagactattgagctaagaacgttatctcaattgtcttcccagtttctcagttgtctgtcttctttccagcctgaaagaataaacccagagctcaaccagaagggatacagtgtgaagtctgacatttggagtctgggcatcacgatggtagtgtatgccaatcatcatgaactatgaggttgtgggtaatgaaactagaatgaggtggacgttgggttcaagaaacaaatgccctaaatgctggtttggggcgccctctcctgctgagatggtaggagattttgagtaataattgtttgtattgtggtacaataaaaacactgatatgggattggggaaaccaatctttctcttgattccacctctgacgagctgtatgcctttttgagtaattgttacagtcacatggactatcttcctatcctcctctgtaaaacgagaggatctgaccagattccttatagtttaaaattaaattattcgagccaaggcaagaagcttaagctgtgcaaagaatgctaatgtgcgtgaaccctgatagggccgtgttatccaggacatagactatgcttcccaggatatttttattggagaagtagaagtcaaagtctgatcaggtcagtgtattagttcgttttcacactgctgataaaagcatccccaagactgagtaatttaaaagaaaaagaggtttaatggactcacagttccatgcagctggggaggcctcacgatcatggcggaaggtgaaaggcacatcttatatggcggcagacaagagagaatgagatgagacagccaagtgaaaagggagatgcttcataaaaccatcagatctcgtgagactttttcactaccatgagaaccatagaacagtatgggggaaccacccccatgattcaattgtttcccactgggtccctcccacaacatgtaggaattatgggagctacaattcaagatgagatttgggtggggacacagcccaaccatatcagtcaggtatatcctcaatacatgataaccaataggatgatttccttagacacagccctaaagttatatgatttattcataacttattcataactttggtgattgtaaatttcataactttggtggtcatacattttcagtggatcaccaaggtctggaattatccactgtggtcctggctcctccccaggcacagcagctgaataaatcccatgagttatttctcctgcctgcccagaaagcacatgatcctgtaatgcaaagtggccttttctcaagtccaaaaaaagatctgtcatttggttctaggttgctttttctccctgtcatttcaccaagggacctgaaggtggcagtagatgctcggctctggaaagatcttaggctgggaattacttgtcagagcaaacgtttgaaatcctcgtagctttacatcctgaagtttaatacggttggcttacaatttttatgaagtgccacagtgggttttagtgagggtccccattttagataggcttaagtggctgtgtctagtaagtaatatttaaaaatccctagcactaggaatttggggaaaattgctagagaacaaattattagtttatttcctgcccccctacccctggacttatacttgaactttgccttgtgtttcctgctgtctatccacaaatgaaacgtgggtgattccctaaagcagccctgttgaaactgttgtctccttttttcttcttttctccagattgagttggccatccttcgatttccctatgattcatggggaactccatttcagcagctcaaacaggtggtagaggagccatcgccacaactcccagcagacaagttctctgcagagtttgttgactttacctcacagtggtaagacagcctcacctcccaagtgtcagtgtgaaagaagaagatgagttctcatgaatttcttccattggggttgaatccatcatgcatacattcattccgaaagcatttgtggagtatgccctctctgctggagaagcaaagatgaccgtatcacactccctgccctcactgggcccaaagtcaagtagagaagtctcataaatgaataattatagtataatgtggcaagtccagtgatagagataggggcataggcgatttaaggaactcagagggaagacctcaggataggcttttctggaggagataaatctggagctgcgatcacgagaggaattttccagacaaaagggaaataggaaaggaaacatattccaaacagaaggaacatcattcacaatgtcacaaaagcaagaaactcctttatgtgagctttaagcaatttgatgttgattaaagcataaagagaaagctgataggacccactagaggcctggggataggaagtagaggcaaagaattactttcggtgagaagatagtgggtagtttgagagtgtttcttaggtccccagaagtcttgtagaaccttggttgctactgaatacttgctaactgtggagaaacttgcccaccataagagacaatgctgaagttctgggaagggaatccaaaggaagttggggtggaaagtgggagggagccatactcatgaggtgaactatattttcatgaaaactgccagggcagtcaagaaaagcaagaggggaaagtattctctagacaatccagtaatttctatctgcatagaggtcatgatgcctagcatggcttgatagtaatgatcatggcaagtgatgctggaagcaggatgccagaagtgaagcacacccctgagccaggttagcgtatttggccatccgggagaagtagatgagaattaggaggaagggggctcggagatggtggcaggcccagctgtgaccctgggaggggagccgttctgagtactcactgctggggaagggcctggagctctgaaggctgtttgaggtactgaggaagctgaaggaacatcttccccgtggcttcattcctcagcctccatgctttttagaagtgctgtgaggcagggcacccgcgcctgtaatcccagtactttgggaggccaaggcgagtggatcacctgaggtcaggagttcaagaccagcctggccaaaatggtgaaaacctgactctattaaaaatacaaaaaattaactgggcatggtggtggacagctgtaatctcgggaggctgaggcaggagaaccgcttgaacctgggaagtggaggctgcagtgagctgagatcacgccattgcactccagcctgagcaacaagaataaaacttcgtctcaaaaaaaaaaaaaaaaaaaaaaagctgtgaatacagcattcatcaggaaacatggaagaaacataaaacaaagcaactgtctgttgcttgtgaacctaagagctcttcgactctttgttagccctaggccccttctcattcctggtacttttccctgatgatgtatgaggctggtctgcagttgtttgtttttgtttttggctggatgactagagaggggctggagcctcgagcactagtgtaatagttgttggatgcctcttaaaagatatatcttctaggctgcttcctgtctgttttccttgagggagtgtgctggatgtggtagtacctctgccaggttgacctgggttcatgattttgccttctggattcaaagacttgttttttgtggatggttggttggttggttatttatttatttattgccttatcctcagatgtttaaggtcacatcaaaaaaagggatgaggggccgggcgtggtggctcacacctgtaattccagcactttgggaggccaaggtgggcagatcacttgaggtcaggagttcgagaccagcctgaccaacatggtgaaaacccatctctgctaaaaaaacaaaaattagccaagtgtggtagcacacacctgtagtcccagctactcgggagattgatgcaggataattgcttgaacctagaaggcagaggttgcagtgagctgagattgcaccactgcactccagcctgggtgataagagagagacgccatctcaaaaaaaaaaaaaaaaaaaaaaaagagatgaggcatcttgggtagtacagaacagtagttctcaagaggggtggtaatggggaatgatcttatctagctaagtctcttcaaattattctccctattacctttctcccacctatccccttttcccaagattctgggtgctttaggaaattttggtaagaacgaggctggtgtgaaaagtttgagaaagctgagtctaccattgtgaatcaccagtttaatccaatgattctcaactgtggctgctcatttataaaactctagtgagctttcaaaatcactgccccctagacctcatcctcatagactctgatttaactgatctggggaggggccaagatactaatatatttttaaatgttctcaagtcatttttatgtacagctgcggtgataaccccaggtttagacatatgatctatggacctgccatcaactagtttctgtttagaaggtttattttcttcaatttgtttaaaaaaaatcatccaattgcttgaattttctttcaccagtgtattttttctcttactggaattttctccgaagaatcagagcattgaaactttttagagatattttaaaatgaacatcttgagaaataaatggtttttaatttttttttttttttttttttttggagacggagttttgctctgccacccaggctggagtgcagtggcacgatctcagctcactgcaagctccgcctcctgggttcacgccattctcctgcctcagcctcctgagtagctgggactacaggtgcccgccaccacgcccggctaattttttgtatttttagtaaagacggggtttcaccgtgttaaccaggatggtctcgatctcctgacctcgtgatctgccccgcctcagcctcccaaagtgctaggattacaggcttgagccactgcgtccggccaatttttctaattttaatgtatgcacacatatatggaagttccagataccggcatcattgctcttcatataatgactgccctgtgccttctctctccttataacacccatagtgccttcatggctgcctgcaaagatatccccttctctctcattttcttttaattttaatcccagctaccacagttcattaattaaaaaattttgagccgtagacatgtctcagctttcctgaaactgttaattctattaatactgtttgctcggtgtcatgtcatttctactcaagtaagtcagtttgtcttatatctgggtatattaaaaacaataccctgtctctacaaaaaatacacaaattagctgggtgtggtggtgtgcacctggggacccagctacttggaaggccaaggtgggaggatcgcttgagcttggaaggctgaggctgcagtgagccataattgtcccactgcactccagcctgggtgacagagcaagatcctgccaaaataagataaaattaaataaataacaaaatgcaatataaaataaaataaaatatgaaactatctagaaacaaaacccaaatcactttaccctagaagtcattaaaagataaattttccttcctcaaagtgtcagtattatagttctggtagaatgctgtacttaagaatatcagttgtctaaaatagtcattttgttggtatgggaattaagaaatagaagggaatcgttaattctgaattttatgagcattcttacttatcctcagtttgactttttcagcatgcaagctctcctatttcagatcccaggtcaataactttttttccctgccacaaaccaccaatatattttctttgatatcccttaagtatgaacattatttttcaactgggttgaaaaagtcatcttatactcaaaaagtagcactgattttcttttagagtttatgactggcctagaactttacggaagcaattttatttttcatacatatattaatatatgggtacatacctccagccattagccatctagtgattttacttgtttgattactgaaagcttgaggtttgatctggagcttggtggaaagaatggaaaagtgataatgttaacagaagagtacctcttctacctcttcatgaacattccctgtgcacgtaactcccctttatcagctattcttttatttttctcatgaataaagctgtgttattgagacataacttcattaaaggacctttttttttttcgtgagctccatgttttttatatttttattatgtaggctatggtcctcccagacttctcagaaaggccgctctatgtgctaagtggggaagggagactacggatttcaaaagtgaaatatttaatctcaaatttcaagatagatacatctatgtttttattgcctacatctgtctttggtatgcagaaaaagaacccattatacccgcagcctaggtaactgtcagagtatttgtgaacttgtgtatcctacctaagcatccgatgtcacaaagctactaggtatcatacacctgcctaggtatcatacccgtgccaaggaatcaacttggcacgatgccatcaccatgttgcaaggtaccataattctgtatccagggaattgatttggtagccactcttgtctggcccatcagtactgatcactgcttgttagttgacagtaaatcacttagtttgtagggtgaagtagaaaagctctaacaggctatcatcaccacacccaaagttagacctagagtccagagttccagtttttgcatttcttttgcagtaacatctgacaaatgttatcttgaaggagaaggaagaattaaccatatgaacgtaaaggaaaaaagcaaacccacaatggtttcttacaaacccttcttttctgtatttattttgagataggactacagaatgagattttcttcctctttttcctatatatctctttcttatcgtaggggttttaaggagttcttgagttgggttgtgttgaccatgtcagccttgttttgagattcatcatagagaagtctaatagagaagtcttgctttctagtcctgcagaagggttaacaaacgagttcgcaaaagattggaatcttagccggtttacacttttcattataaactcttcctataggttcacagaaggaagtcactggaagtcaactgccgagtgccagatcagctggacttccctttggctttttctccaggcctatttaagaagctgtgggcccaactgaccagtctgatggcatattgaagggtagtggaggcccactcaagcatcaatattgtctgactcagggaaactagcataaaacacagacagtcaaatacagtctcctacttgtgtaggaaggacagtaaaaagaggcactagatgtttatttagcttttgacaaatgtatgccttgaaacgcgcaatgtgtttttattctgtggatgtaccaaatagcccttcttggaaatgatcgggggaattcaaataggcagaaatcctctggtcagcacaaactacaagctagcaattctcaagacagcatgagctgttttttagtgtcagctatggtcagaagcgtgtgttgtggcatttggaaaaggaattagggcagttagctaattgcacgcttgaaaatgagaagctctttgaaaattcaaaagtctgattccagttcaaaaagaaattggtgttgctttgaactccaaagttgttattgtatactgaatttcaagtacttcctactaaacatggaaaatttgctttccccccaaccttatcctgagtgtattgctattcttagcccatgttttgaagtgttcttgatttaaaagatggagagaatgggttatatcagttccattaatttaataaacagccttgctttgcggtgtaagtattttccatctatattctgcagtagtgtttggggtagattgtgagctttctaatcaggggccatgagtcaaggaatagcctattgaccagttagtcttggaggtttcaggaatccttaacactttatgatggatcaactagggtactttccccatattttctttatacagagttaacaaaaatctggagattttttttttcttttttgatacagtctcaccctgttgcccaggctggagtgcagtggtgcaatctcagctcactgcaacctccgcctcccaggttcaagtgattcttgtgcctcagcctccctagtaactgggattacaggctcctgccaccatgctcagctaatttttgtatttttagtagagtcggggtttcaccgtattggccaggctggtcttgaactcctgacctcaagtgagctcaagtgatccacctgtctcaccctcacaaagtgttgggattacaggcattagccactgcacctggtcgagaaatctttataagctgttccagaagtgaaaagataagatatcctgactcaaaatcagtattttaaaaaaatacagcatttaaaaaaaatacagtatttttaaaaatggagatgtttaagctcatctatctgttggaaagagacagtcattttatcttttctgctaaatataaggtaaaaaatcagcacatttttacatttgagaaacaagcttttcttcctgacattgccttggttctgttgttgaccaatgaaagctagtaacggagtgggcctgggtcctcagtgagagtgttccagatgcaatgcggagtttaaggtctaaatagagacagccagaatcaaccatctgaatattgagtgtggatttaatgttgtgcttgcactttttgttatttacttagcgtgttacattgttccagcgatagagaagcatttctggtttttgatttgctttgaacaatagtgggaaattcagggcttctagcctgtttgtttttttttttttttttttaccagggtctgtgtgcaagtcagcaacgctcctgggatcacattgcttcttctgtgtttctttctaggtaaactagctcttgaacttagaaagaaacacttttgcttcctggggttgagggcaggagacggtcgtggtgagaatgtgcttaaagacaaagacaaaccagctggagatggtccttttaagtgaaggggagaggaagccgcaacaaggagggaccacctattacacaaagcacagcgtttcttaatctctgcactcatgacattttgggctagagtgttctttgttgtgcgggattgcccagtgcattacaggatgcttagcaacatccctggcctctacctattagatgccagtaacaccctgccaccagatgtaacaaccaaaaatgcctcctgacattttccatatatcccctggggagcaaaatgacctccagctgagaaccacccacgtagactctcagcatctaggtacctacaaaaccatcggtgggagttacacggactcattcatttcactcagcacacattcccatatcaatcagactttgccgcctgttaattcctctttctaatgcgctcttatttttatcctcagttgagatgaaactttctctcataggttgtctggtcactgaggtcactaggtcctaggtctgccctcagttccaggttgaaacttctgtcctcacatctacctgtagcctgtctcaggttccctggcttccacccacagcattgcctggaacaaactggtaggctgattttaagttgttttggttcaaaaactttctctctctcttttttttttttttaattttatttcgttttaaaccacagtttctcaaagtgcctgaactacttcgctctctcatggttctgtaccttaccccgtcatgcttagcttcggagggtgaggcagagctcacgtcacacatgctaggtctcatttgctcaaaatgatcccttagctcaaatcccagcaacctaacaatcagttacattttgattcctccaactccaggcaaaattcctttccattccaatgccaggcaaagctcctttccattcatgtatgattttgtggtccgttgggcacaggagtctgtaggttgccttgcaaatcatagttttcaaaatcatctttttctgcattctgtaacctgggattccaactccaagtaaattgtttcttttcttttctttctttctttttcttttttttttttcattttaaggccagagttggatagaggatagggatgggctgagaatggggtgatgggttggtctcttcatcttacagttttattactgttaaataataagtaacagcatttattgcctccggtatcaaatgttattaaatgtctgtgtcaatggagagcagaataaccagaagtcacctgacaatagcgcatgaccataaagtatttctaacaagaataattgctgtcactgagtgcgctctctcttttatcagctgtcataaacaggtcttattacctttgtcataaacaagtagtattaccttagaaatgttatggggggttgggcacagtggctcacacctgtactcccagctctttggaaggctgaggcaggtggatcacttgagcctaagacttcgagaccagcctgggcaacatggtgaaaccctgcctctacaagatacaaaaattagccaggcatggtggcacgtgcctgtaatcccaactactcaggaggctgaggcaggaagatcacctgagcctagggaggtggaggctgcagtgagccgagattgtatgcccctgcactccagcctgggcaacagagccagcccctgtctcaaggaaaagaaaataaatattaggggtttattgcttctatctcaggcaggtttggttaggactatataaaagcaaattatacattcatgggaaacagaagcaaaaagaaccaggtacctgacagtgaagagataacaaatggcaatgtaagaaacacttgccaatttctttgtctgtggaaatggcattaaagctgctttgaaggaaagtagattttttgaaataaaatggctatagatcagaaaaattagtgtgcatatcatcggtaaagtatcaaaaggaaagtacacacacacacacacacacacacacacacaactatttttcccattaaggcacaaccagggtgatttaaaacatgatacataagtgttacagaagaggaaagtcaagataggaggctgtgttttcaatacacttttaaagctgattatgtttagtgttctacaggttctgaaatccttgtctaatgaaaatatatatggcttctagattttaatgattatttttttttctttaagcttaaagaagaattccaaagaacggcctacatacccagagctaatggtgagtattgttagcaacgtaaacatgactatactgatagctacaaaaggcaaagtcactaagacctaaattatcatcacatcaccatattggaagagttggttcattgatacatcagtgacaggaattgaactccaggaaagagagttaaagagttcatcctacatccttcttaaacataggttgggacctgtcactattcttagtagtttttttccaggctaataaacctgtcatgatacagagcaaattatgtgtatacaatttatatttttgaatttaaaagatatgagaagcctcatattactaagataaaattaaggaaagtatgatttaagagatttcaatactgaggaaaacttaaatgctctttgactgatcaatttttgatcaaatatctgggctaaattagatgaacaactttttggggggtagctaaggaggaaaaaaaattttgctttttgttttcactttggtggaaaaaagtaagacaaagcatgattagtttaaattatactccctcagcattcacagtttatcacttgctgtgtctataaaaagcaagagtgaagaaagtaatatcttagcattgtttgttgtattaaaataacgtttcttaaattgtggtaactataggccgggcatggtggctgttcatgcctgtaatcccagcactctggtaggccgagttgggcagattgcttgagcccaggagttggagaccaacctgggcaacatgacgaaaccccacctctacaaaaagtacaaaaaattagccgggcatggtggcatttgcctgtagccccagctactcaggaagccgaggtggcaggatcacttgagcccaggaagttaaggctgcagtgagccgtgattgtgccactgaattccagcctgggcaacagagtgagaccctgtctcaaagaaaaacaaacaaacaaacaaacaaaactctggtaactacaattctaagctaattactaatgattctaaaagctaaatacaaatggcaaggacctaaacttggcaatgctttgctttatctaagtatatgttgaatgtaggagaaacacatttttgggggggagaaatatataaaattcagactatttgctaatttatgttaattcctagatttgtttcaattatcaaggttttcattttagcaggggaaggaagagttacgttcatgcacaatttcaaaagcaataaaacactgacaccctttcttactggaacacagttattcatcaggcattaaatgcttgctcctctgctatcccagccacaagccctgctgtcttcaagaccaactcagggcatgtcttagaagcatggattcctagtgtcaaatgctgtggtgaggtggcttagatatgaggaagcacagcttggaaatgtcgagtcaggaagagttacagaaagctgatcaggaagatgcgtgatagttacagccaatcacataggttttcacttctgttgcctaagctttgattgaagattgaaccattttgcaactggatgaattggagatgagaccatctcattgggcctccattgggtgcattaaaaggcagcccctggtgctcagcactctaccatctttattcaactaaaactcacagttaaagaaggaaatatgagtaatgtttgagaaaatcctagcatagtacatgtttaagttgaatattttcttcccgattattttttaatagccagtcaaaggcttttttggttctgtttactctttttaaatatgcttatgcacccgctaggccattttaaaattaatttcatataaaatacagtagatatacagttattcttgtaggatactatggagcctgtaatcctattttatttatttatttatattttaatttttattttttagagatggagtctcattatgttgcccaggctggtctcgaagtcgtgggctcaaacaatcccccggcctgggccccccaagtagctgggactacaagtgtgcacctgtactcctattctaaagttgccatgttttgtaactaagttcagataagaagaacattttctatatatttctggctactttttcttcttccaaatggtttcggatcagaaatttcactgaaacacacttgagaaaagaatgcttaatatacatgggcagctgatgtcaaattctacatttgtaatatgttctaaccctgtgatattttatggcctacatatatatcaatgttataaaatcatgtcagtcccccttttcttcttacagcattagtctttgtggtactggaaatggacttgccttttaagactataactgttccctgctttcctgtggaactgaggttttcaaacggaaaatctgagtccaaactccctgactttagcattgggaaaacacttgctgagaggcaattgtttagattttaggagttggtgaggaagtatgaaggaaaaaaataatcctttttccaggtgaaggacagtttaattaaggccttaacctagacatgtccctcttatagaaatcccaaatgtttctctccctaacacggattgaagggtgtgtattctttaagatcatgtcatttgcttcttctctcaaatgtcactggggagtatgactcagtagaatttgttcttctaaagtaggtagcagccaacgatttctgtaaaggactaaatagtaagtattttagtctttgtaggctatacagttgctgtttacaatggcttaattcagtgttgcaatgtgaaagcagccatatccgatgtgttaaaaaaaaaatggggtgtgtgtggctgtgttccaataaaactttatttaaaaaaacaagcagtgggctaaatttggcctctgggtcataggtagctgatccctgtcctagatgataatcaccagaaaagataaccagttcattcaagtgattgcccagtgaaataatgttctccaattatcttaggaagttctagattgaactgtatgttaaacaaagatgcctgacccattcaaaaccatagtcttaagggatgaggtgctgtgcatgggacagggagacctgctggtgactgtagcttgtctgtctattcctcgtagtatgttcacggatctccatgttttcttcaggcacatcagtgagactaaatggtgtaaagtcctcccttcttgtctccctggctcctcttttgggaaacccagcctggtattatagtctgagtattattcatagtccctcatttgtcaatttcctggttgctgcccttgctaatcttaatccattgcttataggagggactgggttccctcttaaccttttacagcctcaaaacccacacaagaaggcaagtcacactttccatttgtcatgcctacccgttttcccctccccctgcccttctggctctcatagcattttctcaacctgggaataaatggaaagatgcctagcgattttctttttttttgattaaagacttcaagtcaggttatttaattcatttgcagactcaggcaacatctactgagctaatagccactagcagaacaaaaggcaaggtggggctggcaggtgttggaagcagtcaccaagataatctgaggtttggcatgtcctgttttgatagtaaaaagcttttaagtacattaaaagatttccaaatgtccagaggatgtgggaaagctaataagcatgatggtagagtccttggtaagtgtgctgtgtatgtggtgactaatcagaagtatggctgctatttagtttttgagggagctcaggaggaaggacctggcactcagagcttcagttgatttcatgagtgtaaggatcggagccagcactcaacctgtgtcctcagatgggcaaagggagaaaatctcttttccattttctgagtcatgatacttaatcgcgaccagctatcttctttggggtttttatttctttgttcctttcccatttgcattgtttcctagagtttccatgagcaggaactcagttttccacggagctgactcatccaaccctctgctgtcaggtttaaaacaaatataattagaaaacctacagctgggcaacataaaggttgtaaactaaactccctaaagtcaggggaaacagagtgagtcacttatgtgtctggatgtaaaaatgcttacatttagctactcaactggtcattgaaaatagactaccaggcaatcaagggagtgagcatgggaggtgagacacgtgggactaagttctacctgtaagaattatccatttggggtaggtttggttggttctatttccactataagaactgtggctcatgacctgatatatctttctaagtagaggtggcaggttccactgtgagagctgggcacttattgtaacaaaattgagcaatctggggagaattgttctagtgcagagaaaatggcttcctgctcaggattgttttgaaatgcatggcctcttgaatcacataccatgcttgttcccctagcaaagcataagacttgttatgtttttagagtttacttgttctgagctgtgaggatagagactcttcttttcccttttcaatctttaatctccgagttcagttttctctgcacataactagagtttggcagtctacattatttttcagatggatcaactcttcatcaggagagacataaataaagctcgtggcttggcaaatggctttaactgttttagtctaaaccaattctccaacgtcaagggcgagggctaccttccttgcacgtttactgttcaacaaaattggcttctcattccatcatctttttcctgagaaataaaagtgcatactgctggccgggcatggtggcacacgcctgcaatcccagcactttgggaggccgaggctggcagatcacgaggtcaggagatcaagaccatcctgggtaacacagtgaaaccctgtctctactaaaaatataaaaaattagccaggcatggtggcatgcacctgtaatcccagctactcgggaggctgaggcaggagaatcacttgaacccgggaggcagagtttgcagtgagccaagatcgcaccactgcactccagcctgggcaacagagcgagactccatctcaaaaagaaaaaagtacatacacctatgaattgtcttattatcttactactatattagcctaaaatgaccttgtggggcccagggctatttgtaaatcagagtttgggttgttttttgtcaatctttgtattttgctgtagatgagacttacgtagcataattacacttttttttaaaatttaatatagtggaaacctagagatatcaagatggaaagagtgacaactaagagatatctttaaaatgtttgcatcactagatgtgtgcttgattttggaaagggtaggaaaagcccagcctagctctgatagggatacttaatccctgtaccaagcagatctattcatttgctaatctcatatattgattgtcagtaagacattaataccatgttttttctttttcttttccagcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaaggacagagggttttgattttaaaaagaagaaaaaaaaaccttattttttctttcttggcctcaagttcaatatggagaggattgcttccctgaatcctctcttccttccccttttagattttgaagtgcaatcatatgtttttctctgtttgcattttttcctccttgttcttgacaaggaggagttgctcctgcccagaatgagcgtgacacttccgaacacttcttcatattcagttccaagatatatctgcttgattaaacatgagcttcctctgctctgaagctacctctgtcctcattttattctagccagaaaaggagtatcaccctagtgattatggctgttcactttcccatctatcttcctaaatctggaagttcttctcttggagatcaagagaaaaattacaattgtattccttactttattcacccacctatgaaaacaggaagcaataggaaaaaaaatccggttactccattttagcttttggtgaacgatgtagagcaaattgtctctctggtctaggtccgattactcttacctgtttttccactttgagacattctaaacagaatgtgtaacttctcatatgtatgcctctcccatctgtgaacctaggccaaagttgcaaaaacaatcatattaatagtagagtagagaaaaagttagtctatggttctcaaccctcgtgtacattggaaccatctgggagctgtgaacactgtcgctgccaatgttccagccaccagagatttggatttaactggtggggcctaggaattggtgtttttttgttttg

SEQ ID NO: 15536 - DNA, 13773 bp, Human
tgtgcctgtagtcctagctactcgagaggctgaggcaggaggattgcttgaggtcaggagttcaagaccagcctgcgcaacacagcaataccctgtccgtaaaaacaacaatacttccaaaaaccagtgaatcaaaagctttatagcatttgattatattatgctttatagtaggagcccataaaaaaaaactattctttttgcaccaagctataagtaccctgaagttaagaacaaggtcataataacctgtgtttcccgcagtgaccaggaaaaagcagtgcatgggttaacacattccgtacctactataatatgcatcatccaaggcactttacatttatttaattccacaataagcttataaattaggaattatgatctccatttttcaagagaggaaaggtgacttactcaaagaaatttttattcagatggactcactcctttcaatacactttgtttagttaacttaaaaattttttgtattttaaatttttgtgggtacatagtaggtgtatatatttaaagggtaatgagatgttttgatacagtcacgcaacgtgaaataatcacatcatggagaatggggtatccatcccttcaagcacttatcctttgtgttacaaagggtccaattacacttttagttattttaaaatgtataattatggtattaatgacagtcactctgttgtgctatcaaataggtcttattcattctttctattgttttttgtacctattaactggtaacaccatctccccaacccctcattaccctttagtaacaagttaactttagttaacttcttatttaaaaaatgatccccaatttattttattttccactgagaagtaactactttgtgggtaatcaaataaatagttgagaacttgaactcaaaagtcactagtaaaatatttggtcaaaataatttaattacaaatatacaaatggcaaacaggcatacgaaagggtactcagcaccactgatgagagaaatgcaaatcaaaactacaatgatacctcatctcaccccagttaaaatggcttatactcaaaagacaggcaataacaagtgctgggaagggtgtggagaaaatggaactctcgtacgctgttattgggaatgtaaatcagtaaaaccactatggagaacagtttggtggttcctcaaaaaactaaaaatagagctatcatatgatccagcaatcccactgctaggtatatacccaacagaaaggaaaactgtacaaagagacatctgcactcccacttttgttgtaacactattcacaacagccaagatttggaagcaacctaagtgtctataaacagatgaatggataaagaaaatatggtacatatacacaatggagtattattcagccataaaaaagaatgagatcctgtcatttgcaaaataatgtaattatacttttaccctggactttttatattatgaggaaataacattacatttattggttacctgcagttggtgaggcatttatacatgttatattatgctatcttatttaatcctcacaataacccaataaaatattcctttagaggaggaaacggtgactcagaagtgcagagtcttgcctaaggtcatacaagtaaacagaacacatcactcacttcttatgagaagaaatctcactgtaagtgataacccaactggcagcttttcttcttagaacatgtaattttctcttcgggactccatcctaaatatttaatttacataatcatattactagagtatctcaaatatttatttacataattaaaagcactcaaatcatagggctccaaaatgtatttcaaaataagttctgttaaagtaatatatttcttagtcactttgtggtttattgcacttccggaaccagctattgataaacttcctctttttctacagaaactatttcagtttgctagaggaacattttaaatctgaattgaaccacccattttcctttcttagccaaatcaccaaaatgtccagttagaacaagaatttagcattctgcaaaagaagttaacagctgaggtaagaaaattttcacacaatttggtttgatcttgctttatataaaatttattttaaaaactgtcattagtgttttaaacttaaactctgatagtctaaagatgtctataacaggtttttgtggttttgttgcatagaattaaaaaatactcagttcagcttgccttagaaaaatattttcacctaggtttgtataagaccttttaagtttatttaatctcacacacacacacacacacacacacacatatttttttttttttttgagatagagtcttgctctgtctcccaggctggagtgcagtggcatgatctcagctcactgcaacctccacctcctgggttcaagcaattctcctgcttcagcctctcaagtagctcggattacaggcgcccaccaccacgcctggctaatttttttgtatttttagtagagatggggtttcactatgttgcccaggctggtctcctactcctgaccttgggtgatccgcttacctccgcctcccaaagtgctgggattacaggagtgagccaccgctcccagccacaatcatatttgttaaccttagttttagaattaaaaagaaactatagccatggcagataaagctaagggttagaaatagaactagattccacaggctatgactgaatttataacctccaaaatattaattgttaaaagttctaatgtactttttatagaattttcctgtacataatataatgcataaattaaaatttttgtatcccctttagtttgcatagtaagaatggtcactttcacttaatttagaaagaaaaagaaatcagatgtggtatttgactattattattatacatgctttattttttacatatagattttatatttaataatgatgacatgaaaacattatggctcattttaaaagcttactaagccaaaaatgttagtcaataatcaaacatgcatgcgtatattaatatcatctacgtgtttatgtcacattatctgagactttagaacatagtataagatagaagaaacctatagaataaacaatagaaaattgttaatatgcataaaagatgcttgctgtgggtaaaatgggcaaattaaaaactgcaaagagtattttacatagacttgtaatttcagggaataatatgttcatagtgggtgatatcccatttcaacacttaataaatattcatgactttctcttagaaggatttcttctaagtaattactgtggaagtcagaaaataaagatatttatctctttttcagattaggcttgtctatatatttttctacttctaatatttagtttatttcattatgcataaagtcataaaattatattaaatttttttcactgtcatatttcataaaattaaaaaatttcccatcaatccttatggtgtgtttttgtcatagaatcccatactttttttttttttttttgagatggagtctccctctgtcacccaggctggtgtgcagcggcaccatcttggctcacaggctcactgcaacctccgcctcccagggtcaagagattcttctgcctcagcctcctgagtagctgggattacaggcacccaccaccacgcctggctaattttttgtatttttagtagaaacggggtttcaccatgttggtcaggctggtcttcaactcctgacctcaagtgattggcccacctcggcctcccaaagtgctgggattacaggcaggaaccactgcgcctggtcccatacatgtttttaaagggttagtcccaaatctaaagtttactagtagtgcctgtgttttccagctaattcccacataattctacttagaaggaaactttaattctgattaagtttgaattgagaaacataaatctgatgcctttcaatgtccaagctttaaaaaaaaaatcaccacaaaattttcagtaaacttactaaatatgacactttatagaaaccattccaaattcttataatagttttcgtagaatcaggactaaaatgggttttcaggtatttctttcctaccctttatctaagactacctacaagtgttatttacgtgtaattcccaccaactcacatctccttccttcataaagcatttctatttcataacttttctatgaaaggcagtatagcacatacagtgaaatgtgatagaaagaaacggttctggcacaagattagcatgatttttgtattagtgccactacttagagctgtgatactgccaagttacccaacatcgtggtgtctcagtttccttatctgtaggatgaaaaaaccaccacctagctaattaaaataggatactgcttagcctttggtgggtgctcagtaaatggtcactatcatgatacaagatggtcatcaaatacttcctattgtagttgaaggtcaatttctctttccacttttcctcaagatgcagaatggctggttttttcttttacggtttcaaaacttcactagttagagataatactactgctaaattttaatctattatatttgcatcacaacttttattatatcaaagtaattgatacagctatctatacttgtcttttgtctaggatatgctctccaaatcttgattctctttaaaagataatggcatacttcctaacatatccaacttaacagcatcaattttaaatgctggaccctttaagtacttatgcattatatttataagaacatgtctatggccgggctcggtggctcatgcctataattccagcactttgggaggccaaggtgggtgggtcacttgagtccaggagttcaaggcaagtctgggtgacatggtgaaaccccatgtctacaaaaaatacaaaaattagttgggcgtggtgtagtgcacctgcagtttctaacttctttagggaagctgaggtgtgaggaggatcgcttgagcccaggaggcagaggctgcagtgagctgagattgcaccactgcactgcaacccgggtgacagagtgagaccctgtctccaaacggaaaaaaaaaaaaaaaaagaacatgtcttatacacggggactcctgcttcactgtaactgtctttaaaatgtttaaatttatgtttttctttttaaaatattctaaatattcagcaaagaaaaagaaccaaaatcacagatttaaacctcaaagtgccagcctataataatgagtaaaaaccggcatatgagggctgacaaatttgcttgagcagcagactaagggatttctggaaaactctatataaaacgtacacgggtacatgggttctttggaataattgctaggtatgcttctggatagtgtcagggaaaaaaaaagggagaggatggtaaggatactcacagcagacaggagagcctgaaatgaaaggtaaatgaatttgaaaggatggttccttctggtcctccattttagaaagcaagctcctctttactgtctccctgcactcacaaacacaggccagccacaacagagcagcattttgccgttgcttctttcatctacttcaatcatctccccccacccccaacttcattttgcctacttcaatcatctacactgccttcttgctaattatataaccactgctttttttttcacctgtttattaacttttcttcttttctgtatcttctctagtcaattgaccttcctcttttctgttcgctgcttcctagagtttttgttttttctcttttgtgttattttgtatttctttgcattgccttttatattattctaaatctcctttttattcccctgcccaatattgttctttacctacagaaacaatgttggtacttcaggtacacaccacttacatattttaaaatgtgtatgctaaataaccttccacactggtagtaacgctggcctcattaccgctgggaaaaaagtcagttttttccactaccatattccctatttattcctcttttaaatctttcttctccttctctggactacactgaattgccatcatagaattctaatacagtttctagtactctgatgtggcagatcctaggaggataaaaagctaactgaagagtggtagaaagtgttaggataggcaaaaaatggaatttggttttaatattgccataaccgttaactgacaagtgaaaatctcatacatggagggttccaccagcttactactgacagtagaggataggagcctatcaaaattgatcttacaaactaacctgggtttaaaattatgttcctgtttgggccctgtccttctctaatgcctttttcagctaactgaaaagaggaaccgtatggtttccttattttaagcaaagtcacaaaagaggaaacatttttggctaaagacaattcatggcttatattttctgatgctttgcatagcattaaaacagatttttaaaatgaagttctgaagagaataacattttctaaagaagtccccccgcctttttttgtaatctataagaataatgggtaggaactgcatggatgatgaccatccagagattattcaaatccctatatctatgccaaaagtgttcaaattttcccttttaaatcttttgcaaaatggataaaaagcagaatttattaactcagatttcactgcctctgcttattttctggtagaagtactagtaaaaagcaaaaactaaaatggaaaggaatcaagaagcccaatacaggttaaatgtttactgtgctcctaatatataaggcattaactacaaagaaatcaaaatataaaaacatgaggcaataaagggtagcagaaagaatgtatgctttggaatcaggtggccctgggtacaaactcccaatctgtcacttcgagtggtataacatcaggcaaactgcttaactcatttgacactgtctctttatctgtaaataagggatccctttaccttccttataaagtcatttgaaggttctgtgaaataaagtatgcaaaactgggatagtacaacacataatatgctctagataagtatttttctttctcctttctgccttcttcaaggttctttataatcttgttcaaggaagtaggtataggaaaatgtgaaaagtaaacacaattacttaagagaatagaagtgtgagtgagatacatacatgaattatgtaaggaaccataaaaacaataaatgagagctagggggaattcagtaaatgactgatctgtttgggctgtagtcagtcacagagaacttgggttaagaaggggaatttaaactgaggtctgaaagatgaggacagattcagatatgcagccagaaaggggaagaggctaggtctggaagaaaaataaaaaaaaagaacacccttgagaagggtaaaaaacagcatagaagtgtctgtttagcagggaaaaatcgtgtgtttagaaagtatgcaaggtgggaaagggatgcatttggctggataagaagtttcagtcatgatacgtgaatctggactggttaactcaagccagaaggaagaaaactcaatttagaagttttatcttaacaggccaggcgtggtggctcatgcctgtaatcccagcattttgggaggctgaggcggacagatcacttgaggtcaggagttcgagaccggtctggacaacatggtgaaaccctgtctctactaaaaatacaaaaattagccaggtgtggtagtgtatgcctactgtagtcccagctactcgggaggatgaggcacaagaatcgcttgaacccaggatgtagaggttgcagcgagacaagatcatgccactgcactccagcctgggtgacagaacgactctgtctccaaaaaaaaaaagaaaaaggaagttttatcttaacagaaattaaaccctcaagcaaggcagtagtaacctgatcatgcacacttttaagattaattcagcagtgtgcaggagagttcaaaggagaactgttttaaaattcaggcttgaattattcgtatagggaaaaaaatcacatatcttttcttctactaaaacagggccatttatcatcactgtgtaccaagtggtagaggagtaagcaatgatatgctgtttagatatgctgaaaaggtaatttgtaaaacctttattgcaccttccaacagaacatcaaatctctctaaatataggcttatgagtcagaagaactatagtttctaatcatgtataccaatatctaacaccctaagattttctattccctaatgttaagagataaccaaatagttgccattgtgtttgatgatgtgcaaaacaagtatattataccaaaagttgcaaattgtctcagtagaactcttcactttagaggaaaggcaattgagaacaggaaaggttaagcaactagttctcatggttagacaggtagttagatgggagaagtagaactgaaacttaactctccaagttttagcatctaccacatcccagaaaaagccctatctgccaaactttcatatgtgccttattttcctgtgcccacattgttgctctccctggctggaaacttaattagtttttatagacttttaaaattcagttcaagctttacttcactgaagcctttccaggctaggttaacttctctgtacatctcctgcatacttttatgagaaagcttatcaaattattgtaattgggccaggcgtggtggctcacacctgtaatcccagcactttgggaggccaaggcaggcagatcacctgaggtcagttctcgagcagcctggccaacacggtgaaaccccgtctgtgctaaaaatacaaaaataggccaggcgtggtgatgtgtacctgtaatcccagctacttggaggctgagagaggagaatcagttgaacctgggaagcggaatttgcagtgagcccagattgtgccactacactccagcctgggtgacagagtaagactgtcttgaaaaaaaaaaaattattgtaattattttttagctttttttctttcttctttttatttagagatgggatcttactatgtggtccatgctgttcttgaactcctggcctcaaacgatcctcccatcttggcttcccaaagtgctgggattacaggaatgagccactacgcctggcctttactgtttgcttctatcactagaatctgaaacacttaaaggcagtgactatcttttttttttttttttaatctcctaaacctagaacagagctccacacaaatgtggcatttaccaatagatgaatgaaagcagcagcaggactacttgaccaactggattgaatttactccaccagattcagagatcactctaggattttaagcctaagactctgagttgaatgaaattctttaaaaatatgcaatattaacataaggctaccacgctacagagacactaaggatgcttcaaagattactaatagactctgtgcctaagaaacttagtggtaccattaacagatacagagaagttgggagaagagtcagttgtcagttgtgagggtaaagatgaactccattttaaatatgttgaatttgctgatagtgggagatatttatatctatatctatgtctatctatctatatatataaaatatggaaaaatccaccaagaagtcacacaaatagaattaggacaaagaagatgtaggctggaggtacaggtttaggaattgtggcataaagctgagaactaaaatcttacagaatcaggaacaaagaaaagtaggtaagggtgaggacagaatatcaattaaccatatttaggaggcagaagaaaaagagctagtgagagtaacatgaaaggaagactgattacaaaaagctacttgaatattagtgaaggaacagtagtgtctaatgtggtcaaggaggggaggggagagaagaaataaagaacaattagattaggtaacagatgatcactggtgttcttcaaggcaggagaatcaatatatttctagtagaaaatggtgaaaaaaggtagagaacacatggatccagcatatagagcctatgcgttttgagaagtatgactaagtgaagtactgaaatataatgaagctagaggggcagcagagccaagtacagaacttgtattaataaaagaagagagatcactgcttatgaggtccaaatgctgtatgatgggttagagtatatccaagagttgttacaccaaacctacagtgtatcaagtctaaattaggaataataactactaatcaactactactaattaggaataatgtctacctactttatgccaggaatcataatgaaaagtcaaatttttaactagacaccaatgacgcctaactgtctttctctttcattataaacccgctatagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgatcaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaatagagaaattttcttcttggtttcattgcaaagagtaaaacaaacatgttaaaacatcaactgaagggttgggttaggaacatttaccctgaaaaaaatatgaggatgcatcataaaatgtaaatattttcctaccatgttgggggggcacaaattttaaaactggcatctttacaagtttcttctttataaacacccaaacaaaatcaagttttataaagcaaaaaaaaggaaaagaagactatggcttcattctaaatacgggtgactttgggtgatttttttttcaggaaaagagactatcaaaacacagatgattctcaactttttactaaacttatactttctgatgctatccactcttaaatcacctttcttacacagaatttcatctttatccattatctgacaattggtaagtctgagttattagagtaggaatgggcccaatctttgtcaaagtcaagagtggtcatcagcctatacttttggggatgccagcctttgtctgcagaagtgctcctttgcccaacaagcacatattcttcctcattagtcccatctaactccagggggaaacaagcacttagaataaaatggtagcccagtcttggagaaccactcatagttctgggattttcagagtagaacatagcatttattcatagcactggcattcatgacattaacaaagctccatatttaataagaaccagtagggttttggacacaggaattttacatacaatgtttttcctaaaatctttcaagccatctttactgaccattaattttttaatctatagaaacacttccttgagcttcttacttttcctgaataagcatgatacttattgtcatattacatcttttgtcttcctcattaaaaattttctttcatgtattcttcaaagttagtacttttgttcgagacagagtctcactctgtcgcccacgctggagtgcagtggcatgatcttggctcactgcaacctccgcctcccacgttaaaggggttctcctgcctcagcctactgagtagctgggactacaggcgtgcaccaccacgcctggctaattttggtattttttttttagtagagatggggtttcaccatattggccaggctggtcttgaactcctgacctcatgatccacctgcctcggcctctcaaagtgctgggattacagccgtgagccaccgtgcccggcccaaacttagtacttttaaagctaatttccccagcagcaatctggagttgagaatttcctattattctttttaattttacgaatttttgttatggtaaataagatatgtttttatacttggccaagtctttgacatgccttaaatcatcataactgttctcattttacatttgtgacagttacttaatgggctcgttccacatttttgcccctttttaccaccttctttcctgaaagaaatacagggaaaaatagggaaataccaattttcttagattaaacgggagctgattagc

SEQ ID NO: 15537 - DNA, 27250 bp, Human
gagcacctccccaggtgcgcctaattcgaagggcagtcagaatggcggagccaagttcctggcacccctcttcagtttcccctcaacttgagaggggactcccccgcaggcggggcagagtggaccctgggaccccagcccaagacttttccggagaagaacactcgctccagcctcttcccgcggagcacctcccaccagttttcatggcgcccaccctgaacccccgatcgccccaacctttctccggcctccctcaccttgagcggcgctcccagcaggcggtgcaccgcgggtatctgcgcgcccaagggcagcgccccgtccaggctgcaggtgggggcccggcgcggctccggaaagttggcacatgcgaaggggtcggtgtcttccaggtactgcaccctcacggtcaccactgataccggctctccgtccccgcggtcttccccgcccgccatggctctgcggccggctcacgcagcgcgcctccgagtcccggccccagtgcagcttctactcaaagcacactgtagctccgcggttcgggcccggccggaccggacgcggctggaggggcggggccagacggaggcggggccgaggaagggggtggagccaagattagtccccgagtgcgcgccaggaggtaaccactgccggaggcggggccgccgctagccactcacagggcccaatgggaatcccgttagttcactggctaggagggcgggaaaaaccgagctcgcgccccaccttcgagaacgcgcagaaggcggggaggctttctttggtctggggatagtgaggctgcgttctctttgaggggtgttagggcagatggggcagaagtttctttagatagtggccggccaggtctctctcagttgagggacaagatagccctcattccttccatttgaggggtgagtccctgtggtttcctcatttagggaaagcagtgagagggggtcccttcaatttggagcaagaagtgagaataaattccacccagtttgaaggaagaggtgggatcagttccctttagttgtgggaggaagagggaaggatgcccttcagttttctgggaaaagattgggaggagtcagtttgagggggcagatagaacacgttcccctcagttttggagaaaaagtgggatgggtgcccctcagcctgaatgaaaagtggagacggtcctcctctgtttggggcgctatgagccgaatgcccctcagatttggaaaaagttgggtgcatctcgcctagtttgaagggaatcagtaggctgggttttccataggttcctgtcagcttcatcaaagagatgagacagttctctgtagtgtgactgaaagggagggccaggtgccccttggtttgggagatgaagaacagcctccctcttcgcctggcacgagctgggccagtctgggccttagggtttctgggacgttgggggcagcgttgtccgtcactgctttggggagcgtccagtgcgcgtgcgcagctcaggtccgggtgggggccggcagggggtcctgggcttggcaacgtgggcggagggcggccaagcacggtcccctgcgttttgcacccggccgcgccttggtcccaggggggtgctgctcgccgcacagcagcgctggccgaggaggagccgtgcccctcccgtcctgaccgcgccccccgcagacccccgcccttcccgctgcgggctgccccaggggggccgtggccgcgcaccgctctggatctggtgggggcggttttggggaggtttgggggcgcggactcgaaggagtaggttgtggaacttgggggagagctgcactggggaatttccggagctgggactgatttagggaggaaagaggagagagtccccgactacgagagtccgaggcagggtctcggagcctggacctggcttgggggtatcggagccgggattggggggagcgggccccacgtgcctgtgacgcgggggcgcccggtaggtggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcggtgagtgcgtgtgtgcgtgcgccaggccgaccgccagcggcggacccgcccccaacacccccacctcctcggtcctcagattggggctggcttcttgcacggtgctgggacttaggtttggattccacaaatccgggctctcgcccagttcctgcatcgcttcttgtgggtcccaggtccctgtcttctcccctgggagctctgaggatttgcctttctgaagggctgtcccccgctctccccaactccatctgtaggctcctttgccctctccgctcccctcttccccttgcagtaggccctcttcagtctggtctctcccccaccaatccctagcctcccagaaacctctgtcgctggtgaggatgtgtggggacattgaggggagggtgttctcccaagaacacaggcatcctggttctgaaaaagcagccttccctggagaccatgtccgagtgtccattcccttgggaaactacactgccacttttcctccagctctcccctgctccccacttaaagctgctgccttcttgtgcctgtgtatgggtacccccccaacccacgttcaggtccacattcttctcacttcagggtataagaaacttccgtgtatcggggccttcctgtgtgctgtctaccctagatgctttcatacatccgacctcttcagtcctgacagcattgaaggctgtgcttcagacttctttttccctgaatagagctgcttttccttgcatctgctccttcctcctcccttctgagcagccagtggtccctcctcccaccagagaccctcctccttctccctgttgtgctggctctgctgtgggggtgactaattatagctgagcgttgctactctctccccatggatgctggcacagcctgtactccagtctcaccaatacagccttcatggaggaatcacccagagcctagaatttgcccctcttctcccacatggacactgctagggggtgagggggctgggcaggaacagaactctccactctgctgtggcagcctgagattaataatggaaagtggaactcaatatgccttccgggagcgtggttctgtgatggggcttggatctcggggctggggttaatgcatgaagagatgaagatgaaatagggtccccgaaggagagaagtgggagaccaaagtagggacaagtatggagagatctatgaccatgtttaccttagaggtccagcagcaatgagagtaagagtagaaagagcctcaggtttggagccaacgattgggtttgctaagtctgtgagttgcagaagagttcctgtcttagggtttatagcaaaaactgtagttttccccataaatcatggttctttttctagtttggatgacatttcctatggaagtaagagaagagagcctccttttcacaagtcaaagaaaatcctcgaacaagagaaaaggcagagcattcaggaacaccttcccccagcttcattgctaggagactttttcccttttattaaacaaatatttacatagagctcactatgtgccaggcactgttctaggccctttgggtacagcttccaaagggcactgtcttggcatagggtctcacagaggctaatttagaggtctccttccccaacaccccagggattatgtagagagagatgtgttcgcttgtggtctgaggacttaaaggagagccaaagagtttattttagaggacaaaagtaggagtggctatagtgctagaaacgcttttcttctcccctcctacagacagaactgttctatttaattaacatttggtgtgtgtctaacatactatgtgtctgacattatgctaggcacatttgcatactttatatcattttatcctcacccttgatgctgggtatttttcctatattacaaaagaagaaattgaagttcaagtaagttaaataatttgcctgagatcacatagaatgtgctaaggctggaagaagacctggagatcttctgattgctaaagccaaagttttaaaaactacgcagtcctgagtgagcccatataatgaaaagcacattgggctaggaagtctacacagctcctaggaggtataatatacattctggtctagttaaggagtgaggacattataataggtaacatttattgagtgcttactgtaaagtagtgtgctaagtgcttttgagtagattgtcttttttttttttttttttttttttttttgagacagagtctcactctgtcacccaggctggagtacagtggcatgatctcggctcactgcaacctctgcctcccaggttcaagtgattctcctgcctcagtctcccaagtagctgggactaccggcacccgccaccatgcccagctaatttttgtatttttagtagagacagggtttcgccgtgctggccaggctgatccagaactcctgacctcaggtgatctgcccactttggcctcccaaagtgctgggattacaggcatgagccaccgcgccccgcctgtagattgtcttttttaatggtcacaataatcttatgagatcattatcgtttttactcccatttcactgatgagaaaactgagtcagagacatgaagttatttgccctaagatcacagaactaagctttgaatccaagcaacttgactccaaagaccctgatttttacagctttcttacatataaaaagatactgggtagcattagctgaggttcaaataatggctatggataagggttgtcagagaaaggtgaggtcccctgaggatgaaagtataaaggaagggacatttctagaaggggaaaaagcagtaaaggcctaggttaccatagtgtgacaggagcactaagaaacagatgactttgactgcaggggagggtttgtagccctggagattggaaattctagaagtcttgcatatttctcctcccttggtcccagtcttagaaggttggccaggcgcggtggctcacacctgtaatcccagcactttgggaggccaaggtgggcggatcatgaggtcaggagttcaagaccagcctggccaacatagtgaaaccctgtctctactaagaatataaaaaaaattatctgggcatggtggcgcgtgtctgtagtccccgtactcaggaggctgaggcaggagaatcacttgaacccgggaggtgaaggttgcagtgagctgagattgtgctactgcactccagcttgggcaacagagtgagacttcatctcaaaaaaaaaaaaacaaaactgggagttcataggcctgtgtgtgggaggatattccataaactgatccatcctgcactctttttgcattgcagtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtaggtgagtgaccctaagacctgggctttgccagacccatcacccctctcccttctcctcaagctctggaggcccatgctggtgtgagccatgccctgaaagctccatcctaggtccctccctctggagtgcaaggcagtgctcccgctggggttcaggcctcattgaggtctctgccagtctgggcttctgcagcataacagctgagcaggagtctggctcccagctgtatgtgggctgccaaggctggggagcctgtgttaccattctgttgcctcctgccctctgttaccacattgccatttgccagcccgtctcccctgaggcatagctgtgcatcatttctgcaagggcctgctgtcctggctctccccaggccaggtctgggtggttttctgtttttattattatttttttttcttaactatatgttgtctataagaaattcattattttaaacatttatttttttaaataaataaatagatatttaaaaaataaatattataaatccatcaaatgctggcactacactgggttttctctccttacttatcccactgactcttcatagcaacccttttgtgtagtttgtcacatttacacatgaggaaatagaaccccttgcatttgtttgctatcaggtccaaggttagcagaagaggtccgtgtttgttgttgttgttgttgcttgtttttttgagatggagtctcactcttgtccaggctagagtgcaatggcatgatcttggcttactgcaacctccacctcctgggttcaagcaattctcctgtcttagcctcctgagtagctgggattacaagcacatgtcactatgcccagctaatttttgtatttttagtagagatggggtttcgccatgttggccaggctggtcttgaactgctgagctcaggtgatctgcccacctcaacctgtcaaagtgctaggattataggcatgagccaccacgcctggccccaggtctgttttactgaggctctttgcctttaggttgccctctcttgctaccttctttatttcctaacccaagaaattcattcaaccctgaaggttaatgattcacactttttccaaggtattacaagaaaacgtttacaattgctacctgggactctaacctggtttccctattgaggtagtgaactatttggggcaggaagggaagggaggacatcagatcataataacagtaatagataataatatcttttgggtgcttactatatgttaggcattggctaaggaactttttgaggtagatattgttattagtctcaatttagacatggggaaactggggctcatagaaattatatgacatattcaagtccgatctgtgttgcttttcttactatattcagttctccacacctgctgagaattgtgtcacatccctttggccgggaaccacaggtgtgggagaaagcactctcttttgttattccccctaataaaaatagttagcagccaatttccatttgctggtagttattattactgttgctacagtgctttttccctattttattttatttattattattttttgagactgagtctcactgtgtcacccaggctggagtgcagtggcacaatctcggctcactgcggcctccgcctccctggttcaagtgattctcctgcctcagcctcccaagtagctgggattacaggcctgcaccactgcgcctggctactttttgtatttttagtagagacagggtttcaccatgttggccaggctggtcttgaactcctgacctcaggtgatccagcccacctcggcctcccaaagtgctgggattacaggcatgagtcactgtacctgggctttttccctattccaaatggctgggttgagttttgaaacaatcttgtgaggcaggcagatgaggaggcatggctaaggtgagccacatgacagtgacggaccagcatcacacagttggtaagtggcaaagccagaccttaggcataggtagcttgactgaagtctcctgatctgcaggctaatgctgtctttgccatcccaagtcctctttgggcttccttgctgttatcagcaggggtggggcctgggcttgttccagggcgtgctccaggagactgggtcgtcttcaatgactggcctgtcctacacatgtcccttaatagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgagcgtgctcagctgactgccattccctgaccccaggctgcatgctctgaccaactaggggtctgcgcagactcagtcccttcccttgggtcccctggggcagaaatatgctgtctgctttcaccctgctctcccagcagtctgtctcccagcagtcccagttgctgccttcccgcctcactgctgactctcctcttctcgctcaggtgctgtacaaggtctgcaactcctttgtggagatgggctctgccaatgtgcaggccactgactacctgaagggagtcggtcagtatttccccgctcccagctggcattggaggtctgcctcccctgggttgctgaggccctcccaccccgcatcaggacagaagaggctattcgggttgcctcatctcctctatagagaaatggggtctgggaggggcttgccagggatcctggctctggggttttgagcccctgggagtgcggtgggcatcatccctcactccctgccaggcagcagtcttgtcagcccgggtagggtccgggccaggggtcatgctgacaacccactcctcccccagcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcgtgagttctgggggccttgcaggcagatagctgggagggggcactggagatggttgcccctcatagggacacaggcaggaacttcaggagtccataggtttccctgagcccttgtggtagtgggagcctcagactgtcctggggagtcagtaaacctcagcaatatttcaggagctgcccccagagctgtcctcagcaccctgaaaccctctgggtgtaggctgggctggaagtagactttaaggcctggggccaccagctctggaggccgcagcactccagaaggtgcattagagagcccgctagtcagagcacgttccttccaccttcccttccaggagacactgaatgggaagcctggagatctggactcttagcccagcactaccattcaagtcttcaggcctccctgggcttcagctctgagagtctgacatcctgtaatgggcaatgccccctcctgcagtatgctcaaaccctggaggctgagccccctggaacccttccccacttgccatgtctctccatcctctcccagggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggtattgctggcaccctctgctttcccactctccttcctgtcccgcccctccctgcagctcatctccctatctgagtccacatctttgtcaattcctaagcctcctcttgttgctcacctgtcccagcccctgttagacctcagcccagatacttggtcccatccggtcccacgtcctccactcccaacgctttgctcccactggcctccctcccgctgtaggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcaggtgggagtgcccacaaggctgggtagggagagggttgggcaggccctgggggagtcttggagcctgtgggacaggggcttctcttcccgctgggagatggagggccctgacttcccagaccttgagtgcagtggggtaggggtactgaagctgaagcctcattacggggagagaaaggcagcagggaactgaataggaatagggcagggctcacctcctgcctgtccatagggcttgaccatcaagccactggtcaaatggctgaaggtgaagaggagtgagcatcacaaacccaccctgaaccaggagctgcatgaacacgtgggtatcagaaccccagccctcgcctgtccctctcgaccttctcctattttgggcagagtcctgatccagtccccctacccaccccccttctagacttttgaccacattctggctgcagtggaggacgttgtggggcaccatggctaccactactggagggacaggtgagggagctgccccgaggctccttcagcagcagcagccccaccagccagggaagcatgggggatgtgccacacttctgagaagggacagagccaggttcaggctgggtgacctctgcctgaagcccttcagtggcatcccagtgctctcaggttaagacaaggctccccagtgtggcctgcttggccctgcatggtttggcaactgccagactccagcctcatcatgctctgctctgtctttgactgtctgcctgctaattccatggaccctgtcttagatcctcaggacccaccatgctcccccagcctggccactgggaccttctctgtactagaacactccttcacctccctctcacttactcagcttcgattcatccttcacaactcaccataggcttcaattccttagggaggacttccctggcctccctggctaggacgtatctgtgtcatattctctaattatcctttgtagttcttgtcatggttgcaattttacagtgatttgtaataatttcagttactgtcagcctttcccatgacattgtaaattccatgagggcagggactagccttgagattctctctggctgaggcccatatctaaaaagccaggccagtgctgacggtgtccttgccccgtctgaggaagggccacctggccaggccttgggaatgggactcagggccgggcctggcatcctctgtaggtgggagcagtttgacaagaaatacctgagtcagctgctgatgcgacgatcagcctaccgcatccgggaccagatctgggatgtgtactacaggcttaacatccgggatgccatcagctttgtggaccaggtgggccagcagcttccaggtgggccagtggtgggtgggcagatggtcagcagagcaggacagaaaggggtggcaagcaggctggccctgagcagggagttgggaattcctagctggctccatggtctggtgaagtggcagcggcaggaagcagctgggtctggtgctgacattcagagtctggcaggcagtccagagaggtgggaaacagctggactctggggtcagctcaaccattatcacttccaagcttgtgaccttgggtaagcacactctctgagcctgtttccttagctgtaagaaagcaggcataagaggctgggcacggtggctcacgcctgtaatcccagcactgtgggagcctgaggtgggtagatcacttgaggtgaggagtttgagaccagcctggccaacatggtgaaaccctgtctctactaaaaatacaaaaactagccaggcatggtggtgcatgcctgtaatcccaactactctggaggctgaggcaggagaatcgctaaaatctgggaagcgggctgggcacggtggctcacacctgtaatcccagcactttggggggccaaggcgggtggatcatgaggtcaggagttcgagaccggcctggccaacatagtgaaaccccgtctctactaaaaatacaaaaactagccaggcgtggtggtgggcacctgtagacccagctacttgggaggctgcggcaggagaatcgcttgaaccctggtggagtttgcagtgaggttgcagtgagctgagattgtaccattgcactccagcctatgtgacagagcaagactgtgtctcaaaaaaaaaaaaaaaaaaatccgggaaccagaggttgcaatgagccgagatcgtgtcactgcactccagcttgggtgatagagtgactctgtctcaaaaaaaaaaaaaaaaaaaaaaaatagaaagcaggcatacaagtacctatgttatagattttgtgaattcgatatgtaaagtgcctagcagagtacctggcatgtcaaaagagtaaactaagtgttcgttattattattttctttattacccctgactcctgggcaaccctccatctgattgctggctgaccttggtcttgacacctgcagggaggccacgtcttgtcttccacaggtctcactctgccttctatgcccagccgcaattctgtggcagaaacttctgtcaccaacctgctgtgagtccttgagccccttccccttcctcatactcctctccattgtgccctctctctgagtcccttctgggggagatttgtcagcaccttttcatctgcccttctcctggactgcctcctgccccctctccagcacatgtgtcccctgcctcctgcaggagggagagtggcagtggagcgtgtctggatctgcaggtgattgacacagtacgcagcggccgggatcgtgaggatgctgtgatgcatcatctgctctgcggaggcctctacaagccgcgccgtagggtgagagcaggcaggcatcaggattttgagggggtggaggtggtctgaggagagcttaagaggcagttggcgccagcttgttggagagctgcagatgcccagctaaagagtgtgggtttcagccgggtgcgatggctcatgcctgtaatctcagcactttgggaggccaagacaggcggatcacttgaggtcaggagtttgagaccagcctggccaacatggtaaaaatgaaaccccatctctactaaaaatacaaaaattagctgggtgcggtggcacatgcctgtaatcccagctactcgggaggctgaagcaggaaaatcgcttgaacccgggaggcagaggttgcaatgagctgaggtctcaccactgcactccagcctgggtaacagagcaagactccatctcaaaaaaaaaaaaaaaaaaaaaaagagtgtgggttttatctcatcagtaataagaaacctctgctttgtttttattttttggagaaagggttgacctaatacaagcactgtttaaggataccttctctggtagcagagtgcagatcaaattggagggggtgagttgagaagctgggacagccagttgggaagatggagtgaaatattgtggattagggctgagcggtgggaaagaagaggggcacgtaggcctaggtgattggctctgatggtgagaggaggaggagacagagtactgggggccttgagggtcactggagaatgatggagtcacagacagaagcaagagcactgaggaagcctcctagaccagcttagcctgtggaaggtgggcatctgttttaaataatggaagttagtccaatgcagatcatgaagctttgcgtctggaaaggcccagctcatccaggagagagtctgttgcaaccccacaagagggcagcaagccattaccttgcacctttctaaaatgggaagccagctgtcaccagttctggcagtttcaacagtcaaagctctttctactgttgaaacagaattggcctcctttaacttgcacccactggtcctgatttgactcttcgcagctctgcagaatacatcttccaaaatttcaagacagttccctttcacacaggctctcttgccctcaggccagaatctcttacctcctggtatgtcttctctggacttaaaaaaacagcgcccagaatggaagttgctactctagctgtggctggccagggaagggcctagaagctctgacaccattctagttctagaacttgctatttctcttcccacagcccaagatccctccagccttggctcaccaccctggggccccacattgtccttagaatctgctaaactcccaggtcttcctcagttaatggctggcagaccctgtctcactgcatcctatggggtttttaaaaaacctttcttattcaaaattccagtagaacgaataaaataactcatatttatctatcaaccagcactgaaaaatcagtgcatgatcaattctattacattctgcagccctaccacatccctcccacactttatcttaaaacaaactccagacatcgtatcacatcatctcaaaatatttcagtatgtctctctaggtggcaagaactcttacatccagtcagtattcaataaatatcttttccccgctggatgttcaaatcagggtctaaataagtccacacttagcatttgggaaatatgtctcttcatttaaaaaaatctataatagttctttttcccctctctatctcccttgctatttatttattgaagaagctggatactttctcttggagaattgcacattttctagattttgctgactgtattccagtggtgttgtttaacatgttcctccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtgtgtgtatgtggtgtttatgtataagattggtcaatgggttcagtccaatcggttcatgtgtagtctgttttttaaaaatctggaataagtttgtgtgtatcctgttaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcctccagactgacatggatcaagcatttttggggtatggtaactcaaccagttctgaatccacttagtatgataacacaatccacaatttctcatgttcttcatcgaaatatcattagagagagacagagatatctagttttcagttagaaagataagattatagtttaatagagagataagggctggagagaaatttggaagcaatctgtatcaggttttgtcacctggctaccacagaatcccctggggaacttcctggcttcacctggagattctgattctgtagtctggagtgggactaagaatctgtgttcttactaagttccccaggtgattcaaatgcagctggtctgatgactgatgttgggggaccacagatctgtatcactgggatagctggggcagagagaatggataagttctctgaggagagtgtttcatggggcgggaggagggctaaggataacactgaggagtgcgcatgggagaaaaggaaagagagccaaagacaaggaacccttggagaagcagtggcaggtggtgcctcaggcctggggcagaaagagggctggatgctgcgcagaggcctggccagcacctaggcagagcccacagcactggtgaccagcaagaaggcagcactgtggagttgtggaccctggagttgcatttctggtttttaaggaaatagtgggtaggagagaaagtgtcagaatcaaattataaaagtgtagcagcaaaagggagacaatggtgttcaagggaagactttctttaaggaggcaagggcaggagcttgaaaacagaggggagggagccaagtggtgaggtaaggagtgaagatacaggagagtggaggaataggaggcagcaggaactgctggaggcaggaaggagggaactgagcaatgtggaggccggggctgggcagcaatgagccttgtgaaggagatggaccccttctccccaggagagagggtacctcctggtgcataggtagatgaggagggcagatggaagacttgaagggggctcttagaactggttcagggaagcagaaaatatgagataaagggaccagacttgggatttgaggcaagataagatgatttggcaggcactgggaagcatttcaggggattaccactagatgatgaaaaggtgctaagcaaggagggtagaggcagaggcagtctaggtgagtgtgtagcgggcttggtgttgataagagttaaaaagagcatggccaggcgcagtggctcatgcctgtaatcccaggactttgggaggccaaggcaggcagatcacttgaggtcaggagttcgagactagcctggcaacatggtgaaaccctgtctctactaaaaatacaaaaattggccgggtgtgatggcaggcacctgtaatcccagctactcgggaggctgaggcaggagaattgcttgaaccccagaggcgggggttgcagtgagcagagatcgtgccattgcactccagcctgggtgacaagagcaaaactccgtctcaaaaaaaagaaaaaaaaaagcagatgatgggggtgatcctgaattattgggactgagaaggtccagggtgtcaggggagatagttatgaaagttcaaagtgcagcccaggatatcatggtggttcttgtagaaatggctagataggagattccagctggagaaaggatcctgtgtagctagaagggggcaggtaggctgggtgtgtgggcgaagctcagataaatggaggtacaaagaaaatgtcccccatgttgtcacagtagtagaacaagacagagggtcaccttcaaaccagagagaatcgggaaaggatggcaagggttggggaaggccaggtttgggggaataagttctgggataaagggaagcttttcccagggaactgagaacacagggtctctggctgggttcctgttgtattttttgttttgtttttcaatccattgttaattctggaaaagctgggctggcaggtcctgtggtgaatatgttggggctgtggcctggggttcttgtgggaggccaaggcatccatcctcatagccaggcggggctgtcattgccagtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggcatgtcttccctcagggactcctcttgggagctggaggctgacagcaagcagttttgagccccctagtgttaggatccagcttagggggaaccccagttgggacagtcctcaggggcttgatgactacagcagtttgggttcccttttagatgttcctggagtcccagaagggtaaggtgagaccttcagagggggagcagcctcttggccatgtggtcacctgctgggaggcagcagggccgcctaccaaagatgaaaaaggcaggagaaaaggagattcctttgaggggcaactccatgagctcctaagtcagcccacgctgatgcatccagatttcttactggggcatgggtcactcttgcctggttggccaagggatggtagaaccactgggactgacataaattccctcccctgctgggttaggaaaacttgtcctgttgaccccaccagatgacagggttggggtgggaagccggggccagaggctcaggttttctttcttggtcctcagaaggatggtgtggcgaatgctgaggctacaaatgggaaacatcgaggcctgggctttcaggacacaggcaagcagggagcagtgtgggattgaggatgggagggaggagggaaagggctggggcttgccagccagaatcctggaggacccgctgtagggtgcattcagcaccgtgacctggggctcttcctccagggacttgatttccaagttggaaatgttcaaagcagttattagacaatgcgtgacaggaggcatctgattgctaactatgggttacaggccccgaggacttggaaaatgtgtcatggagatgggggagtttggtctgggccttggaggatgggtggactctggggcccagtgtcctgtctgcaaagccaattttgttttgtttttttgagacagagtctcactctgacaagctagagtgcagtggtgccatctcggctcactgcaacctctgcctcctgggttcaagtgattcttctgcctcagcctcccaagtagctgggattacatgtgcacgccaccacacctggctaatttttttttgtatttttggtagagacagggtttcgcattgttggcctggctggtcttgaatgcctaacctcaggtgatccgcctgcctcagcttcccaaagtgttgggattacaggtgtgagccaccgcacctggctgcaaagccagttttgtatgagctgaatgttaatgggccttccagcaatccaagtgctcatgtttccagtggatcgtgggatttggggctgaaagaagaggatgggggagctggaaagtgtggtcctcatgacttcctccggggacttagcttcctctggtcgcttccttgggctccgcaatgtcagttctcttcctcccaagtccccacctcttaggccagtgcttgaaacagccagaggagaaagcaagtgtctctgccaacgtgtgttctgcctagggagacagggagctggcttggggctgtgtagtcccaacaggcagctgccagcccaggatgcctgactctgctcttgtctctgtccagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggtaatggcttcctccctgcccacctcccctctggagcaagctggtttcctctctcttcactcatggcctctactccagacaactcccttttcctattcactagtttattcatcagccagcatttgcagagcctcttcttcataccagatgcccgacataggtaatattcaaccctcacaacaaccaagatggggaaactgagcttagagagcttaagagacttgtgacttgtccagcatcacatagtagaaccagaatttgaacctgactcatctgactcccaagcccacagcctttctttttttaatttttaaatttattttattttatttgagacagagttttgctcttgtcatccaggctggagtgcagtggtgcgatctcagctcactgcaacctctggctcccgggttcaagcaattctcctgcctcagcctccctagtagctgggattacagacgtgcacccccacgcctggctaattttcatatttttagtggagatggggtttcaccatgttggccaggctggtcttgaactcctgacctcaggtgatccacccaccttggtctcccaaagtgctgggattacaggcgtgagccaccatgcccggcctattcttttctttttttttttttttttaaatgccattcttgcattgctataatcttttttttctttttcttttttttttttgagacaggatctcactctgtcacccaggctggatcatggattgcacaatggcatgatcatggctcactgcagccttgatctccagggctcaagtgatcctcccacctcagcttcccgagtagttgggactaccggtgtgcactagcacacccagctgttgtttttttttttttttttttttttgctacggggttttgctcttgttgcccaggctggagtgtaatggtgtgactcaggtcatggcaacctctgcctctcgggttcaagtgattcttctgcctccgcctcccgagtagctgggattacaggcatgcgccaccacacccagctaattttgtatttttagtagagatggggtgtctccatgttggtcaggctggtttcgaactcctgacctcaggtgatctgccctcctcggcctcccaaagtgctgggattacaggcatgagccaccgtgctcagcacccagctgatttttaaaaattgtttgtagagatgaggtttcactgtgttgcccaggctggtctcaaactcctggcagtcttccctccttggcctcccaaaatgctgggattgcaggtgtcagccaccgtgcccacccacaccctttcaaggccatgctgcctccctttgtagtctagtgaggaataggaggtggtgagcaaaccatgggctctgttgagacccatgccctcaagtagatccccaggtgaaggtggcagcctgacctggaggagcagcctgaattcatcaaaatggagttattgtggacaaaaatacagtatataagcatttttctgtatgtatagagacctaattcactcatattgttagtatcactggtggttggcaccctcaagtgtctttaaacattttttattatagaaaatttcaaaatatacaatgatagaactataaaataaactcccatctatccattatccagcttcaataattacctactcatagccaatcttatttcacctaaacctcacctatgccccaccctccactgggttcctttgatgcaagtctcaaatatcatatcactttatcaataaatacttcagtacatgtctctaaaatataaggattctttttttttctttcaagatggtctctctctgtcacccaggctggagtgcagtggtgcgatcatagctcactgcagccttgaatgccccgacttaagcagtccttttgccttagcctcccgagtagctgggactacaggcacacaccatcatgcccagccttttttttttttttttttctggtagagatgaggccttgttatgttgcccaggctagtcttaaagtcctgagctcaagtgatctttacttctcagcctcctaaagtgatgagatgaaaggcgtgaactaccatgcccagccagataaggatttttttttttttttttttgagttaggatctctctttgacacccaagcaagagtgcagtggccggatcatgactcactgcttcctcaacctcttgggctcaagccactccacccggcctcagataaggattcctgatgcatgcctctagtcaattgaccccaggaggctgaggctgcagtgagctatgatcacgccactacactccagcctgggcaacagaacaacactctgtctcttggggaagaaaaaaggattctttaaaaaatatgtaaccacaatgcctttcccatatctaaaaatctgtcatcaaacatcgttcaaatttccctgatatatatatatatatatatatatatatatatatatatatatatatatatatatattttttacagtaggcttgtccaatgtcccttttaacctatagcagtgattctccagggggatggtggtggagtgattttgctcccccaggggacatttggcaatgcccagagacatttttggttgtcacaactggggaggatggccttggatggaggggtagaggccagggatgctgctaaacatcctacaatgaacaggacaaccctcaccagcaaaggagtagctgtcccaaaatgtcaagtgtcaactttgataaaccctgatccatagtttcccccaaaccccctacttttttttcttcacgatgtatttactgaagaaacctgcttatttgtcctacagtctttctctgtctggattttgttggttgcatccccaaagtgtcatttaatatgtttctctgtctcttaaatttcctttaaaccagtaaatccacaggcagtggctcacacctataattccagcacttcgggaggccaaggtgtgcagatcacctgaggtcaggagtttgagaccagtctggccaacatggtgaaaacctgtctctactaaaaatacgaaaaaaaaaaaattagctaggcatggtggtgggcacctgtaatcccagctactctggaggctgagatgggagaatagcttgaacctgagaggtggagactgcagtgagctgagatcgtgcctctacactctagcctaggtgacagagcaagactccatctcaaacaaacaaaaaaacaaaaaacctcgcctcatcaattatttggttactttgaggtacagttcacccagtaaatgcttgattctttcatttatcagttttcagaccaaagaattcattccctagcagcctgtaaaggtgaataccaaaggttttttgttttacactttttgttgttgttatcgcattttaatattccaggtctttcaagagataccattttacttttaatcatagcatcaatacatttcacacatgtactcaaacagaagcttattgggctgctcaggactttatcgatgaacagatacaggctgtactgtactttggagagctggggtggttggtggccagaggaattctctttccaggtttcctccttcagaacctcagatttcctgtaattcagccccgcccctgcagttctgggattcttagctcaggtcccctatgcctcgtcatcccctttgcggcaaagctctggcctgctgttaggtttgcatgagctcacactcctgggctttgtcccaccaaagggctgtggtgggtactcaggcaggatgctcagcagaaaaacctttggcctgtagcctccaggtctttctttccctctctggtggctggcgtttctccctcgctggttggctgggatggggcttggcaggaggctgtttcagagaccagtgctgcagtagggtgaggggactggagatggggcttcctgcctggctcctgcttttgctatcttcttattttttatttttatttattttttatatagagtctcactctttcacccaggctggagtgcagtggcgagatctcggctcattgcaacctctgcctcccgggttcaagtgattctcttgcctcagcctcccgagtacctgggattacaggcgtgtgccactgtgcttggctaatttttgtatttttagtagagacagggtttcatcatgttggccaggctggtcactaactcctgagctcaggtgatccaccaccttggcctcccaaagtgctgggattacggcatgagccataagccaactttccttattttcgtttctttgatgaaaataatgttcaatttcttgagcaactactgtgtgcccggccctgtgctaggtgttggggatagagtggagagtaaaacaagctgtggtacttcgcctcagcaagacattcatccgataatcgcaaaaatggacggcatatggaaactgtggcatgaatttataagaatgtgcttatacttgagatttccactgtattggtaatgagttcatgtgtactctctgtccccaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatggatgggtgtcttgtgtccatgtgtcagggggttcttagggtggggggcaacaggggcatctggtgaaggaggtgagaacccaactgcctgccccagggattgagaatggaggggaatcctaggcaggactattcatccttctggtcccctgtcatgcattccccaatacttttccaatattgtccccttagcaggggtcctgcagtggtggtcaaggggatcactgttttggcatcgagtcacagaactaaaagtctgcaaaatgagaaaggctagcagggaaagaccccagaggtcaggtgccaagctgtcctgatgcagccaccacacacctaggaccagatgagcatttcttgaaaacctggatgcaggtacaggacacatgaacagaggtggccttttgcacatgacagacaggaaggcaatctcaagggctcacgggatttggttaccgtgtttattttttatttttggagacaggattttgttctatcacccaggctggagtgcagtgtcacaatcatagctcactgcagcctggaacccctgggctctaggaatattctcggcacagtctcccaagtagctaggactacaggtgtgtaccaccatgcctgctaaatttttagtttttgtttttattatatttatttatttttagaaacaggatctcactctgtcacccaggctagagtacagtggcatgatctcggcttactgcaacctctgcctcttgggttcaagcaattctgcctcagtctcctgagtagctgggactagaggcacatgccaccatgcctggctaattttttgtatttttagtagagacagagtttcaccacgttggccaggctggtctcgaactcctgacctcaagtgatctgcctgcctcagcctcccgaagtgctgggattacaggtgtaagccactgtgcctggcatatatatatataattatatataatatatataataatatatattatatattatatattaatataatatataatatatataatatatattatatataataaatatataatatataatatatattatatataataaatatataatattatataattatatattatataatatatattatatatattatataatatatatatttttttttcctggaggtagggcctcacaatgttgctcaggctgttcttgaactcctgacctcaaataatcctcctgctttgacctcctcaagtgttggaattacaggtgtgagccacctcacctggccatctctgagtgtttatgatgcaaatcagatagtgtggggtccagaaacatgaatagaaatccctagatggccgggcacagtggctcatgcctgtaatcccagcattttgggaggccaaggtgagtggatcacctgaggtcgggagttcgagaccagcctgaccaacatggagaaacccagtctctactaaaaatacaaaattagctgggtgtggtgacacacgcctgtaatcccagctactcaggaaggctgaggtgggagaatcacctgaactcaggagaatagcttgaacccagaaggcagcggttgcagtgagccgagattgcaccattgcactccagcctgggcaacaagagcaaaactccatctcaaaaaaaagaaaaaaaaagaaaaaaaagaaatccctagataagagcagtcccaaatccaattcccctggtgtctaaaggacttaaaacaaaaacaaaaactttggcccagcacagtggctcacgcctgtaatcccagcactgtgggaggccgaggcaggtggatcacctaaggtcaagagttcaagaccagcctggccaacatggtgaaaccccatctctactaaaaataacaaaaattagccaggcatggtggcgctcacctgtaatcccacctactcgggaggctgaggcaggagaatggctggaacccgggaggcagaggttgcagtgagctgagatcgtgccactgtactccagcctggggg

SEQ ID NO: 15538 - DNA, 9133 bp, Human; identical to SEQ ID NO: 11961

SEQ ID NO: 15539 - DNA, 7833 bp, Human
agctgggatctgaagcccgggcggacctaggagtggttctagcctcagtttattcctcctgggcagccatgctcagcccagagagctgggagaaccaggtggtgggagtgggggtgtctcaaggttgtgtcctggtgttaatccctggggcccctggccatatctagcttgtggtgagtgtctctggcctgttggagcagccactggaatgcctggggcttgagtggccctttgtggttgcagttcccttggcaatgaagaaacactgctgaggtcaagagctcagattgccagaggggaaacccagccctccttctttgcatggccccctgctgggaagggccacagctaccccccaccctcgccctctgccagacacccagaggaggctctttccagtggcacagtcatggggttggagggggcacaggcagcccagccaggattcctcatgggaagtgtgtggtggctctttagacttgcctgctaacgggaggctctgcccataacttcctcttcccactggagttcgttcaggaagccagaaccagcatggggatgctcaggcctccaagatcccctaggaccatgggcaggccacccctcagcccagcttttgcctactttgaagacctcaaggacaagagggccctaatcttaccgagccaggccctcctcaatccaaggccttcttaggcgttgccaaggaaactgatgcagcagccaaagagcctggcccaggtctccatgacaacctaccacagcccaccagggtccatccatctgtgatgtcacctgagccccaaatggatgccctcccacccccaccacacttgtcacaatcagatgtcacagtctgatagcaggtccctgtcacaaaatacctcacagcctgacctgcaaccctcagacccctgagagatgagcagggagctaagacactcctcatgccttgaccacaccctgtgtttatgccccttttgggtgggggcctgaacctccaggccctggatgtgccctgggtggctggctcagcctacagctagagggaagaagggagaccttgacgactcgaagtggctggctcctgctggcattcaacacccattggcctggatttccccaactctgggcaacttccagtccaggagcagaataaccagagccacggccagggccagggctggggcagattatttatttttagcagagttgctggcagctgcctggtgggtgctgggaggtgggatggggactgagtttaatcccttccctcttctgggctggggtatcctccccagggttcaagcaggcatctccacctgcaactctgtcagagctgcccccacccccaacagccctctcagggcccccaggggctcatggggtgacaccaaccctcacactgaaggttaggctcattagggagaatcttcaactccaggatggggagtggaaaggattttgtgtgaatttaggacaccccctaaattctagctcagacctgagcctatggggagtgggtgtcatgggcagagaagggggatctctgtccagcctgtaactagcttacttgctaaaaggacgagccgggacttggggagaggaaagggagaattcagtctcacggggccagaccgaattcttctccagagggcagttgctgcttttggctgattgggtttaccccgctgcctgcctccccatcacgtactccccccgcaacctcgctctctctctccttctcacacacaccctcagctccggacctcgcctaccggtcagcccctctattcccagacagctaccgctactcccctggcgggtagggcggggtgtcggggatgtaaggtccgaggaagagggtgggggattcccctggtgggggtggacagacacgtcagcccccgcagcagcgtggaccgggggcgggagcgggggcgggtggaggcttaaataggcggctctggagccagagcccagtgcgggctgagaaggcggtggctgcagcagcagcggcggcggaaaccctaaagtccgagtccggactacgagtgcgtggcctcctaatccggatcctagtcctgagcgtgtctgtgtgcgagtgggtgagtgtcctggcggagcggggtcggggcggctgcagatggatgcgccaggtccggaggggtcccgggtgagggcgccgcgacctgggggctgggggagggctgcggcgggacctcggccggagcatcccgcctgactccgggttgggcaggtgcgccccgggtcccgcctccctcgcggcttacacggccactcgggttcctgatcccctagacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcaggtgaggggacccagctgttcaggggaggggcgatcccggggctaggactaggggctgagaccggtactcaaagccgcaaataccgtggaattatagttgttgttgttgttattattattattattattattttattattattttgagacagagtttcgctctttttcccaggctggagtgcagtggcctcgatctaggctcactgcaacctccgccttcaggtttcaagggattctcctgcctcagcctccagagtagctaggattacaggcgcctgctaccacgcccggctaatatttgtgtttttagtagagttggggtttcaccatgttggccaggctggtctggaatttctgacctcgtgatccgcccaccttggcttcccaaagtgctgggattacaggcgtgagccaccgcacctggccaatactgtggaattctattggcgctttcagaatcatgcctctacctacccacttcataaatggggaaaggaaaggagaagggacaccccccagcctttggtagggaagaaatgcccagagtagaaggccagggcatagatatggctactctgtgggatgggactggacatccctccctgcctatcagggacaggtcagagtttctaaccagagggatttctaagagaggagccctaggtggccaaggtccccagggggggcatgtgggtggaggtcaggcacaccatgccctccagcccccacttccctgcctggcactgctgttgccacataccagcatctgcaagtggagtggagggtaaggagggctctggggaagagttggagggtgtggccagaacaggaaacctggcagcagcggctttgacaaccagctggtaacctgtctactggccttctgcctagggcacacctatgatcgctccattgtagtggacggagaagaggcatcactcatggtctacgacatttgggagcaggtagggtgcaagcagagacccagggcaggggagggaggagtgagttgggttagaggtctgggagtgccaggctcgtgtcgggggcatgaggactgttgggcagatgtgtgttgtgtgttctccaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatggtgagtaggcggcaggttgcagggggagggagagcccagctgggccctgatccaggcagtcttggctcagcttgagtccctggggatcatcagaggctaaaaatgttcagaaagaaaactggcggggagggaaatgggagagagctggtgcctgctcacagggctccggaaggccccagagggctggggaaagaaccaaatctgataggggagctgggcaccgcagggccctcctctcctgcccctcttggtcctggcctggctggttgggggggtaaatgggtggaagagagtgtaggggaacaggccaggaggtcagagcctgtgtgctaggtctgggccattcttagagtagacttggccctggggaagacccttcccacttggcctcagcatccttttctgtggaccccagtactgagcccctcagaggaacccagcagtgacttggtgaccttgcctccgcaaccccagtccactggatcattcatcatgatataacctcgaattaaaaaatactaagttgtgcggggcatgggccagggggtggctaacgcctgtaatcccagcactttgggaggccgaggcgggtggatcacgaggtcaggagatcgagaccatcctggctagcatggtgaaaccccatctctactaaaaatacaaaaattagccgggcgtggtggcgggcgcctgtagtcccagctactcgggaggctgaggcaggagaatggcgtgaacccgggaggcggagctttcagtgagcagagattgtgccactgcactccagcctgggagacagcgagactctatctcagaaaaataaaataaaataaaataaaatactaagttgtccaacatagttctcattttcctgtgtttactactgtcgtactttgtttaaatatcaggcttcaaattatttcaataaatggatctccttttgagggccactgttttgggggctccttaaatgcaggcactctgcctactgggtgacgcagcagtgcccagtaccctcagtacaggagctggggtctctgtgttttcggggaggaccttgcaaattctcgagtggcagcttccatgggtggccactgttggaggggactcctcattcacccaccctttgtttactggtgcctgcctttccccacccacacagagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgatagtcatggctgttgactctctttcctcctatctgggcgcttcaggagctggaaggatttctgaagttgagggatgggggctcactgccccaccctagtgtgtggccatgatgtgttaatgtgagggtccagatttagccagctgggatgggcatcgggtctggttagaggttcaaggagcaggagacacaaacccctcccagtccctgttatccagattcttctctttctgcactggggcctggcgttgcccaactgattgagggttcaatcacttcactgtccataaagggaaacaggctgctcaggggagcacattctgccctgggtctcacaaccaggcaggaaccctgggtctcacaaccaggcaggaaccctgggtctcacaaccagacaggatctggctccacagctggtatttctgccctgttccctcttgaggggctggaatcagctgaggttggggatagagacctccgaggggtggtttgtgaaggcacacacagctccacatggctcctccaccacttcactggggttgagctacggaggaggcactcactgttctctctaccatgagtatccaggccagaacattccatgctcagcattggctaattcagttttggtgggaacagctgccgggagcccgccctgcctggaatgagaggtcttgcatttgtataggaaggtgtactcgtgcttatgtttagggatgcacctgtctccctgcccacccatgcccatggctccctcaccctcggcacaagtgctgctaagagtttttatctacatggtctcaggaaaaaccatccccatctggtgctgggtgggaagtggctgagtggggactggtatacaggtctgcccatctccaaagcctggaggcagcctggggcgaggtggggggcagtttctaagaaggttctgggccaaggtccatacattccttccttagttcaatttattcaatttattcattccctcaccctcggcacaagtgctgctaagagtttttatctacatggtctcaggaaaaaccatccccatctggtgctgggtgggaagtggctgagtggggactggtatacaggtctgcccatctccaaagcctggaggcagcctggggcaaggtggggggcagtttctaagaaggttctgggccaaggtccatacattccttccttagttcaatttattcaatttattcattccacagactccagggagccctggcaacctggttagaatcctgattgcagcttattgaatggcaggaggaggcttgagggctgcccctccatgtacaggggagcgctgagattcacccacgtgctccccagggcagaggtaactgctcagagctgttgctgctctgcccctcctccccacatacttcaaggaatgcagaaggcatggtattttcagatcaagtgagggtccccaggccttcctggctctgtcacttattgactgtgtgaccctaggcaaaccactcagcttctctgtgccccagcatgtgcccaatgccccttcagaacgcagtatgtggcataatgaaggtatgtgctcagagcagtgctgggcacagagcaggagcttaacacgtgtgaaacccccttcaacctccccacactacactgctccaggctgggtgccagagtgaccctgaagcaggcactcagcttgtgacaaggctgggggcagctgggggtagcttctggcctgagagagactaatcagatgtacagtgggaaggacttcgtggggaccatgggaagctccaaggctggagagggactggagaccttcttcccaccctctcccctcattccagactcccaggccccagaagcatctcctggctctgcttggctgccctcattgcggggagagcccctgttcagccctgcaactccctcaaggtcacctgagccagtttaatcttcttaggggcatgagactgcccactgtctcagccctgtcactgttgagtggccagt

SEQ ID NO: 15540 - DNA, 14673 bp, Human
caggtctgcccatctccaaagcctggaggcagcctggggcgaggtggggggcagtttctaagaaggttctgggccaaggtccatacattccttccttagttcaatttattcaatttattcattccctcaccctcggcacaagtgctgctaagagtttttatctacatggtctcaggaaaaaccatccccatctggtgctgggtgggaagtggctgagtggggactggtatacaggtctgcccatctccaaagcctggaggcagcctggggcaaggtggggggcagtttctaagaaggttctgggccaaggtccatacattccttccttagttcaatttattcaatttattcattccacagactccagggagccctggcaacctggttagaatcctgattgcagcttattgaatggcaggaggaggcttgagggctgcccctccatgtacaggggagcgctgagattcacccacgtgctccccagggcagaggtaactgctcagagctgttgctgctctgcccctcctccccacatacttcaaggaatgcagaaggcatggtattttcagatcaagtgagggtccccaggccttcctggctctgtcacttattgactgtgtgaccctaggcaaaccactcagcttctctgtgccccagcatgtgcccaatgccccttcagaacgcagtatgtggcataatgaaggtatgtgctcagagcagtgctgggcacagagcaggagcttaacacgtgtgaaacccccttcaacctccccacactacactgctccaggctgggtgccagagtgaccctgaagcaggcactcagcttgtgacaaggctgggggcagctgggggtagcttctggcctgagagagactaatcagatgtacagtgggaaggacttcgtggggaccatgggaagctccaaggctggagagggactggagaccttcttcccaccctctcccctcattccagactcccaggccccagaagcatctcctggctctgcttggctgccctcattgcggggagagcccctgttcagccctgcaactccctcaaggtcacctgagccagtttaatcttcttaggggcatgagactgcccactgtctcagccctgtcactgttgagtggccagtgtaaggacttcgggagctcataggctgctgcactcccccaccacaggtccccctggggggggtggtctggagccccaatacccacttccactcatgtactgctcacccatcctttgcaacctccagctccttgtcttagttccacaagccatgcggagctgccagggcagaatgagagccaggtcattcctgagtccctgagttctgctctcaaagggctcccaatctaatggaagaggcagacaatgacaagctggtgtcctctgtgtattaatagagatagcacatggcatggtgtgagggggaggggcattcccagaggaggctcctgaacaagcctgggaacataggggaagtttcctggaaaaaggaatatttgagctgagcactgaagcatgcatgagcaggtgcttaccacacagatgaatgagtgggaagggtgttccatgcaaaaggaacagagtgtgaaaaggtgtggctgcagacactggagcctgggagataagtcagaccaagtctggagccacagaaaaagtaacgtccagaaccagagggccaaggaatacctcctgggctgtgctggggtcgagggagtgccaggccaaccatctccccacctcctggagctggcagtcacggatgctgagcagctcctggctttccaaagtcaatgagtaacttggggggctgggcggggccaggcctgctgctgtgggcccagtggccttttccactcctgagcaagcgtggctgaaccctcctacctgctcaagtgccctgccttgccccacccagcccagcctggccagagccccctggagaaggagctctcttcttgcttggcagctggaccaagggagccagtcttgggcgctggagggtgaggggctgggagtggaggggagggcatggctgaggctgaggttggtggtggggaaaggagaaacactgccctgtcctcgccatctgggaaagaattcccagggcctcatcttagaggggttgtcgatttgtcgctgctctgcctgcccagctccatgacaagggctggaaaatgatgagacaagggccgggctcctgctccgggggttctccttgtctagaaggtggcagtgggaggcaggacagtcccagaggccctgagctaggaggactcctcctgtggtcaagtcctctgtgaccttggccagaccccagcattcaggccttgcctgcaacaagaggtgacttcaggaagtgaccctccaagtcttcaggaactttccagcttcaaacttttgtgatttgggggattgctagaaaattaccactttgggatctgcggcctggggaggctatggtgagaaggagctggaggtctggaggtgaaattctgatagagtgcttgatggaccaagagcctagaagcagggtggctgggcctgggggccttggtgggcctggccgaggagcagggcactaccctgcaggagatggagagcctcagctcctttggaggggaggaagagaagactagtctgcagtacgatcccactagttgtgtgtgtgggatggaaagcccctccctacccacctgggctggatcctcactgccgtgtccctcaggcctgtcctgaccatggtccctgcctggctgtggctgctttgtgtctccgtcccccaggtgagctaggccctgccccctctccttcaggtcttggctttgggggttgacacccttgcccccaactccacctggaccaattgcactgaccgtgagaacggtgcaaggcatgggaggggtcagagctgggactatagagccactgtgggatgaggaggtcaaagaccagagcgcgggtggatggactaaggtacagccaggccctgggaaggggcggaaattccgctcttctgttgggtctcagtgcccacgcaggaagatagagcctggtgacaaggtgagaatcctcccacaggctctccccaaggcccagcctgcagagctgtctgtggaagttccagaaaactatggtggaaatttccctttatacctgaccaaggtgagccggagagctggggttggggccggggggatccctccccgcaaagtcctgcttctccttcctctggcacccttcctcttgctgtttctctttgaaatcctgctttccagagagtatgtacacgttacacaggttgagtgtcccctatctgaaatgcttgggaccagaagtgtttcagattttggatttttttttttcttcagattttggaatatttgcatatatatcatgagatatcttggggaatggaacccaaatctagataggaaattcatttatgtttcatatacatcttatacacatagcctgaaggtaacgttatacatttttttttcttttgagacgaagtttcgctcttgtcgcccaggctggagtgcagtagcatgttctcagctcactgcaacttccacgtcctgggttcaagagattctcctgcctcagcctcctgagtagctgggactacaggcatgcaccaccactcctggctaattttttttttttttttttgtatttttagtagagacagggtttcgccatgttggccaggctggtcttgaacacctcacctcaggtgagccgcccgtcttgggctcccaaagtgctgggattaccactttgggatttgcgagctggggaggctatggccagaaggagctgacagtacagaggtgaaattccgacagaatccttgagtggccaagagcccagtgtgagtctgctcctgggcgaatatttttaatgattttgtgcatgaaacaaagttctgactatgtgttgactgtgacctgtcacatgaggtcagatgcggcattctgtacttgtcacatcatattggcgctcaaaaagtttcagattttgagtatttcagatttcagattttcgggttagagatgctcaacctgcagtgggaatgactaacagattttaatcctagtggagagcagagctttagattaaagaacgaaatctcggtggtgaggtttcaagcttcagaaagaagggcagagagttttggggagcatcaggtccagggaaaagagttctggctctgagtctcagtcctgatgcttactggctgtgtgacctctgacaggagccagatgtctctgagactcagtttccccacatgtaaaatgaggccatcaggtggaggaggggcatctcccaggcctggccaccgctcccttcacttctgttcatttccatcagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtatggctgggccaggtgtaggggagagcaggcaaggcagagccagacgctgactccccttccctgccaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggtgagtgaccagggcagccaatttacagtaaggtcaggtgggccttgatggaacagcagagagcgaagagatggccagacagttggcataggacagggcagccatttctgtcccatttcttttttcttttcttttctcttttttcttttctttttttcttttttttgagatggagactcactgtcacccaggttggagtggagcgcaatggcgcgatctcagctcactgcaacctccacctcctaggtttaagcaattctcctgcttcagcctcccaagaagctgggattacaggcacccgccaccatgcccggctaattttttttgtatttttaaaagagacggggtttcgccttgttggccaggctggtctcgaactcctggcctcaggtggtctgcctgcctcagcctcccaaagtgctggaattacaggcatgagccactgcacctggcccatcctgtaccatttctgtcccaccttgttcctccctactccactgagggtgccatccattcttggcttcagtttgctcatctgggaagtaggacgaaaagccgtggctcatctccggagtcctgatgtgataatggatagggaagaaaggacagaggagaaataggagaggcatgggagactctccccaccctctctatcccttacagtttgccctcccaccgtgaaccaggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaagggtaagcccgagcggggtgtgctggggagggagggtcagagaaagctggagaaggtggtatctgaaccataagacaagcatgggtgggagcttgagaggtaaaaagggagggaagggcactctaggtggagacagcaacaaggcagggggctgtggaggcagggccaggcatggagagctaggaaatggtgtgaatggagggcctcagctccacactccacggagacctgggcctaagggacaaagataggaacagtctaaggggttgtagcctaagatgctgctgggcaaccttgcgactgatggcggaagagacctggacctggaagctcagaccagaggcatgaactagggttggaaagaaaagtgaatcaggcatcatcatagccagccacgcattcacccgtctaccgcccaacaacctacacagtccatccaacctcccatcactcatccaaacactctcctattcacacactcaaactcccatccacctaccaagtcaaccacccattcatccaaccaacccatcatctgccatctacccatctcctcatcctggtcatccacctacctctctagtctatcacgcattcgttgtgtggagagatatggaggtggctttgcaaactgtcatgtccttgttggaggctcacaacagtgcttaaagttcctctcttcccttggccaagagagtgtcccaatcacctgctgtatgcttggttttgtgtctggtatcttgctgagaatgatgccctggcccctgctccctggctgcctgctcagctgaccatcctccctgttctagggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtgagtaagtggctgtcagtggctgaagcagccccatggatggtgcagccaggcccgagtctcatggatatttgggggctgggtctggaaccctcatgacccgtgctcctccctccactcttcccattacttcccactgtggactggggtgttcaaggccctggacgcaggcccacagcccctcgcctgctctgccatcctctagcaggcgtgactctgtgctctgacctcttgaacttgcccagggcttcctcagagagaacagctgccatctcttgctgccatggggattgtcaccccgggccaggaatgtctcaggcctcttctaggaatgccctggggtcaggcccaggctgagagggcagaaaataaagtaacatggtcactcaagcactttgggcagggtccaggcttggatcagggcaaggccactaacaacatgtgccctgaacagaaggatcccacctggactccaggcccagggagggcagcaccttgcctgggtcacacagttgggctcaggctcctcaacgagaaatcagatggggcgcaaaggctgacatggattgttcctgccccttggcccggggtgtcccccccaggtacactggagtgggggtgatgtgcactatcacctggagagccatcccccgggaccctttgaagtgaatgcagagggaaacctctacgtgaccagagagctggacagagaagcccaggctgaggtgatatgaagggggagccagggatgcaggctgggggtgcttggtcagtgtccagttggcttttgggggtgtcacaactacaacagaggctgaggcagtgggaaagagccccgaagagctggagctggcccaccggaaggaaactcagagccaggcaaggctggagctgcccttggtcctgacctgaagccccctactgcccaccgcagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtgagctacaggatgggagagggacgaagtctctattaaccacctggtcttgctcttctctgggataaggacccagcctcaggcccccatgtcaatgtccctccataacacacacacacacacacacacacacacacacgagctcaaattcagtttagtttggcacaaaataaggagtgggtggggtaaggtctccaggctgggctgtggtcctatccaggcgggtgctgtcttggcaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggtaagtgccctgattggtgacccaggccccctgtcccctctgttcctaccctgacctcaccaacacgtccacctctgccctaggcttcagcagcacgtgtgaagtcgaagtcgcagtcacagatatcaatgatcacgcccctgagttcatcacttcccaggtaagcagacgcaggggagaaggccttgggaaggatgctggtggggggctcaccatccctcctcctcctccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaaggtgagggcctgggtagctgggaaaggggcccacacatgcacgcatgcatgcacatgtgccttgcccaggcccgcacagtgacctgggcctcctggttccagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggtgagctaaaatcccagccccttacctggactggattgcccctgctccctggggatgaccccagggcctcagaggggactcacattatctgtggcctgcaaaatttctcaaactatggcaaatgccaaggttgtgactcctggcagggatcggggctggatggactgggtggggcatggagaggggtgttttggaccccatgagagctcagattatgcctcagcacctggagggaggaccaggccctcctccaatgccccccaacagattgcagacagacaaggttgttcatagactctgattcccttgcagggtgacctggagtgagcaaagttgaaatgggcctcccaggctctaagagtttctcccttacccacatgatctgttcttcatcccacacccaccaccaccaccacaacaaatcctgaagctggagagagagactgggccccccaggctttgctgtggcccctgagtcacagagagggtgtggaatttaagcaagtcacacagccctgggggattctgagcaaaaccctatatgtagtcccagtacctcctcacctccttctttgggcggcaggttctccctagtcaatgactcagagggctggctctgcattgagaaattctccggggaggtgcacaccgcccagtccctgcagggcgcccagcctggggacacctacacggtgcttgtggaggcccaggatacaggtatggccaggcagtgatgggagcccctgggagggggtacaaacctcagacagacagacagcaggactgagcttcctcccagaggccctcactggcaacccccagccccaagcaggagaggcagatatgaagctgggttcaatgttcctctctgagaatggatctactcctccggtgggcaagtctggcatctgcctcccctctctgatcattctcctagattgacacacaaaatctcccagccctgtcctttagccactggagggcctctcagggtgtcagcttcagggactggtatagggccggggaggtggcaggaggaccaggggctgcccctggggaaggagtgctggagtgaatgggccactggagccaggtgtggaggacactgaacactgctcaggacagagagctggccctggggtggggagccccgggaggcaggtttcaactctgagctgggctgtgatacagggcagacccagcagcagtgagctccgccaaagtcagggatgtccacagtggcatggggatgatgacaggtggagagaagcatggagggagcatggcaggggagtctataaggcgaggctcatgggctgcgggagcagcccagggacctcagagctcaccctccccctggcaacacctggccagctcagcactgcctcctctgcagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggtgtgtggtggggaaagggagggaggctgtggccaaggcagggagggggtgtcacttggaagtgagatacccttctaccatgggggtggggctaggcctagggggagcagcccccagagggcctgtccaggctggtgaccctggtctttgcctgctgtcccaaaaggttcccatgcctacctcaccttggccctgcattgggtggagccacgtgaacacataatccccgtggtggtcagccacaatgcccagatgtggcagctcctggttcgaggtgagattgggcttgggtgcagcctgcagttcctgagggaaccgctgggatgcaaggggagggagctggtacacatgcatacaggctgctcatgtggacagcacatgcctgtgcacacttgcacacctatggctgggcacacatacctgggcacacaggaacaggcacagaggcacatacatttttttttgagacagagtctcactctgtcacccaggctggagtgtagtggcatgatctcggctcactacaacttccgcctcccagattcaagcaattcttctgccttagcctcccaagaagctgggattacaggtgtgcaccatcatgccctgctaatttttgtatttttagtagagatggggtttcaccatgccagccatgaactcctggcttaagtgatccacccatttcggcctcccaaagggctgggattacaggtgtgagccaccacgcctggctagcgcatatatcttcacacacatgtgaatacacacatgtgcagaaacacacacatatcagccaggtggctgggctgggggctctgagcagctggggagccctcccctccctccccttaccttcctcccctctcccctcagtgatcgtgtgtcgctgcaacgtggaggggcagtgcatgcgcaaggtgggccgcatgaagggcatgcccacgaagctgtcggcagtgggcatccttgtaggcaccctggtagcaataggtaatggaggttggacattacctgcgtgggcgagggcgatgggtggttgggaccacagcctccaaataaacacctttgtccccatggtgcccctagctctgaaaaaggaagcccccaactctcctagtcattatgcgcctgccctttgatcatagtcattgtcatcatcattgatagtagcatctacggtcacatgattgcacattgactgtgtggcagggactattgccaggaatcctcccagcaaccctgtgaggtagatcctggtatctccccattttgcagatgaggtcattgaggctcagagaggttaagtgactggtccaaggttacacagtcaggttgtgacagaacccaggtctttctagcctaattgcatcagtctaagccaccccttctatcccctttatttctttagcccctcaaattttctccttgctggttttccttgctggttctagcacactgctgtgatgagcctttctcttggaggtccatggagttgggatccaacttactggttccccgatgtccccaagagaaggggactttggaggctgagtatactgggtcagcctcagaggggtaggggccaagccggccgaggagtcaagcttctccaggcaccaccacagagtcatacccagcccagcctcaggatgctgtccaggaaactcatctcttcattaatccaatgccaatcacaggaagtccctcgtgatgaacaagtcccacagccccttctgaggcctgatacatccctcttgggccccacaggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtatgtctgtgtctcagtgtctatgtgtgcatgtgtgtgtgtgagtgtgcacacacctgctttttcatcccttccccatctcctgccacatagaaagggtctgggcttgaaggacaagactgaggtcccctgcagggaaggacatgaagacatcatatgggctattggtgagagcttggggccacagcaaagtgggtcatttttgtgggcatccagagcccaccagctacagaccctggatgggtgaactctatgcaggtgatggtcaaggaggggtgtctttgagggtgtcatctctgtgttttcctggatgtcatctttgctatgggaaggcaaaaccttgtgagtccccatcttctgctcatgtgtgagcaccttgtgctcctgtgcatgagtcacctacacccagggatgggcagaggcccctcagtctctgcagggccctgggcaggatggtgaggccccatgggtcaggagcatgtgaggtgaggctggggatgcgtccttctgccccagtgtaggctccaaggcactgctgtgtttcacacacaggctggtgagtgcatgagggcatctgcaggaaatcagagaaggggagtcacttagatggagacaatcggagcgggacaggcacccccgtggcttactctggagctgcccctctctgaggtgaacccctgaccctggcccaagattaagccatgtcctgatgctctgctgagcccggctgagccctgctaagtaggagctgagctctccagattgacctctaatccctgacctgtgggtgactcaagatacatgctgatccccatgtccccttctcaaccatctctggggagtcagggtgggacttgctgtcccaagcaccatgagctgatgatggtcaatcacgggaaagggagaaaaacaacctctgtggggcccaggccctatttttaggagataatctctccactattggcagattctgtgggataggggccaagcccagctaagagagacagggcgggcaacctggcaaagactcagccaggatccccagcccaggggttggactctgaggctggcccctgtcatcctggctcaggtacccccactggaggctctgctggctaccctcatccaggcagggattccctgcccctctgccaggatatcctctgctcagcctgcatgcactcagaagtcttcagggtgcaaatcttctggaggtagtgtctcatctaatcttcctatcaacctacgagggtggattattggccccattttgcagtggaggatcttgaagatcagggaggttaagggccgtagctgggagtcttagaaccacggtacatggcataactatctgtccaaggtccgtgttacctctctggaaatgtccacagcgttcaggtggtctctgctccctcaagatttcccagcagggccttagagatcacccagatcagctctttcttgtaaagatggaaaggtgaattgcaaagagaaggagggaaatttctaggttcatacagccataagatgcgtcacttgagctataaccaccactttctggcccttatcctagatggataagtagggagataggagggtgcatgggtgaatgaataagtggatggctaggcagatgcatggctggatggattggtgggtagatggatgggtgggttggtaatcgggtggatgggagacccacagacgaaagggtggatgacaggataccagggcaaatgaaggcatctgctctagtttgagggcttcttcctcgggcctccaggccccggaccactcttggttgtcactgctggagctgaccgccaggtccacaagccccttctccacagacaagggcccaggttccttgggcatctggggacataaaactctcctgtatcctcagccccattctgcagaggaaggtggccaggtgcggtggctcatgcctgtaatcctggcactttggg

SEQ ID NO: 15541 - DNA, 12827 bp, Human
ctggtctcactcccggggctcagctccaactgaccttgaaacgctgaggaagggagcgcagaagcttgaccttgatggacagaccaataagggtggccatgctgcagtgcggaatggttggtgtgaaagccacagccactgtactctcggggtcgctaacctggttgtggaggagagatgtcaagagtcaaccaccctcagcccaaggtccctcttcttagtttgttgttttgggcaaatcatccaacttctatgggcctcagtttcaacacccataaaataggcacaacaatctccctccccaaagatacccttcggtgttcgtgagcatagagcacgccagctcctgctgcacagaaacctttctgactctctggaacaactcgctcccctcggaagtgactcacctgaacccgcacctgctctactacgttcaactcctctagcgtcagtggatgctccgggtcattgatggagcgaatcagatgtgggaagtgaaggaaaagggactctgcgcccttgcccacttagaaccctctgccaggaacgccctgctgggatgcggctccaccagctgctcgatatcactgctccccccaccgcaagcccccggaacccgcccgcgcccagcagcggcggatatcgaagatctcgcgtgcgtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggtgaggctccctcggaggggcgacagggaccgggctcagatctgccaaatgctgcggaggcagaacctgacagtgcgggagggcaggcgcctgggaggtaggagctggtggagatgacagcgtggaactcgtgagccccacgcaacgcctccccgccgcccaaggtgggctcctagaagcacagaaagggtcgggctgggggacaccacggcaaggaaccagcggagtacaggggccccaggagcgccgggacatgccaggccgggtaggcagcctggggtcggagtgggtgagggattggggtgtggggattcagtccatttccctcttatgattgtggctgtagcgggtgctgccggccggtaataacagtaatagcttctggcagcatctggctctcagtgtgtggcgtccttggccaggggggatgccctgagccctccaaaggggcctcagacaaggatagtggtccttggggaacagaagcccccaggcgccaaatcctaaagcagatctaagaggccacagtggctgggtgcgattggctcactcctttaatcccaccactttagaaggccaagggagagtatcgcttgtgcccaggagttggaggccagcctggacaacatagtgagactcggagtgtacaaaaaattgaaagaaattagtgggctgtggtggtctgtgacctgtagtcccagctacttgggaggctgaggtgggagatcactttagtaggggaggttgaggctgcagtgagccttcatcccactactgcactccagcctgggtgaaaaagcaaaaatctgtctccagaaacaagaaccaaagagctcgtggtgtccctcatgccatttacctcatcctgggcaagggcacaacttggcttccagggcaaaggtgaaggctctgtgtgcctgccaggcttctccaggcccttatcagaagctgggggagtgtttcggcctttggtcctctcacccgaaactctcctaagtgtatgatctgtctcttccaacccttccccaatttaatttgcgcaggtggagtccatactccccccgccccatggtgcactgctgcagggcttcctcccgtgcctgcccttgaccacattctagagttcaccaggagcccagcaggaagatctgcctggcctcacagatggctaccttttaaaatattttgggccaggcacagtggctcacacctgttatcccagcactttgagaggcagagatgggaggatcacttgaggctaggagttagagaccagcttgggcaacaagacttgtctctaccaaaaaaaaaaaaaaaaaaagtcaagcatggtggcagacagctgtactccaagctactcaggaggctgtggcgggaggatctcaagcccaggaggtggaggctgcagtgagctgttatcatattactgcattccagcctgggcaacagatggcgaccttgtctgacaaatatatatgtatacaaaattttgggttggacccacattcagaaaaaataattgacaagccataggagggtacaggtgatgtgtgccatcctctttttacccaaccagtcctggcttctcctcaggggccatcaaagtccccatggcccacactggaaactgcttgttgacaccgcagtacacacagtgcccagcagtttacacaagaatagatgtgtgcacttgtccttgattttcatctaaacagtcataaactcacccactttctggagccaggcttttctacagctgggactacaggcatgcaccaccacaccccgccaatttatttcctgatttttttgcagagacagagtcccactatggtccccaggccagtcactgtgctttttatatcccagccacagccatacttttctcttgcacctcttttcaccaacatcactcatggtttggatgatgctttctttacatgatttcttgccactttggacatgacatccctgaggacaagaaacttgcctgcccaattcccaccatcatcctactgtcacatgacctggcacacagttgaaggacactctagtcccatcaagggcatgtgaccctttgtttgaaggtcctagggctgaatgatgatgcctggccccaaggagcctcagcctggtgggatggagacaggcccaggaagccagagcgggaagggagtgttacaggcaggaagtttgtaaagcccatgtttacagatcagagtcccttgagctaagatgaggatggcaaggaagcagcaataccaacagttgggagggcagtcgattggtcaaacccaaccgtgatgtctgtctctctgcccacaggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtaagctctccaaggggtccagggaactccaggccctggggcaggggtgggggtgctctgagctcagctaggctgcagttatcatttcatctaaacccccacagccagttttccttctgagtttcgtggattcccacgtgcatttttccaatgagcatgctgaggctcaggagggcagaataacttctcagactcctggatcagggcttggcattcagaagacattggctccaggtgccgaagggaggggcagacacacgtatctccccagattctggttatgccaagctttctctgccaccagtggcaggtgtctctgggaaaggttcgggttggctctatgaaccttgtaggagcccctaactctagtggcagatgttgcaaatacctgaagagaacagtagtggtagctttctggggacctgcactctccacaggcactgtgtccactgacaggaccaggagccattggccaagagacatgtatatgtatatgtatatgtttccaactggaggccatgtaggaatgatgagtttttgagagtttagacttgggatgagagacatcccactgcccttctcatgagaaattaacatccattcactcatgtagcacacatatgtgggctactcccctgtcccaggccttacgggttacaggaatatagtggtgaatgtcaacacatgcagccaatggttctcatagaaacccctaagagtcaaggtttccggcagtgcgaggaatgatacccaaggtcctcagtaacctcgaggcctccctggaagtccaagctgcatcccagcttccccagagcctgtggcctgtaacttggtgggaagggatttttgagagggatcatgtgtgagcaggatattgtgggaagggtctgagggtggctgggagcacctctgaacccagggtctggttttggccacagcctggcccctggactgattatttgccctggttaccaggtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgggtgtcaggccacagttcactgggggttggaggacagttcttctgcaagaagctgaaaaggacaatattagctcaggccctgcttcagagtggaccatgctgagaagcttctcactgtcaggtccaagaaatgctccttacccagactgggcagctggcccctggacatggggtcacagagttctggctgctcccagaggtcaaaggctgtggctctgggctggacccaggactcactcagccaactcatgccaggagatccacttaagtgccaaagggctgcaccttgaggtgaccaagaaccccagccatggataatctgttgggcctatagaatgggcacacacaaaaactttttttcttagagatggcatcatgctctgttgcccaggctaaaatgcagtggcatgaacatacctctctgtaacctcgaaatccgggatgatcctctcagattagcctcccgagtagctgggactactggcctattccaccatgcctggctcatttttaaaacattttctgttgaaacggggtctcactatgtggttcaggctaaggacatttttggttaatgttcatgtggagccatcagggagacaccccttttctttccactttggtgaattatctggggttaatgaacccaggctttgatacagggggttcgattgcaaagattgggaggcctggtcttcctgatagatcttgggtgcctaaccatttgcccatgtaatgaatttgtgctggagatctaatggggaggtagacagaggcaaagcactggttggtctaggtagtggccctggtggggtttgggctgggtgggagcatcatggtagctgccttgatttccccaggtgatggtgtggatccacggtggtgcgcttgtttttggcatggcttccttgtatgatggttccatgctggctgccttggagaacgtggtggtggtcatcatccagtaccgcctgggtgtcctgggcttcttcaggtgagactagggctgggctgggcaacccgggctgagcggggccaggacagccctgtgatccctgtccctgctacttctcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtgagtgccctcagctgaagaggcctaggcctgctccctcccctcatatccctcagagcctctgtctgttaaacggggatgacaagggccatcgggagcatgctccaggagctgctgcctaccgtggaattgctggggggctccagggtcagaattcacatccttctgccattgcagaggccgagcttgttctgtggctcctgtgcaaagttgtcaccctagggatccccaccatgaggagaatcatctaggcggatgggatggcccctgtgtctgggacttctgagttggaacagtgtcagaactgcaggaactcatacgaagtaccctctgagatttggggtacccctgttcttggccagggccttgggcaaactcctctcctctacctggaaggatgagccagcccctgcctggtccctttacaggtggtggccaacctgtctgcctgtgaccaagttgactctgaggccctggtgggctgcctgcggggcaagagtaaagaggagattcttgcaattaacaaggttggtctaaatggatgtgggtgtagaggaaggggtgcaataggcatggggctggcaggcctgcacggccgtcatattccctgggcacattacctcatctgcatgcctgagtgtcatagccctgggtcgggactgaaggtcggtgcatgctgagccaaacagtaatctcctggggtgggtatgagcatccagggataaactgggaaggagtggaaggtactcagagggcatcggaagatgtctgggacctgaccttgttccctgaccttacatttcccctcagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtgagccccaacccaagcccacaagtgcctggggagcccatctggtagtggggggtgttcagggcttcatagctccaggctcatcccatccccagctacagactctctcctggccatccaggtcatgaggatctatgatacccagaaggaaatggacagagaggcctcccaggctgctctgcagaaaatgttaacgctgctggtaaggctcctggggtccctcgccaatggagacgggctcctctcctgtcctgagacagaggaaattcaacccccagatacccttcctatgtagtgacccccatgagcaaaggcctgggtgtgtgtgtttaggggtggggtcacctcagagcctcgcctttgctcccccttcctgtgccatccccaagcccgagaccacctcctccctgcccctggcatccagtctaacctgcctcttcctgatccacctggggtagatgttgcctcctacatttggtgacctgctgagggaggagtacattggggacaatggggatccccagaccctccaagcgcagttccaggagatgatggcggactccatgtttgtgatccctgcactccaagtagcacattttcagtgtgagtatatttggaccaaagcctggcgggcagggtacagctcagggctgtgggtcccaggtgagacctgctgctgtccgggtcagcactcatgtttattgggctccggggacacttgacatccatcattgcagtaaatcctcatggctagcccaagaatccgacatttcccccatttcacagacgagcaaattgaagttagggaccttcagtgacttgcccaagatgacacagcaaagaatcgcaagtcctttcctctattcctgccccagcctggggctccacaccccattgtccagattccagccagctttggacctaggtatcttatcaccatgggtgaggcaagaagtcttcagggggaggggccaccgtgtcatgggctgtccaccccacaggttcccgggcccctgtgtacttctacgagttccagcatcagcccagctggctcaagaacatcaggccaccgcacatgaaggcagaccatggtgatgagcttccttttgttttcagaagtttctttgggggcaactacagtgagtcttcttcctttcccgggaggtgggctgggattctggctgggtctctgagcgatgattgattgtcctcactgcccagataaggaaactgaggctcagagagaggatgagatcaggtgtccaaggttttatagctccaaaagctgcaccaggattagaattcacgactcttcagactgtgagctgtgctccctctgcctctccccagccatgggtgtctggcctggtgcagaacaggtgtttcagggacatgtttatttcttcagtgactcccagagatagaaggaagaaggggcctttggggccatgaaggagcccaggatggagtcagccagagcctggtctacagggaaagtttggaaaaggggagggctggcttctgagggcagtggaagaaaaagcggagaagcaggactggggaccgaggtctcgggggccaaggacgagctccacctgggatgctgaggttggacatcctgatgaagacacatgtcctcttcctcttggcagttaaattcactgaggaagaggagcagctaagcaggaagatgatgaagtactgggccaactttgcgagaaatgggtgagacagcacacccctgcctcaacctccccgattgggggacttgtgcccatccagtgctctcctagtctggggtgacctcatgagcacacccgcatccttcatcacatgatggccccttccccagctccgggacccactcagacagggtgggggtgcgtggggcagtggacacgctctatctctccagtctacctggagggtgggcgccagtgctgtgccaccgtcagggcctccctctcagagagagggacacaacagagctggctgccctcccccaacccccactggtgctgacactagccagagggagcttatttcctgtttctggaagcctccccactcattccccaagcccacctggcctgcttggctgccttgcctgaccagactcagggtgctcaggtctgggcttcgggggcccagagtgaccctcatactgccctgctgggatggcatgtctacaggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaaaagcctctgtctgcctctccccaagccccaagtgctcttacatctgtgagtggccaggccgggtgcggtggctcacacctgtaatcccagcattttgggaggccaaggtaggcggatcaccacatcaggagatcgagaccatcctggctagcatggtgaaactccgtctctactaaaagtacaaaaaattagcctggtgcagtggcacacgcctgtagtcccagctactagggaggctgaggcaggagaatcccttgaacccgggaggcagaggttgcagtgagatgagattgcaccacggcactcctgcctgggccacaggacgagactcagtctcaaacaaacaaacaaagaaacaaaaacaaaaaacaaaaaaaatctgtgagtggccaataggaaacctggttactggaattcctagtgttttagtccattcagttgctatagcaaaaatactaccgattagacccggtgcagtggcccacacccatcatcacaacactttgggaggccgaggtgggtggatcacttgaccccaggagtttgagaccagcctggccaacatggtgaaacgctgtctctactaaaaagacaaaaattagccaggctctgtggtgcacacctagaatatcagctactcgggaggctgagacacgagtataacatgaacccaggaggtagaagttgcagtgagctgagattgcaccactgcactccagtctgggcgacagagaccctacctcaaaaataagtaaataaataaataaacaaataaataaatattaccggttaggccgggtgcagtggctcatgcctgtaatcccagcactattggaggccgaggtgggactcctgaacttgagcccaggagttccagaccagcctaggcagcatggagaaatgtcatctctacaaaaaaatagaaaaattatttggatgtggtggcacacacctatagtctcagttactcaggaggctgaggcgggcagatcacttgagcctgggaggtcagagctgcagtgagtcgtgattgcaccactacactccagcctgggcaacacagcaagaccctgcctcaaaaaaatagggcttccaatactgatataaaacttaaaatactacaggttaatattataaactgggtgccttataatgacagaaatgtattgcttacagttctcgaggcttggacatcgaggatcaaggtgccagcagatttggtgtctggcaaggacttgttctctggttaatagatggcaacctcaggccaggtgcggtggctcacacctgtaatcccagcactttgggaggc

SEQ ID NO: 15542 - DNA, 9990 bp, Human
ttcccaccgaggctcctccctccccaaggccatcaacagaaaggaaggaagctgagtctctggcattttattcccaacaggaaagagtgtctgcacagagggtggggacagctgggcgacacttccctgaggggcgggggggtggggtgtacttgtactcaaccagtcttgaccagcctacccagaacctcttagtgctcaggagaggagatagggatttgctagacttggcctcaacctggggtggtgggcagagtgtgcagatatggatgcagacgacatcaacagcacaggatgaaaactgtgttggccagcctctgaggaggatgtgtacctctgcggaggagtgagaggtggcaggctcttgtgaagaggggtgtggtggggggtggtaggagagggtcatgaaagctgtgtttatcttttttgttttagacagggtcttgatctgtcaccaaggctggagtacagtggcaccaccatagctcactgcagccttctgggctcaagcgatctgcctgcctcagcctcccaaagtgttgggagattacaggcgtgagtcaccgcaactgggcagctgtgtttatcttgagagttatagggagccagggaagggactataaggtggtaattatttagtggatgttcagtccaccacccaaatccacccttcaggacagaagtgctcattctccagctgccaggagtgtaggctactgagatcacaccactgagtctctcagtcaatattggggtgcaaaagcatggtaccatcgtgtgaacatgaacccttcagaagtgctaccccaatttcagagatcctagtgggataggctgaggcctataatataattgcatctgctcaattctgcttgtcttaatcccttaaaggtgtggatcctgaccaggtgcggtggctcacaccggtcatcccagcattctgggaggctgaggtgggaggatctcttgagcccacgagttcaagactagcctgggcaatatagtgagacccacatctctaaaaaactaaaaataaatgagccgggcatggtggtgcatgcctgtggtcccagctacttgggaggctgaggtgggagaatcgcttgggcccaggaagctgagacggcattgatcttgccactgcactccggcctgggcaacagagtgagaccctgtctcaaaaaaaaaaagtgtggatccccaacaaacttgctgcaaaaccctatctcgagtcccatttcccagaggacctgatctaaaagaaacaataataaatagtaacaatgttaaaagttacaaaatgaccgtatcacacattcctgcatgccaggaatgactgagtgctttactgatatttacacataggtaaacacgtttgcattggctgaagtgttcataaccccatagtctctgagcactgtactgtgaggacaagacgagcgaaagatgaggctaggaccatgggtggaacaaggtggacaaggtagatatagttagtgcttgctgtttggcaggaagtgagggataggaatagatggggtgaccccaagacagtagggcagcctttaggaacaggtttgatgtggcagtaaaatgagtttgaaatatataaaagaataaataaagagaaaaaaatggaaaaggaacaggtttgagggagcagattggattagtcaggtagtgtggtctcctctcccaagatggggactaggcagagttagtgatgttggggcagattggcaaggaaagttccgatggcgtccccttctctactgccagggcggcccactgacgcccttctcattcctccccaacttcatcccaactccccggtctacccaggtagttttcgtcttattcggaggctggacatttgctactggtccctgaagttttgcggctgcacccacagacagcaatagcgccacgttccctggaaggcgcacgggacggaagcggaagcagtaacgctggctccggctgcccggcggccaggaacggaagcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggtgcggcctgggctaaggggagacaagggaggctggtggaccaggcctgggccggtagcgggaaccccgggggcggcccagctgggtcctccgagagccggccgccatcgtgtgctttctcacaggagagaagccgggggatgtttcattcattcggccgaggccatcgagctacagctatgggccaggctcgggctgcaggtgttcgtcctcgtggcccttcctggctggcgaggagaagagctgcctatgggacagagctgcggtcctgagctgcagtagcgcctgggaggcactacagggttggaatccagattactcccttcccagaccacgtctcagggtggctgggggtacaccccagagtggggctgagcattctccattctctctgccaggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgatatcctcctggcggtccctgctggggggagtgggcaaggggccctctggttcaacttgccctgagtcctgttcctcttgggagtttgtcttatagccactggccatggcccagcctcaggctccctcctcagagcccctccccttccactcttagcctgtgatccctcccccggtggacctgagtccccagaacggtctctgagggcctgtgtgtcagaccttagctaaagaattgggtcttttctgtagtctgccatctgtcaccatagggcatcagccattctccttaaccctcacactttggcctacgtcactcatgaggacatctgcagatgctttgctggtgagcagagcctgggtaggggtaagggggtgggctgggctcagccaaagtcctgagcactgggctcagtgtcttaggagagttctgtctcttaagagggtttctggggcctgctcagagaggaaccaggcagggtaagtcttctgtctgagtgtcactgggaccctgtggaggtcagctataccaaaagggtacagaaattctggagtgggtccctgggtctgttcccatctctactgtttcctggatttggcttcttgggtatgatagaggcacaagggggagagagggagagaggatatgtgtgtatttgcttgtgtgcaggctcttacatgcagggcatgggggtgcccacttccaacttgttagtttagttgcattgtgaatacaggatctgttcctttttttttctttttaagagatgggctcttgctgtgttgcccaggctggtcttgaactcctgagctcaagctgtcttccctcctcaaccccctaaagtgctgggattatgggtgtgagccactgtgccccgctgatgtgtttcttctccatcttgtatgctcctgactggtcatgggaaagggatgttggccttggctagaacaccctcacctagggatcagccatcggtagaggaatgaggtgcctgtggccagtgatctttcactccacataattgaacccagatttcctggttactgaccctgggctctcaggaagagaagagctttagctctgcctggccactatgggggatgggtgaggcccactgtctagttcctcagggaccgtgatctcctgccttgctccaaaaggcaggcacctctgttcccagctcagattgagcccatgggctctgacccattctccatgtcattctaggagataccctcttggccatccgggccccatcaggcaccagcctggaggtgcccatcccagaggtgggtgcttagcccaggcaggcggggtcagctgagggcgggtgctggctgtggagcctgataagtcctgggtggggcaagtagggggaggcctggagtttggggttatctaggaggatgggcatcctgggtgggagaggacactgtggtcctgacccggagtcgggcaggagccaagcctgcttacaattctacccatctcccatcccttaccacccatctctagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacaggtgaggcaccatgggagcttgtgacagaggcccaagaggtagtatctctgtgttgtggaacaccatgctcagagttggaagagactcttcaggttggggattgtccttttcctgaccacctagccttcccttgctatggtaatgaatgagccttttttgtttttgtttttgagacggagtctcactgtgtcccccaggctggagtgtgcaatggcgcgatcttggctcactgcaacctctgcctcccaagctcaagaaattttcctgccttagcctcctgagtagctgggattacaggcgcccaccatgcgcagctaattctcgtacttctaatagagatggggtttcaccatgttggccaggctggtttcgaactcctgacctcaaatgatctgcctgcctcggcctcctgtagtgctgggattacaggcttgaaccaccatgcctgcctgaatgggccctttttaacagggaacctctgactgtgggaagagccattgctggtggcagttttctcccccagatccacatccactggtgtctcaattgccctggtagcccgtcttgaagtatggccacagcagacatgttgaccacgagtcttcttctgtaggtcttgtgtccctgtctcctgtggtgactaatttcaggttacttcctctgggggtgactggcaatgcctaattctccttgggtctgggaaccaggcttgtggtcctcctgtgtctgggttccagcacagccagtttcaacgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggtgagtacctgccccctgggggcagagagagagagtctagcctcagtccagtcctaggtcagaaaacagaattggggatggaacccagatctcctgtcaaccctgctggacacgagagctctctgccagcacctctgggtcagtgctggtgccccctctagcaccccatcctaggctaacacagaactccctgccgtctctcaagccctttcctgccaccccttggagcaccgcctcactaattgacacttctctgtatcactctctctcatcttctctgtctcctttctgtctggactccttgaaaaagtaatctccattcattagtctcctagtcacctttcaggttgcagcagtcacccccccagccccagtgttacagcggtgttactcttgagaagctgccgaaggcctgccgagcccagcagcctccagcgtgttttgctggtgctctcttggtctgtgtcaatattctttcctcctttggcatcatgatgccagcttttggctctcctatctcactggcttcttgaactcttccctggcgtgtccttaaacattgctgtttttgagggctctgtcccattccactcctggagagggctgcagctctgggtgaacgaatccccagcctccgcctggcctagatcttttcccaatctgcacacttcggtgtccacctgccgtcctgtgtacatccaatggacactttattcctgcatgtcctcaactgaacttagtttcctcccgaagcttgctttccacctctgcgcacccagccgtcagccctagttatccaggcctgacccttggctctcactctagttctagttccttatccctcctccttctgctgcccaccccatgccagctaactgaggtctgtcccagatgtcccctcctatcctctggtatcctcagcactcaggatgacccctggccacctctgtcctggattcttcagcatctttctctttaccctgactgacagactaatctttctgaaatgcaggcctgacagaaaaatgtggcatttctctgtttgcaaaagtacctttaatggctccttgagggccaccagataagatctgaactcctgagcctggcatgtgaaatccctcatagtcctctctggttgcattttcttctgcttcccctgtgtcctcctggccagaggtttgtagtggagtcatcaccctgtagcgccaccacctctgcctggtgacctgacccagggtctggtctcagtcttgcacagagcaggtgctcagcaagggtgggacagatggggtaccttctgtcagacagggggtgcatgctgagcccagaaagaggcttctgtggcctttccgagttagaaaagctgtaccaatcgcttgcagggggcctttggtaccctgggctcagcactgaggaattcaggtttagcaagtgaggccaacagacagtgccagcttggcctaggcaggacctacatctccttagctgtgtggagcctcagggtgggtggtataggatccgaggaagccagggggctgtagtggggccaggctggacctctgtgccctgagcatggctttcttgtttttcagttttggaactccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctagctctgatgtggttctttggggaccctccttgggactgtgctggactggcagtgtgattgggtgggtcaccttgctggaactaggggtggggcggcctccggcagcctgccctccccgcccccacctgccgcaccttggtgtggggcggggccgcctcggcggggcggggcaggcggagccgtcctaccttcctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatccagatgcgtgacgccatcccgcagctcatccagctggaccaggtcacccggctggtcccgcctccatctgccccactgccccacctcccggtagccccctggccctcggggcagcccgccccacccctccccccaggctcctccccatccctccctgcccaggccgcgagaatgaccactccacttgcaggcgaagcccctggccgctgtgctgaaggaggtgtgcgacgcgtgagtgctgccgggccagggcctgcggagggcgggagggcaggaggggcggcgccccctgccggcctcgctgagcctcgtgcccctcaggtggagcctgacgcactctgagcgttacgccctgcagtttgcggatgggcaccggagatacatcaccgagaatgtgagtcccctctccccagccccaagctcggccttccgacccctctaacccacctggccccgataactctggctcttcatcccactaccggagcgcgatctgttattcacccccagccgccctcaccgacaccccagttgatcagtcctcggagccctccctgacctcgctgccttttctgctgtcttctccagaaccgcgcggagatcaagaatggcagcatcctgtgcctcagcacggccccagtaatgcccctcccgtcccgccttccccatccctgcccctttgctccaggtccagaggccccccgccccggaggcccccgccccagccctgccttgcgccacctagttgacgcccggggccgcacacttccaggtcccacccttaccatg

SEQ ID NO: 15543 - DNA, 75929 bp, Human
  misc_feature (1)...(75929): n = A,T,C or G
tttccttgcctaagctcatggccatcaaggccattctagagatctttcaatttttatttattccacatttcccatggcagaaacaattattgctagagtctttggccaagatcaacttggaggtctgtgagccctccttggacccattgtggagcaagagtgcttcctcatggattttttttccccccgagacggagttatgctcttgttccccaggctggggtgcaatggcacgatcttggctcaccgcaacctctgcctcccaggttcaaccaattctcctgcctcagcttccgagtagctgtttgagacggagtcttgctctgtggcccaggctgcagtgcagtggcaccgtcttggctcactacaacctccgcctcccaggttcaagcgattctcctgcctcagcctcccgagtagctgagactacaggcgtgtgccaccacaccccgctaatttttgtactttagtagagatggggttttgccatgttgaccagaccggcctcgagctcctgatctcaggtgatcagcctgcctcggcctcccaaagtgctgggattaggccaggcgcagtggctcatgcctgtaatcccagtactttgggaggccgaggcgggcagatcacctgaggtcaggagttcgagaccagcctgaccaacatggcgaaaccccgtctctactaaaaatacaaaaaaattagctgggcgtggtggtgggtgcctgtaattccaaatactcgggagacagaggcagaagaatcacttgaacccaggaggcggaggttgcagtgagccgagatcgcgccattgcactccagcctgggcgacagagcgaggctctgtttaaaaaaaaaaaaaaaaaaaaaaaaaaaagagggctgggattacgggtatgagctacagtgcccggccacaggactaactttgaatcaaactctgccataaatcccatgtcagactttctccagtttgggctaaacaacttccctagaatttatggatcttattttttgcagctgattgcacattgagtaagtatatggactggcaatcggttacattcttaactcagcttgttcttctttagaaacttaaatttattgggctcccactgtgtgctagacccacataaaggttctcacgctaacactgcaaacctaggagtgtctgcattttggaaataaggaaactgaggtttagtggtccaattcttatctaaggccccagccagcaggtagtgtagctgagtgggatcccatctaagacccatctgactccaaaagccacgacctttccaccatgactcggttggattctttggtccgtttccacctcagtcttcaacgtgcagagcctacacccctgccggtcggtttagggacgaaaagtccccaaggacttaggtttcctcgcgttcaagtgacaatctggggttactccgcgcacctggggaacccagaagttccagatgaccgaggaagggcggtagaaaaggcctgcgctggctactcccgtctgctaaaggccaggcggatcccccaacgacagctccacgccgagtggccgcgggcgagcagggggaaaagggccctgatgcggaaggagccccggggcgccacagccaggccgctccgccagcgggcgggtggcgcatgcgcggcgtgggccgcggagttgtgaatggtgcgtcttgtttgccggagttggaggcgggcgggcgcgcgaggaggaggggtggggccggcgggggcggggtgggcggtgagaggaagtggcggcggcggcggcggcggcggccgggggcggtgagcgctggggctgcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgaggtgaggcaggcgggcgggcggctaggaggccgcagcgcgccccgagtgggcccgggcggagaaaagtttgggcggcacggtccccgggagtcccggtcggtgcgcccgcggaggggcaatctcgccggggcggccatcgcccgcagcctctgcttgcccttatcggcgctgcgctgggagggcgggcgcgcgggcggcgccgcggatttggctcctgatttcgggccgtcttgccttgcagattaagtacacgggcttcagggaccggccccacgaggaacgccaggcacgcttccagaacgcctgccgcgacggccgctcggaaatcgtaagtcggctggcccggggcgcgcgcgggtcacttgttgcgcggggccgcggcggcccaggccggttccggacggcggcgcggctgctgcggctcccggaactgagtgggcgccgtctcacttcctactcgggattcaaaatgcgaaaccagatgccgcgggccggtactcgcggggagacgcttttcctggggctcgccgcggtggcgcgtgtcggccaacggagcaccgcgagtggagctcgaacccgagccagactaaacaagcgaagggcattgtttaggcggcgacaccgaagaagggttcagggtatttgtagcaagcaaacccccattcggaaaaagaagtggagcttcattcaaggtcggcgatagtttgtttcttagaaggtagatctgtcggtaattctctgtgtcaagcggtctcactaccagatcgccgagtagaaatctttcctccagttatttattctaatagagaggggaggggggggaaaaggccctaaaaatgtcattttcttagaatgttaagcttcaggagaatcagaaagaaaccattatccccatgtcctgagtagggctgctgttcctaaaaactgcacagatgggcaaaacccacggttgatctcgaggtccttgttttaggaggcagatttagtgcgtcttcaccagaccttgggttgaaaaaaaaaatccaagggtcctagttcctctcatctttttggtttgccttgttggaggtgctgatgaggagggagtggtaggaagaaaccaagaaaagaggttgattattactatttttttgaggtagagtcttgctctgttgcccaggctggagtacagtggctcgatctcgggtcactgcaaccttcgcctcctgggttcaagcgattttcctgcctcagcctcctgagtagctaggattacaggtgcctgccaccacgcccggctaatttttgcatttttagtagagacggggtttcaccttgttggccaagctggcctcctgacctcaagtgatccgccctcctcgacctcccagagtgctgggattacaggcgtgagccactgcgtctggcctgattattttttaaaaagttgaagcactgtctaatggaatgctgttactctctgctcggtgacttggactcactgcattgttagaggcttgaagctaggtgcgatttgaatttgggttaacagtaggaagacattggaaatttacttctcccaccccctttataaaaccagtttatttttattcagatataattcatatgtcataaaattctccctttacatcactgaactcaaatttatttttaaagaatattttgatattttaagtgaaagctttttagagttgtaatagtgagaagatactggttaaatttatcaggagctcctgaatatttggtcattagtgcatgttatgaaagagagtctcaagcttttagcccacttgcaaatttcttgagtaattgtagtatttatatgattgaagtgcataagacatacttttaggttttggcactgagtggtataataaaagaattcattagctggtgcgatgatcgtgtcatcctttgcctgggttaccttttgcaaagggaaggtggtatacctgacgatagaatttcctggaggtaaaggatgcaagtataaaagataagttacaaagtacttgtactctcactgtttgcttttttgttttgagacggagtctcgctctgttacccaggctggaagcacagcagcatgatcttggctcgctgcaaccttcgcctcctgggttaaagcgattctcctgcctcagcctcctgagtagctgggattacaggcacacaccaccacgcccggctaatttttttgtatttttagtagagacggggtttcaccatcttggccaggcttgttttgaactcctgaccttaagtaatcctcccacctcggccttccaaagtgctgggattacaggtgtgagccaccgcgtctggtcttgtttcgttttttttttttaagagagaggtcttgctgtgtggcctaggctggggtgcagtggctgttcacaggcacaatcatgaggcactacagcctcaaacttctgggctcaagcgatcctcttgcctcagcctcccaatagctgggactacaggctcggcgtcaccatacgcagccccatgtgttgtattatcatcactatctttgaaagctgaatttttttggaaatttggtgaatcatagctagtagggtgttttctgtcatctcagactttgctgaatggaattatgaattcaacccataggatatctgaaatgctgtaatattatagtagtagtacaggtggttagtgtttgtcatgaatttatttccaggatgaattagacattctagaccttccccgcttccaaataatctgatcctcacctgagcccgggaggtcgaggctgcagttagccatgatcgtaccactgcactccagcctgggtgacagagtgagacccggtctccaaaaataaaacaagtatctgattcgacacattttacaagttttaaatttctgagaagtattaaaggttaaagaaggtagattgaatgctgtgtgaggtttgcacttaagacggctcatgtcttattttgttaaataatgtaactattggtatttggagaggaatttcacgtttcctagttttctctctttctagtttccctcctttaattcagtgttaacccacatttaattacaggatccttagctcctagagggtagagacctcattaattttgtataaacccctctggatacagctatttttcacaataccttttatatcagaggtacttgattatttgaatttagaggctgcttaatttaatgcctgaaatttatctcatgacttatgaacaggctgggtttcttcctatttggctgtggaaaaaggcattattttgcctgttttgacagcagccataaatggcaagggatatccatagttctcaaaactattcccaacctttctcctgccccagttgtcctcttcttatttggaacatcttcttgatgtatcagtgaggttaatgaagaattcattttgctgttgcccaggctggagtgcagtggcatgatcttggctcagtgcaacctccgtcccccatgttcaagtgattgtcttgacccagcctcctgagtagctggaattacaggcgtataccaccatgcccagctaatttttgtatttttagtagagacggagtttcaccatgtttgccaggctggtctcaaactcctgacctcaggtgatccaccgacctcggcctcccaaagtgctgggattacaggcgtgagccaccactcccagcctcattttgcatttagatgtgaaataatttaagggctgtgttgatcatctctctttaactataaaactcaatcagcctccttattttatgccaattgagtttttaactgtaaaacccaatcagcattaaataaaagtgaacacaggtcgaagaatctgtagtagaatctgatttattcttttttgagactggatcttactctgtcactctggctggagtgcagtggtgccatctccgttcactgcaacctccacctcctgcttcagcctcctgacttgctgggattacaggcgcctgccaccacgcctggctggtttttgtatttttagtagagatgggtttcaccatgttggccaggctggtctccaactgctggcctcaagtgatgtgcctgcctcagtgagccactgcacccagccttgatttattcttatcaattcttttttttttttttttgagacggagtcttgctctgtcgcccaggctggagtgcagtggcacgatctcggctcactgcaagctccgcctcctgggttcacgccattctcccgcttcagcctcccgagtaactgggactacagtcgcctgccaccacacccggctaatttgtttttgtatttttagtagagacagagtttcaccgttgttttttttttttttttttttgagacggcgtcttgcactgtcggctaggctggagtgcaatggcacgatcttggctctcggctcactgcaacctctgcctcctgggttcacacgattctcctgcctcagcctcccgagtagctaggattacaggcgcacaccaccacacccggctaattttttgtatttttagtagaggtggggtttcactatattggccagactggtgttaaacttctgacttcgtgatctgcctgtgttggcctcccaaagtgctgggattacaggcttgagccactgcacccggcctattcttaccaattcttatgtagttaagaatgttggagacgtcttcaacactaataatcaaataaagaaaaaatatttataagaagtatggttactctgtggtgagaagagtaaaaactaatacatatttctaattctaaagattgaatggtaaaaagtatgttggattggcacaaggtgtgctattttataatttgtgaaacctacaaagcataagacaacctggaaatcttaaatataggcgtcatactagtgtagcattttaatgttttcattttgtttattttcgtctttattttcctatgacgatgttgacaccatattaatattttggaacagactttttccaactcttacctatatgtaggtatttcattaaaagaattccatggtcacataagtttggaaaatgttattctagaatgatctgtgtttaccacttctgtctcagagagggatctttatgagataatggacatatagtgatgaagcaggaaatctcttctgaggttggcatcaagacaggagatgaggtaatacgatctgcagagtgtcttagcacagaactgatttggggtacactggaggtggaaggatttgctactacgtgaatactgaagaaacaagccacagggattttgacacggggcagtcgttcatgggctgtgtcttttctgccaccactctgctctgagaatttcattatctgaagctgaaaaagttggctttcttgttgagcttaaagttatttatcatattattcagcagacactttcatagcatttacttggtactgttttaagcactttacaaataattgatttgtgagaaaactgaattatgcttcaggtcgtacagcctgggcagtttccctcccagaaactttttttttttttaactagtgttggggggttttttgttaagatttatgctcgtagtacatgggaagttttttttgttttttgtttttgtgatggagtctcgccttgttgtccaggctggagcacagtggtgcaatctcggctgactgcatgcaacctctgcctcccaggttcaagtgattctcctgcctcatcctcccaagtagctgggattacaggcgtctgccaccatgcccagctaattttttgtatttttagtagagacagggtttcaccatgttggccaggctggtcttgtactcctgacctcagatggtctacctgccttgcctcccaaagggctgggattacgagtgtgaaccactgctcctggcctgaaagattttttaaaatgatgttgtaatattgatgttagttcagtttctatggatataaaacatttaccacatgaaaatggtaccccagttgattagggaaatgccatcagagaggtttagagatttagcatttaggttgacaagtgtaccgacagtgccagtaatagaaataggaagtataatttttacctctaaagaatctaagctgttaaccatcaggggaactattggatagctaacttggttgatggctttaaacaaattgccccaaatgtgaacctcttgatttgagatgaagactctatgcatggaaaccaattatgcttcagaacttaattagtagaataaaccaaacaaaaaactttttctggtttcagcaaagaagagtttacatttagatgatgaaaaatgtattttttcaaaaatgcttttacttctttttttcttaatttcctttgggaaaggggtaatgtctttgttttttgcctgagggaaatatagaggtaacttgctcaaggcctacataaaatgacactttattgaagtggttttagattgttgcatctgttgagctctaacatccaaatcttttatatttataaatctaatctataaatatttattagatgaatacttttctctttgttgtagtcagaccaagttctcctaaagtcaaatgtgagaaaagacatatttttaaaaatcatctagggttttagagagtactgtcacatcccatgccaatgtatggtttatcagaggagagacaattccaagtgcattttttatgtactgcctgctatgcagtgtttcagcaagggaaatcaaggaaaattaaagtgtctcatttatacaattttaaattgtggtattctttaaaattcaaaatctttagattttgagtgatttttacatttaaaaatagaagtttttaaatgcagagatggatagtggcttctggttagacattagcagtgtgagatcctaacgtcagcaaaaaatgacctgaaagaaagtattgattccatgtctgattttatacttaagcagccaatggcaaatgtcctcaaaatggaatcagatgtttgtaacttaatacttaagaaaaatgatgagtgcatgtttttttttacttttaagtattctctgtgctgcctggcttaagacataaactgatgtaaaaataaatgactgcttgcataatttatgtaatgtcctgctcctgatcctgtttgtattgatttttctaaaaggcttttgtggccacaggaaccaatctgtctctccagttttttccggccagctggcagggagaacagcgacaaacacctagccgagagtatgtcgacttagaaagagaagcaggcaaggtaggaaacatttctttgcaatttaaaatactgtgggttgttttgttagagattatctggtaatttacattttaataaagatcacagatctgattataccagcatatgctcagatttgttttcattccatgttataaggatgtaatataattttttttttttaatggcgtttcgctcttgttgcccaggctggagtgcagtggtgtgatgttggttcactgcaatctccgccttccagtttcaagcgattctcctgcctcagcctcctgagtagctgggattacaggtacccgccaccacatctgactaatttttgtatttttagtggagatggggtttcaccatgttggccaggctggtctcgaactcctgaccttgtgatccgcccacctctgcctcccaaagtgttgggattacaggcgtgagccactgtgcccggccaatataattttttaaaaccactgttaaacttttgtatcactccattcctaatttcatgtacataatatttgtcatagaacattctaacccttaaggaaagtaacataacaatttctttaaaagtttgaggagatatattttgtttacaaaaatatatgtaagtatagtgctataaaaataaaacaagaggaaaacggaaaaaagctctctaggtttaaaaattaatagtatttagaaatagctcataggtaactttctaattccattaacagcaaatttacatttgagaaaaacaatgtgaaaactttaacttggaaatactttttttttgttttgagaaaaagtttctgggaacatgtcttacagtttcgatgttagaagtttaggttaaagatacaaaaatataggtaaaatgtttaagctgagagccttatttcaggtctacgttaaatgtattatgattttggtaatttttttttttttttttttgagatggagtctccctctgttgcccaggctggagtgcagtggtgtgatcttggctcacagcaacctccacctcctgggttttaagctattctcctgcctcagcctcctgagtagctgggattacaggtgtgcgccaccacgcctggctaatttttttgtatttttagtagagacagggtttccccatattggtcaggctggtcttgaactcctgaccatgtgatccacctgcctctgcctcccaaagtggtgggattataggagtgagctactgcacctggcctggtaaattttaatgaatagcatcttggattggttgattcttgattgagaagtcaaggagttgacttctagaataaaatttttaaagaagaaaccctcttttaaatatagttttatactcaaaacacccttttggatccagtttcatactttttttgtgtgtgtttgttttgcagtgtgtttttgtacccgtttctatcaacttactaaattaattttctaagtgtcatcatgaatagcataacctgccacatttatgtaaaatgtgagaaatgtctaaatattcctttgagaaatatttaatttaatcttgtgtgtatatatatatatacacgtatatatgtgtatatatacgtatatgtgtgtgtatatatgtatatatgtgtgtgtatatacgtatatgtgtgtatgtatatacatatatatgtatatataaaatgaattttttgttttctccaattctgtagaattagatttgatcttttgtgcgtgacaaaacaatctttggattagaaaagggaaaacagattataagatttaaaaaaatgagtactaagcaagcagtttgctttcctgtgtattagcttgtttgcttggaaaattaaaagtgaatgttccagattttactatttggtaattcttacacaatatataaggaagaatttgagaagtccttgtacgattattggtttttttgtgcttctggtgcgtgtatgtgtgactaaatgaagaaattattttttttcttgtttgaatacttccttaaagtttgtttaacatggtagctcagatactaaagacgtaaaccaaaaaaaaaaaaaatttgttttttgtcagctttagcccaaaactattttaagacttcaagggcaacatctcagtgttactgaagtcttccggtatttaataactagtaaatgggttgttaactctaccagaaattaagtttgcttgaattaatttaatgatactgcttcactagtgtgaagaccacataatccttggacttaaaccattgagatgtttttagttatatgaccaaaaataacaaaaatgtgagatggtttattctagtacagtcatgtgtcacttaatggtagggatatgttctgggaaatgtgttgctgggtgatttttatcattgtgtatatatagagtgtacttacacagatctagatggtatagcctactacacacttaggctatctggtatagtctgttgctcctaggctacaaacctgtactgtacagcatgttaccgtactgaatactgtagtcaactgtaacacaatttggtaagtatttgtgtatcttgatgtatctaaacatagaaaagatatggtaaaaatacagtatttaaaaaatggtatacctgtatagggcacttactttgaatggagcttgcaggactggaagttgctctgggtcagtcagttgagtaagtggtgaatgaatgtgattctgtagattatataaacatagtatgcttaggccgcactaaatctataaaaattaagcaattgcactgcaatgttaaaatggctatgatgtcactaggcaataggaatttttcagattcattataatcttacaagaccactgtcatatatgtgatccattttaggctgtaacgttgttaaagcaatacatgaatgtattaaaaagatatgtttttaattctattaggaagagtgatagaactatgcaggctatcaggaaatgtacattttattaatactggttttagaagtttttttttctgtgaagggacaaatgtaaatgttttcagttttgcaggctttcagtctctgtcacaactactcatctctgtaactctgctgttgtggtgtgaaagggaccctagacaatatgtaaacaattgagtgtggctgtgttccataaatggtgacactggtagaaatcagtatctttccctcagatgtaaatctgtaaatgtttatgcataggtcatgtatttctcagatagaattttgtcaacatctgtactacttctgtactactttttttctagaagaaaaaaaagcattttaaggcaaaaactcgtactgtactgttccgtgccactgtaataaagttctccagtgaatttagagaaaaggcattgccctgtgttttctcatccgtggagctcagactgtggggtctcgaatttcttttctctttttatggtctgttttattataaccattaggttttgtttctgtccccacaggactaggactggaagcaaagaaaattgaaggaacttctccaaatgttaattatttgcctctgttccttatattggattccaaatcagtgtcttcttccatattctctcaactgagttaccttctgaagcagcttagttctcgtcctgttcatacgcagttttgaggaactatagttgtaaaggctttagagttaggcaaaattgagttaagttctggcttctgcatttactacagtgtaactttgggcatgttgtttaatcattgtaatccttagttgtagaatgagattaatgggtacttcccagggttgctgttgagagtaactgaaatagtgtatgtaaagtgttttgaccactactgtacctgtcacagttatcaaaaaatttattcattcagaaggtctttgttgaacacctgttacgtgtactgagcattgtcctaggtatttgagatacatcagtgaacagagatccttaacagacaatatacataataagttatgtaatagcttacaaagtgacagtacctttgggaaaaaggaaaggtattataggataaagatgatcaatgaacaggaagtttgcagttttaaattgagtggtctgggtaaggaagatcatacctgaaccaagacacaaaggaggttagggaatgatgagccctgcaggggttgggggtggaggagagatgttccggacaaaggaaacagccattataaagggccccagagtggcaccctgtttttgatcaacagcaagcaggccattgtggctggagtagactgtgaaagaagttgtagtagatgaaatcagaaataacaatgagccagttcatgtgaccatggtaggccattgtaaccacatgggctttttattctgagtgagatggggaatagttttgagtgtttagtttgcttatattttagggacagggtcttggtatgttgcccagggtgactcaaactcctggactcaagttatgctcttggtcagcttccgaagtagctgggagtaaaggcatgctcctgcacctagctcaggcttttgagcagatgaatgatattatctacgttaggttttgacagactcatgctagctgctaggttaataataggttatagggggcaaaagtgaagcaggctattgcagtaatcttggtgagagaccagggtggtagcagtagaggtagtgagaaatggtcatatcctggatgtattttgagatagagccaataggatttgcttatggattagatatggcgtgtgagaaagagaagaataaagaatgactctaacttaggctgaggcaggagaattgcttgaacccgggaaggggaggttgcagtgagctgagatcgtgccactgcactccagcctgggcaacaagagtgaaactccatctcaaaaaaaaaagaatgactccaactttttggctagagaaactgggactatggggttactgtcatcgggatgggaaaactggctggaacaattttgaacagcaggttaggttggtttagcgcatgtgaggttgtggtgggagcttgttattgcagcttgtttctttacttttttttttttttttttttttaagagagagggtctcactctgtcacccaggctggagtgcagtggtgcaatcatagttcactgtaacctcaaacctcaaactcctaggctcaagagatcctcctgcccttctttttttttttttttttacccctgacaaaacaaggtcttattctgttgccaggctggagtacagtggcgccgtcatggctcactgcagcctcaatgtcccaagctcaggtgatcttcccacctcagcctcctgtgtagctgggaccacagcatctcacctgtaaccccagcaccaccatgcctgaagttatttttgtattttttgtggagatggggttctgttatattgcctaggttggtctcgacctcctgacctcaagtgatcctcctgccttggcctcccaaagtgctgggattacaggcatgagccaccacgcccaggctttttaaaaaatcatttgtttctaagtgtttcattattttttctgcctctgtctcttgactgactaggacgacagatatttgccaccacatctggctaattttaaatttttttgaagagaaaaaaattttgctcaggctggcctctaactcctggccttaagcaatcctcccaccttggcctcccaaagtactggaattacaggcatgggacactgcatccagcctgagttttaacaaatgtatgcacccatgtagatgctaccacagtcaagatatatttcagtcacccccccaaaggtttccttgtgcccctttgcaggaacctgggactgactgcactgggtggttctgcctcagtgtctctcatgaggttgcagtcaagcttttgcctgggactgtgcagtctctgaagacttgactagaactgaaggatctgcctgttggtaggtggcttcacttcctagtcatgcttctccatagagagaaaaagagtgaagccaccatgccttttatttatttatttatttatttgagacggggtcttgctctgtcatccaggctggagtgcagtggcgtaatctcagctctacaacctctgcctgccgggttcaagcaattctccttcctcagcctctcaagtagctgggattacaggcacatgccaccacatgtggctaatttttgtacttttagtagagacagggtttcaccatgttggccaggctggtctcaaactcctaacatcaggtgatctgcctgcctcagcctcccaaagtgctgggattacaggtgtgagccactgcgcctggtccaccatgccttttatgatccattcttcaagtcactttcataccttttatgatctattatttgagtcacttgttgcttagcctgttcattagaagctggtcactaagtctagcccacattcaacagggagggagggattacacaggggtgtgaataccaggaggctgggatcattgaggccatcttggaggccagctacaataatactcacttaaatttagcgaactcagaaaaaattagaatcctaatagagcggaaacaaaaagctctatattctctattatttgaaatacagttttatgatttaagaaaatgggctcatagaaattagtccttttattcattctgttgcttatgtggctatagaatattttcaaatcaagggcttctataaggaaggtctgttaacgggtgactgattataagtatataccttacatatgaccaagtcagagcacagaattttataatccttcaaatatatttgaaacttttatacccaggtacctggtgagctgtctacattggctcttaataaggatctttctcagaaatgatttaaactaataacagtataatagaaagagctctagatttgagtcaagacagtcataactattttccttaacatgtaaatgaggatcagaatgtctgccctattcatgtgcctcatgtgagaattaaatgtagtaccagaatatgtgaaaatgccttttaaattgtaaacccctgtctacagttaggcaatttgatggttctgtagggtgagattatagctaactgattgatagagtgtttgtgctacagtgtgccttaggtaagcttcacgtcaggtagttgaacaatgttggaacactacatctttcccaagtgttccatcctggtgtgttacaaacactggcagccaaaatgttcttaattctttaatctagctgtcaaaagacaagggaaaagcaactaatcagaatttaaatcattcttaagttaaaattgtgtagaccaggcaactccagttcctttgatctttcctcttaggacttatttccaattacttttatttcaaataaatgcaagtgattatggttgaccataaattattagtcttgagtggtcagattaatggtttttacatgtattctgtgtctcataaagcttcattgggattttgaaataatgattggatgtacttactttgcgatcccagtttatgactttaaagataaggggtatgaaaatcatttcataaaaggaaaaaaatgaactttacagtgctactgttcatttttttctgtggaaattgaatatgctatctcgtttttaccacattgacctcagaaaaagagaggttaaacttttctatggttgttacattcttgtttatagcttatgattttaattgatagtcaaatacattaatgtcagacatcgagaagtatttattaagtatatgtcattagagtagctacttttaaaaattttgataagttgtattttttttctttctggactttatacttaaaagtcttttaatttatttttatgagcataaaataaagcaaaatctaacaagattggatttaatgagtgaggacagaattttattttaaatggccttttctaataaaggtctatgattctgcttcttctggtaccatttacgcacttgcctgcaggatctttgtcccaaaatacatattgtgtttgtttatataccatccacaatttggcagagtttacaggacttcttgatgttagctttgagaaatccctatttaagctcaagaagttccttctctgtagatagcccagtcattccaaataaaagatctctatggtaaagctttggagtgtgattttcttcaagagaaattagacaactttacaaataccttgtcacatctggattttaagtatttcagttcgactaaaatatgaattgacagcacttagttattgacagtttagtgtattgaaatctggtttttaaaaatatgctttagataaactataatactctaataataacggaatcataaaatttagaactggtaactgcaagcttatatatatatatatatttgacacctttgtagctggcagagcgtttgtatttttaaagaaaagtttttattttagttattttagttatttttcaatctaagagaggaagtcgactttctgaaaaaattaaaatgttttggctaggtggggtggttcatgcctgtaatcccagcactttgggaggccgaggcaggtggatcacctgaggtcaggagttcgagaccagactggccaacgtgatgaaaccccacctctactaaaaatacaaaaaattagccaggtatgctggcatgtgcctgtaatcccagctacttgggagactgaggcaggagaattgcttgaacccgggaggcggaggttgcagtgggctgagattgtaccacaacactccagcctgggcaacagagcaagactctgtctgaaaaaaaaaaaattaaaatgttttaaaattagtatgtcatagtaccttccagttagagtacgtgaatctgcatacatggtaaatgcacctctgaagcacttgaagattgtgaagtcccgttttctcttcttttggattgcattatttccattttagtgtaaaggtgaaattctctttcatgacctttcctgaattacatattccaagtgagagaaggcagaaataatatgtctgagaagagcatccttcactcttcccctccttccttctactttctacatttttttttttttttttgagacagtgtcttgctctgtcatccaggctggagtgcagtgatgtaatcttggctcactgcaacctccgcctcccaggttcaagcgattctcctgcctcagcctcccaagtagctgggattacaggcacccgccaccacacctggctaatttttgtgtttttattggagatggggtttcaccattttggccaggctggtctcaaactcctgacctcaggtgatccgcctgtcttggcctcccaaagtgttgggattataggcgctctgagccactgtgcctggccttttttgttgttgtttgtttgtttttgaaactagatatctctctgtcacccaggctggagtgcagtggtgtgatcttggcttactgcaacctctgcctcctgggctcaagcgatcctcccacctcagcctcccaagtagctggaaccacaggcacgcgccaccatgcccaggtaatttttttgtagatatgggggtctcaccatgttgcccaggctggtctcaaactcctggactcaagcaatcctctcgccttggcctctcaaagtgctgggattacaggcatgtacccatcatttttttttaatggttaattcaaatgctgccaggataaagactattgaaatgttgttgtctgaagatgttaatttctttgtagcactgctatgccctagttttactatttcccattttcacttgtagtttttcaatcagcattattgaggtataatttacatgtagtacagttcacctattttaagtgtacaagtctgtgacaactgtgtattcagtagtataaccaccaccaaagttcaccattgcttcaaaaagttccctcatgcccccttgcaggtagtgttctaattgatgcagacatacatgcactgatacttttgtgatcctcatcttacagggaagaaaacgtttgtaatttctttttaacagcataaaaatgctgtttaccttcaggtgcagagactttgtttcttcaatattattctttgatgcttagttttgtacagaggattggaagctacagacaagctaaagtataatagtgatatggtagactttaattattgttcctttttttatgaaagtatgcacgtgaacagttggaaagtattatctgttataagcttttcagtttaagctgggcctcctcaaattgatgtgtgtttaggaactaagaattttaaataacatttgaagggccgggcgcagtagctcatacctgtaatcccagcactttaggaggccaaggcaggcagatcacaaggtcaggagttcaagaccagcttggccaacatagtgaaaccccgtctctactaaaaaaaaaaaaaaattagccaggcataagctgagatcatgccactgcactgtagcctgggcaacacagcaagactctgtctcaataaataaataccatttgaaatgtcttcaatgccatgtgtggaaactatttaaaaaaataaaacgtgcctcttggcagtattgctgtgctttcaggactctaatgcaggctgtacctaagagggaaagggctgagtctggggatggttggcaggttgtttttgtggatgaaaaaccttttacccatgtatgcagtcagtactgagcctttttgtgttttaaaacttcagatgtaaagacaggttaatcttcagattaaaacaaaaggatggcctagaaacttgtgacttcgacatttacattagaagaatgtagatgttttcaaataaacaaatctgcccatatcatagatgttcaaagtttgttccatataataacaatgatagtttctaataatcgtgtggccctgtttgcagaacagtgttctaagtaatgagccatttgggagaaccctttaaattttttttttaggatatttattcacaccagctttttagtcctgagtttctatccatccctttgctatccagaacatttcttggccatttttttactgggtcaggtgccgtggctcgtgcctttggtcccagtgctctggaaggccagggcgggtggatcgcctggggttaggagttcaagactagcgtggccagcatggtgaagccccgtctctactaggaatgcaaaaattggctgggcatggtggtgggtgcctctggtcccagctgctcgggaggctaaggcaggagaatcacttgaacctgggaggcagagggtgcagtgagccaagatcgcgccactgcactccagcctgggaacaaaattccatctcaaaaaaaataaaaataaaaatgcagaaattggtcaggcgtggtgtcgcatgcctctggttccagctacttgagagaggctggggtgggagagttgcttgggcctgggaggcaaaggttgcagtgagcagagatcgcaccacggcactccagcctgggtgacagagcaaggctccatctccaaacaaacaaataacaaaaaaaacccctaaaacattttttattttccttaaatgtattggccaaggttaaaatatccatcctgaatattctgtatgaaaacattggatatgaagaaaaaaagaaaattcaggcagttgaccaggggagagaattgagctttttggttcttcctgacacatattctcagtgagactatactcacttttttaaaagctatttataaaatattaaaataagatattacatgaagttaaaaattgaaacgaaagtcagcatcttaattcaccaattacacaactgaatggtgttttttgtttgtttgtttgagacagagtctcgctctgttgtcgaggctggagtgcagtggcatgatctcagctcactgcaagctctgcctcccgggttcatgccattctactgcctcagcctcccgagtagctgggactacaggagcccgccaccacgcctggctaatttttttgtatttttttagtagagacgggttttcaccatgttagccaggatggtctcgatctcttgaccttgtgagccaccgtgtctagccttttttttttttttcttttttttttttttgagatggagtttcactcttgttgtccagactggagtgcaatggcgccatctcagctcaccacgacctccacctcccgggttcatgcaattccctacctcagcctcccgagtagctgggattacaggcatgtgccaccatgcttggctaattttttgtatttttagtagagacagggtttctccatgttggtcaggctagttttgaactcctcatctcaggtgatctacccacctcggcctcataaagtgctgggattacaggtgtgagccaccgcgcctggccactgagtggtttttaatatattcacaaccatcaccattatgtaatttgtgagtatttcagaactctgaaccattttatttattttttatttatttacttattttgagacagagtctcttgtctgccaggctggagtgcagtggcgcaatctcggcacactgcaacctccgcctcccggattcaagctattctcctgcctcagcctcctgagtagctgggattacaggagcctgccaccacacccggctgatttttgtacttttagtagagacggtttcaccatgttggccaggctggtctcgaactcctgacctcaggtgatctgcccaccttggcctcccaaagtgctggtattataagcgtgagccaccgcgcccggccccattctgtttatttttgagacagactctgtctcccaagctggaatgcaatggcacaaccatggctcactgcagcttcaacctcccaggctcaagcgattcttccacctcactgggactgtaggcacatgccaccgcaccagctgtttttttttgttttactttttgtagagatggggtctcactatgttgcttagggtggtctcgaactcctggctgggttcaagtgatccttccactttggcctcccatgaaccattttaaatgctttttgagaactgcaaagcagtttttatggtgatcactaccaccggacactgtgctagatggtttacattatcactaattctcctaatactgcactgtatagaagaactgtttaattttagaacatatctggtgatagcttgattttacagctgaggaaactgaggccaggaggctaagttaaccttcaaaagtcgtattatctgtttcctggtacagccaggacccagacccacttattttttacccctaagtctgttctttgcatactacactactgctaataagtaatcattaggtaagttgatgcaaactccacataccaccttccaaagccttatttagagttattttggtccaccaagttactctactgatatatatatatcataaatatatcatatataaattatatgtgatatatataatatatgttatatatataatttatatatcacatatttatatgtaatatatatcacataaattatatataatatataaatatataatatataaattatatgtcaatatatatagcattatgttctaagacacacacatatatatgtatatataacgttctaagactttcagggattcctgtactgttgatagtaccaaatcctatatatgtgctgtttttttcctatacagatatacatatatacgtatgataaagtttagtttataaattaggcacagtaagagattaacaaccttaactaataataaagtagaacgtggccgggcaaggctgctcacagctataatctcaatgttttgggagaccaaggcaggaggattgcttgagtccaggagtttgagaccagcctgggcaatatgagaccctgtctgtacaaaaaagtttaaaaattagccgggtatggtggcatgcacctgtagtcctagctatttgggaggctgaggtgggagaattgcttgaacctaggagtttgagcctacagtgaactatgattgagccatgacactctagcctgggcaatagagcaaaaccctgtctccaaaaaactaaaagtttaaaaaaataaagtggaacactaataacaatatacagtaatcaatgtaaaattaaggttatttgaacataagcactgccatactgcagcaggatggccactaagtaactaatggacacattccttataaaacatggatgtgctggacaaagagatgattcacctctctggagagaaggagtgcaatttaaaacttatgaattgtttatttctggaatttttcatataatatttttggaccgtgattgactgtgagtaactgaaatcatggagagcaaaactgtggctaagcggggactactgtacttgatgcattttccttttaggaattcttttaagttatttttcatttgttagatgtgtcttacaaagaatagataaaaacatgtacattttaggaataataataaaaggaacataggtatagtaggactgatgttccgtatggtagctattatacaatccacatgtggctgttgaacacttataatgtcgctagtgtgaattcacatgtgatgtgtgaaaaaacacaaaccagattttgaaacctggtatgaaaaacaaaaataatgtaatgtatttatatggatccaaaatgtaatatatatatggatccaaatatatgtatatatatccaaaatatatatccaaaataatgtaatatattgctatatatatatatgtacacacacacatacatatatggatccagttttatactcattattttttctgggtttgtttcacagtgtgtttttgtatgtatttctatcaacttaactaaattagttttctaagtgtcatcatgaatagcataacctgccacgtttatgtaaaacgtgagaaatgtctaaatgaccaacatatataggtaaaatgtttaagctgagagccttatttcaagtctacgttaaatgtattatatgattttggtgttttttttgtgtttttttttttctgagttggagtctcgctctgttgcccaggctggagcgcagtggcgtgatcttggctcactgcaacctccaccttctgggttttaagctattctcctgcctcagcctcctgagtagctgggattacaggcatatatatatatgtgtatacacacacacacacacacacacacacacacacgcatacatatatatagcaataggaatatatatatatattttgagacaagttctggctctgtcacccaagctggagtgccgtgacacgatctcagctctctgcaacctctgtctcccaggctcaagccctcctcccatgttgcccaggctggtctcgaacttgtgagctcaagtgatccacctgcctcagcctcccgcagtgctgggattgcaggcgtgagccactgtgcctgacccaagatattgcttgcttgataccatgttgaaaattttagatgttttgagttaagtaacattattaaaattaatttcacctctttttactttttaaaaaatacctactaggccgagtgcagttactcatgcctgtaatcctagcactttgggaggccaaggtgggaagattgcatgaagccaggagtccgagaccagcctggtcaacatagtgagaccccatccttaaaaaataaaaacattttttaagtgactgggcatagtggggtgtgcctgtagtcctagctcctggagaggctgaagtgggaggtttgcttgagcccaggagttcaaggctgtagtgagctgtgatggtgccactgcaatccaacctgggtgaaggagggagaccctgtctcttaaaaaaaaaaaaatgcctgctagacaatttacagttacatatgtggcttgcatttgtgattcacattatatatttctgttgaacagtactgcctgcacagttggccaggtatggtggctcacacctataattgcagcactttcagaggttaaggagggaggattacttgagcccaggagttacagaccagcccgggcaacaaagtgagaccccatctctacaaaaaaataaaataattagccaggtgtcgtgatacaggcctgtagtcccagctacttgggaggctgaggcaggaggatcccttgagtcctggaaatcaaggttgcagtgagctgtgttcataccacagagcaagatgctatctcaaaatgagtcctggaaatcaaggctgcagtgagccgtgttcataccacagagcaagatgctatctcaaaaaaaaaaaaaagaaaaaaagagaaagaaaactttacagttcttttcctcaacccgtctccccccacaaaataatcactatcctgattgatgtatttgttcccttacttttctttgtcattttatttcctgtgcatatatctctaaataacgcattgtttagtttttaaaaaaaatgaaactaggaagcacacacttcagggcagtgtaaacaacggactctaatgtcactttctctctttttttttttttttttttttggtgagaggagtcttgctctgtcacccaggttggagtgcagtggtgcgatctcggctcactgcaagctccgcctcctgggttcacgccattctcctgcctcagcctcccgagtagctgggactacgggccccctcaccaccacacctggctaattttttgtatttttagtagagatggggtgtcactgtgttagccaggctggtctcgatctcctgaccttgtgatccacactcttcggcctcccaaagtgctgggattacaagcgtgagccaccgcacccagccttctaatgtcactttcagatgcagctcctagaagatgagctgaacagaatcttagggtcaagtccggattcagcttccctgtgaatttttagagcctccctggggaagcttgtgagcacagtcatgagtggattatgggaaacctagggctcacactggagttagggcatctggcacactgaaaccattgctcaccgtgtgccggagatgtggaggaatatggtcagagggagttagctgctctggtattttctgcttctaggctcaccatgacctaccttcttttatcctttttttttttttttaatttcttttgtcaaaattgatgtctcattccagagctaccttcttttcacaggagtgagtcaaagcacatcacctttgtcagctcaaatgagtgtccttagctggtcccagcagtggggaaggcttatatatgagcattttgccctcaggatcttggtgatgaccatcctcagaatgtccatctcttcaatctagactgattgtcctctatatccagcgcactgctttcatactgatttctgtgttcatcctctgctgtgaggggcttttttgtttttttctttttgtttctttttcagtttttctgtcttcctgtttcttggtttacggtctctttgtggataacagagttgttgcatatttgaagtgtctttattctacgatactttattgtaagtttgtcttgttctagagtttgaggttagagattattttcgttaagaaggccttgtttcattgtcttggtttaaatgttgcagttgaaaatctctgaagtcattgtgtttcctgatctgtttgtgaccaatttccccgtctttggaagtttgtaaaatctttgtctccatgttttggtatttatctatgatgtaacctagtgtcggtccacagtcattccttgtgcagggtacttgccagccctttacagtatggcagctgtgtccttcgtaaggaaattttcttatattaattgatgacttcctttcttatattttttctattcttttctggaacatctactatttggatgttagacccacaggaatgatcctgttaccttattttcttactgtctcttttgtctttttggtctaccttccagaagatttcctctactttatcttcagagtcttatattgggtcttaatttctactatatttcaacagagctttttgtttgtttgtttgttttgagacggagtctcgctctgtcgcccaggctggagtgcagtggtgcgatctcgcctcactgcaagctccgcctcccgggttcacgccattctcctgcctcagcctcccacgcgtagctgggactagaggtgcccaccaccacgcctggctaattttttgtatttttttttttttttttagtagagacagggtttcaccaagagctcttttttgtgtgtgctacaaatgttccttttttgttagtatcctcttcttgtttatcgggtacattttatctgagaatctagctggtagatttttactgctttacatcacttcagaggaaatggctgcaactgaagggtgaaagtcagaatttatcttggctcagcttttcatgtaagaaaagaaaaatacagtgaaaccaaattaaaataattatgtggagagcatattggtggcaagttaatacatttttatgactttttggagggtctaatttattcttaacagaagtctgagtttagtatccatttattgaatatgtatttatatgtgtatacgcacacacacacagtgtattaaatctattgaattccagacactttctttttttttttttttttttttttttttgagacggagtctcgctctgtcgcccaggctggagtgcagtggcgcatctcggctcactgcaagctccgcctcccgggttcacgccattctcctgcctcagcctactgagtaggtgcccgccaccacgcccagctgatttttttgtatttttttagtagagatggggtttcactgtgttagccatgatggtctcgatctcctgacctcgtgatccatctgcctcggcctcccaaagtgctgggattacaggtgtgagccaccacacccggcctccagacactttctttagtttttcattttatgatttctcttttggactgtaagatgatcggtaaattacattaaatcactatagaagaagctatttttacacatacatgcaacccagttatgattcagaggcaaacaagattgaatgactgtagagattatctgacagttgagcagctgactgtccatttatgaacagggaggtgcatgtggctaaaggaggatgagtcagaaccaagtatcttctaaaggaatctgttgaatagactacagaaatgattacagcaagcgacagggtacatacttcttcagtggaatatcttgttttcttgggtgcctatggccatcccagtattactgttggatgattcattggtctgtgggtaggaacaactcttcattgtcagggaaaaaacagcatgtctcctttggaaagaaattactgtcagtgttgctgtgatgttctctatgttttataagttttcattttgtgctttttgttggtgatttcactgtttaaaatggcccacaagcataatgttaaagtgcagtctagtattccttaaatgcaagaaggccgtaatgtgccttatggagaaaatgtacatgttagataagttcccttcagtcatgagttacagtgctgtcagctgtgagttcagtgttagtgaatcagcaatatatattgaagatgatgtctgaacagaagcatacataaaacaaaattatgtattgatcagttgaggaagatgttaggctagaaggaacctacgtctgcatttcccctaggaacagtggtttagtgttcactgatacagtgttcatgtagatttgatagagtataacaatggcaagtcgtgtgtgtgtgtatgtgtgtaggcttaatggttttctttacccagtatttactatgtttttttccattaacagcataatgtaaacatcccgtgtaacatgcttgtttttggtggtgagggatgcttgtttttggtggtcaaggatcagcagacctgcctggattctagcaggcttttttttttttttttaagacagagtctcgctctgtcaccaggttggagtgcagtggcatgatctcagctcactgcaacttcggcttcccgggttcaagcaggtctcctgcctcagcctcctgagtagctgggactacaggtgcgtgccaccacacccagctaatttttgtatttttagtagagacggggtttcaccatgttggccaggatggtcttgatctcttgacctcgtgatccacccttcttggcctcccaaagtgcagggattacaggcgtgagccaccatgcccggcctctagcaggctttttatttttgagatggagtctcactctttcgcccaggctggggtgcagtggtgcaatcttggctcactgcaacctttgcctcctggattcaagtgattctcctttctcagcctcccgagttggtgggattacaggcacctgccaccatgcccggctaatttttgtatttttagtagagacggggtttcaccatgttggccaggctggtctcgaacttctgacctcagatgatttgcctgccttggcctcccaaagcacatggattacaggcgtgagccaccgcgcctatcctctagcaggctttttaaaggtcagtgttcaatttggaagtttatttattcagctcattatcattgggcgtctaggttatttctgatcatttaccattatttacaaaaatcccctgagaatgaacattcttgtaatagaatttttttttacatctttgattaagttttaggctaattcacagacgtggcattgctgtgtcaaaggaaaatgcacccttattcccccaaattgccttcccaaaatcattagccagtttaccctccccctgacaatgtaatataacctgttttccctcctgatacatgttattgaaatgtttttcaatttattttaatatttgttttaaaatagttatcttgttctgatttaatatgttagtgaactttttttcataatttttggttagttatgttaattttgttctaaactattcttttccacatggttagccagttttttcaactccactggttaaataaaatatccttttactattgattttaagtgttgcctttttcatatgttaagtatttatatacttggtttcatttttgaattttttggttttgttccattaagttgtagctgactgccacagcactcctatatatttattggttgtgttgtatgttttagtatctgaaagggcaaaaaattactctttctctaatttctcatggatggcctgattgttttatgtgaactgtagacttcccaaattctaaaaaacattattttgatatttcagatatttcattggaattttgttgaagattactttgggataaattgtcatttgtagtctttccagtcatgaatatgacatcacactagttattcaaatcggttgttgttgttgttgttgttgttgttgttgagatggagtcttgctctgtcgcccaggctggagtgcagtggcaccatcttggctcactgcaacttctgcctcctgggttcaagtgattctcctgcctcagcctcctgagtagctgggattacagttgtgcgccaccatgtccaactaatttttgtatttttagtattgattggatttcaccatgttggccaggttggtctccaactcctgacctcaagtgatccacccacctcagccttccaaagtgccgggatcacaggcgtgaaccaccacgcccgaccaacagttctttttttatatattcagctcttcctcattaaaaactttaagttaatgagcagtgctattgtagtgctggaatctctttttgggtgggtgaaataaatctttttgaactcatcatatatccccactgcccttataagcatttcctgcacatagttaacaggtaataaacatttgtggaataggtggatcttttcaaatggaaattattataggaaacttacaagaaaaaaattctagattctagctgttttctgttcttctattaatcagtatttaaatatttactgagaacctaaggagtaatgaatgatcacaccctcttacgttttcttaatacgtcagtttatagactagagccaccagtgtttaagctctaacaacttattacagagaatcgagatatcctttccaatcgaaagggattttttgatagtgaagtttcagcttcttgcttttgtcaatagctttgacacttggtttctgtgtgtattgattttatgactcagtactgatgtgcatgggggtcttgtttgcaaatctgtagttactctgttttaattgccttgaaattctctttagaatcactcaaaagagggaactctgccatccctttgtacctttaatttgtctcctcatctcggctacctagaaactatgatcttttctgtaagttatatagtattgtaaaggaaaagacaggtaaggatgccactgcttattccaaatttagatattcatagaataagtaccttccagaccctcaaagaactatttgtacaggttaatacatgagaagtagacttaggttcttcctttgatacttaaatttcaaaacacaggattagtaatatttagctacttaagtttggttcatttgctaaaagaagaacatttaccatctcaggccctgtattagaaggatctttgtgtctgtgagagaaaaggcagaatggagtttttctatcataattgaatccgttttgccttgcacacccctttggagcatttgatgaaagcagtggacttcattagaaaaatgcacatgggctcaaacacatacatttttgcgcagcgacgtttctggccttcttgaaacatatctgtaagcccaaacccctgtaggttttctgaactccatctaatgcagccaacaaaggggaaattttaaatggggcctgtaacaacctttagcctgcgttccttcaggtttcttcactggctgttcatagcctgccctgctggggttttttcttctacccagcatctaaaagttggacttgctccagattcttcctgggtcccttcttttcccctgcttactctgggggtctcttcctttcctctggatttaaataccatggtattgttgatggctgccagatttataacagcccggatctattctcagaatgctggaatcccatatgtaactgcctcctcaaaatcttgatttggatatctcatagatatcccttatatgtagcagataaaaattgttgcaaacttttaattctttctttctttctttttttttttttgttgagacagagtttcgctctatatcccaatctggagtgcagtggcacgatcatggctcactgcagcctcgacctcctgggcttaggtgatcctccccacctcagtctgcagagagtagcggggactgcatttgtgtgacaccacacctggctaattttttaaaatttttgtagagatgaggtctcactatgttgccctggctggtctcaaactcctgagctcaagcagtcctcccaaagtatgctaagattacaagcgtgagccaccactcctggcagcaaactttaaaaaatgacagctcattgagatacaattcacataccataaaattcactcttttagagtgtacgattcattgatttttagtacattcggagttctgcaaccatcattaccatttaatttcaaaacattttcgtcacaccataaagaaatcccatacatggtagcaattactcctcatttgccactcccctgtgcccctggcaactacttatctccttcgtgttgctctgttgctctggatttagctttctgtacgtttctggggggttttttgtttttgtttttgtttgtttttttgagacggagattcagtctagttgcccaggctggagtgcaatggcgcgatcttggctcactgcaacctccgcctcctgggttcaaacgattctcctgcctcagcctcccgagtagctggggttacaggcatgtgccaccacgcccagctaattttgtatttttagtagagacggggtttctccatgttggtcaggctgatctcaaactcctgacctcagatgatctgcccatctcgcctcccacagtgctggaattaacaggcatgagccactgcgccagccagctttctgcacgtttcatataatacgtaacctttttctagcttcattcacttagtattatgttttcaaggttcattctgtgttgttgtgtgtataaacatttcattcctttttatgaccaagtaatattccattgtatgggtgataccacagttgatggtacaaacatgtttttgctgaagctctgctgcatgagtggtgggaaatttaaagccacagaatgtgaaaattaggtgatatcatgtataatttaaattgaatataacatcacaaatacttatatttagagcttgagatgattaaaaattgtgttaaactagcttttcccttacttttccagaagaacacaagatgtgacactgtagtcactttttaacctgctgtgaagtctcaaacatatttgtgatattttacttttggaaagataaactgttttcttgtttttctcatgtatggttagctgcatctgtttacccattttaaatcaattttgtataaaatatttcattgttctaggacaatgggtttaatccctagttcatattctaataacttttctttttaaagtttgaaataaggaatcattttcagtgaaaaactgtctttgtgcttaaatgacattttttttgacagaagcatttcactgtgtattaaatgacattattgaattgcattataaaatgccaaactgttgagacagaattttattttctttatactttgaagtttggtattcatgaatacatgaaagcaccaaacatttactttgaagatgtacacataaaactgtatttatttgaatgagaacatctaaataaatcagtaggatcatctaaatattatttttaattataattgcagtcattagtcttgattaaaaattgtcatcattttctggctgggtgcggtgactcacacttgtaatcccagcactttgggaggctgaggcaggcggatcacctgaggtcaggagttcaagactagcctggcaaacatggtgaaaccccgtctctactgaaaatacaaaaattagcggtgtgtggtggtaggtgcctgtactctcagatacttgggaggctgaggcaggagaatcctttgaacctgggaggtggaggttgcagtgagccgagatcgcaccactgcactccagcctgggcattaagagcaaaactccatctcaaaaaacaaagaattttactcattttctgaaaccatttagaaatttcccaaaacagatcattggttttctttgtcatgaaagaacatttataaataagtaataaatgggcttttaaaaaatttagtaattttataaggaaattttttttttttgagacagagttttgctgttgttgcctagactggagtgcaatggcatgatctcggctcactgcaaactccatctcccgggttcaaatgattctcctgcctcagcctcccgagtagctgggattacaagagcccaccaccacgcctggctaatttttgtatttttagtagagacagggttttgccatgttggccgggctggtttcgaactcctgacctcaggtgatctgccctgccttggcctcccaaagtgctgggattacaggtgtgagccaccgtgcccagccaggaaaatatttttgactatggacattaatatgaataagcctggcccggtgcggtggctcataccctgtaacccgagcactctgggaggccgaggcgggcggatcacctgaggtcaggagttcgagagcagcccggccaacatggtgaaaccccgtctctactaaaaatagaaaagttagcaggatgtggtggcatgcaccagtaatcccagccactcgggaggctgaggcagggagaatcacttgaacccaggaggcagaggttgcagtgagccaagatcatgccattgcacttcagcctgggagacagagtgagactctgtctcaaaaataataataatttttttaaaaagaataagccaagagattgtggaatcttcaattctaaagaatataaatcatttatgactaatataaaatccagttcaagtggtgtaaagttgactttgctattagaaaagatgtctccatgattagaatttataatgaggtgtgctaataggtgaaatgacaatccccagtgcatgctactccgtccacctgttagccttctaacagggtttaagattaatgaagatttctggatggaaatcttcatgagagatggtaaatcaagattcactgagatgaaataaggggtattgtttttaggttttgtgatgggttgagcagaggtcggcatagtcacttgtttgatttgatgcacattggtggagttttaaatgcacagtgtggaagggaatgagcacttatcagaacagaaggaaatgtgtggttaaacggtttcagttgtaactaaagactatttcccttggtccaaataggaggagaaatggaaccttttgtattttggttattttccaatataagtagaaattggttcattgtggtttattgcagcccttagcagaaatgattgggttcagtagtgaaggggaatgacacaaatatgtaccaggaaagcataaatttttatttattttttatttttttgagacagagtcttgctcagtctaccaggctagagtgcagtggtgcgacctcagctcactgcaacctctgcctcccaggttcaagcgattatcctgcatcagcctcccaaggagctgagactacaggcacacacacccacgcccagttaatttttgttatttcttgtagagacagggtttcatcatgttgtcccagctgatcttgaactcatgacctcctgccttggcctcctaaggggctaggattacaggcatgagctgctgcggccagccagagggtataaattctataagtactattttaaaggtatctcagaggtaatttttttatcatgtttataattattggcagtcagttattgttattaaacatctctaaaaacaaaaagaatccaagagtctgaagagactactgaaatgagtttcaaaaaaaagatgcttccagctttttcctcaaaatgagaaactgttttacagatttttatataattaaacaggtaataaataatgccagattttagctcacaaagcactggatttcccaaaggaaatacatttggtgcaggtaaatgaaaagcctcgttaataaatatatatttgataatctgcaggtttgaaaactcactgaagaattcccacttcctctgcattaaaaataccttgttcaaggcagtaaatattaacctatgctggtttattcagaaactcatgttaaacaaggtagagaagacctaaaattatgtgttttgtttgtttatttgtttttgagacagagtctagctttgtcacccaggctggagtgcagtggcacgatctcagtttactgcaacctctgcctcctgggttcaagcgattctcctgtctcagcctcccaagtacctgggattacaggcacccgccaccatgcccagctaatttttgtatttttagtagagacggggtttcactttgttgtccaggctggtctcgaacttctgatcttgtgatccacccgcctcagcctcccaaagtgctgggattacaagcgtgagccaccgtgcccagccctaaaattatgtttttaaaagtaactattaggttagtgtggtattaggagtgggaagattgtagaaactgtaataaatttctcttatattgtttatctctatcacaataaaatattcacctcaggatgatagaattaacaccgtcctttctgggtggatagttactcttgggaacaattgtattttgagccaatatgagaattaatttggtgatcaaaaatgatctaaatttgggtatgatgtatacctaaagcaatttttattctagagttatttatttacttgaaaaagaatggtgcagaaatgggtttttgttttttgttgttgttttttattgttgttgtttcagaagaaaagttaataaaagtgtaaaacagaagttttcttttttttctctctcttttttttgtttgagacaagtctcactctgtcacccaggctggagtgcagtggcactatctcggctcactgcaatctctgcctcccgagttcaagtgattctcttgcctcagcctcccgagtagctgggattatagctgtgcgctaccatgcctggctaatttttgttatgttcagtagagatggggttttgccatgttggccaggctggtctgaaactcctgacttcaagtgatccgcccaacttggcctcccaaagtgccgggattacaggcatcagccaccgcgcctagccaggatgtaggaattttctcatgaagctgaaggttcaccagatgagagatacttttggtttcaggaatcttgaagatctttttaaaatttattggtacttttttaaactgcagtgcataaagtatagtgaacatatttaatttgtcagtgacttgagatgttaccatatcctaggatacttattttcgatatttctctaatgtgtaagtagatatacttgttggatgtgatacagtatgaagcctggctaattttgtcatctaaaggtattatgtgtaaggaataaacacatttccatttattaagaattcaagatgcttggttaagtttattcatttttttatttttatttttttactttttagaggtgaggtctctctgtgttgcccaggcaggtcttgaactcctggcctcaaatgatcctcacaccttggcctcccaaagtactgggataacaggcattagccactggtgcctagcctttttgtcttagttgattttgttatagtatttaagaatttcaacagggagttgaaataagtagattttgggttaacttaccagtttctagataaataattgatacatgtagtcaaaccctgtgaccttaaaacttttctactatatttaaaagactgattcaccttactgttgcctattgggaaaagtaaaaaataaataaataaaaaactgtgaaatagcttgaattaaatttcataagtcccatataaaggatagcagtgttttgttccgaattatttatggacacctaaagataaccacatactacttaatgtgatataatagtaaatattataccagttaaagttctttggttaaaagcagtagaaatcaactctggctaacaagacaaaaaaataaaaagaaaaaaagattaattatcaggaatctgtgagatagcttataaaactgaggggagtatcaacagcctgatcctgcatgctccaggaacccacgttgagggaagcagtgcatgctctcttcagagggtggtggcttccaattgttttccatctttctacccaacattcaaaaatcaaagtgtctggccgggcatggtagctcacgcctgtaatcctagcacttttggaggcaaaggctggcagattgcctgagctcaggagttcagcaccagcctgggcaacatggtgaaaccccatctctactaaaaatacaaaaaaaaaaaaaaaaattagccaggcatgatggtgagcgcctgtaatcccagctactggggagtccgaggtgggagaattgcttgaacccgggaggcagaggttgcagtgagctgagattgtgccactgcattccagcctggggagcacagcgaaactccatctcaatcaatcagtcaatcataattttattcatcttttctacagagtttatataagtaagtttaatctttttattttcatgtgtctgatggttttcaattattttcatccttttctgtgtcttaggtatatttgaaggctcccatgattctgaatggagtctgtgttatctggaaaggctggattgatctccaaagactggatggtatgggctgtctggagtttgatgaggagcgagcccaggtagggtaacatcaggctttattgagcatggtccctttagtccctaatcttgcctttgcctggggacctattttacccaatttttaagagtaagtatagaaagtattgtgttgaagcaatattgaggaatcctgaaaatgttgatactcaaattctgatcctgattttgggaaagttttttcttcagcagttctaaatttcatgggttattcgtatctgctcagtgggtgcttcaaagtccagcaagtagctctttaaaatatttattcttgatctttagaacactatgaatagggaaaaaagaaaaaactgttcaaaataaaatgtaggagccgtgcttttggaatgcttgagtgaggagctcaacaagtcctctcccaagaaagcaatgataaaacttgacaaaaattgtttaaaaaaaaaaaaaaaaagctggacgtggtggctcacacctgtaatcccagcactttgggaggctgaggcagacggatcacctgagacttgaggtcaggatttcgagaccagcctggccatcatgatgaaaccccatctctgctaaaaatataaaaattagccaggcatggtggtgcacacctgtaatcccagctacttgggaagttgaggcacgagaatcgctcgaacccaggaggcagagattgcggtgagccgagattgcgctactgcactccaggctgggcaacagaacaaaactctgtctcaaaaacaacaacaacaacgaacaacacccatttaaggcctcatggaagctattgaatctcagtaagatcagtgacagtctgtgtcattttagtcaggagctgctcccattccccagctctgtggtccctcaggttcttccctgggcgggcagggtaagccatgagcactggtagatctgttgtcctgtcaaagagagctgactttattaaaagcagggcttgggaaaaaaaaaatccatgcccaggcatattgtttaaaatgatagaggtctcatttgctaacagtctggcaaagctagtgttgcagaaagcaacaaaatggcagaccagccagaaatttatcagggagattcagggaaagtgataggtaaagtagaccctactaagattacactcatgtcatccagaaagctgtgtgcatgtacaaggctacacctgctctcttgaagagaacacagaaggtccttgcatgctacttttccctggatgaacacaaggtagactggcaaactccctgatctttgaaagcatttccccaagctacacacaagtccagtggcaaaagatggaagtctgctgactcaagatgtttgggtaaaaactctgaccagtcattggctgacggctgaactatgctgatccaggaacaaccccccagaaagcaagacttaaaaaagacagctgtgcgcagtggctcatgcttataatcccagcatttggggaggccaagatggcaggatcacatgagcccaagagttaaagaccagcctgggcaacatggtgagaccccatctccacaaataattttaaaaattaaccaggtgtggtggcatgtgtctgttagtcctagctacttaggaggctgaggtggaaggatcgcttgagtccaggagctcaaggctgcagtgaactatgatcatgccagtgtactgcagcctgggcaacagagtgagatcctttctctaaaaagaaaaaaagagaaaaactgagcagtgacatcagaggctgtgcactgctgtggaaaacagactcctcagaattagtccaggcgagtcactaaacaaacaaacatcaacaacaagctgaaagcaaggatcagaagtcagagttgctacagtatattatctaaactgtctggttttcagcaaaaagttatgagatatgcaactatgaaaatgcaacttatacaaaggtgaaaaagcaagcaatataaactgtctttgagggggcccaagtgttggttcttagtgagaaagacttcaaagtagttgttataaatatactgaaagaactaaaggaaaattctttccttttaatgttaaaggaaattatgatggcagtgactaattaagtagagtatatcaataaagggatctaaattattaaaagaatcaaatagaaattctggagttgaggctggccgtggttggctcatgcctataatcccagcactttgagaggccaaggcgggcggatcacctgaggtcaggaattcaagaccagcctggctaacatggtgaaaccccatctctactaaaaatacaaaatcagccaggcatggtggcgcatgcctgtaatcccacctactcaggaggctgaggctcaagaatcacttgaacccgggaggtggagattgcagtgagctgagattgcaccattgcactccagcctgggcaacaagagcgaaactccatctcaaaaaaaacgccgagtgttgtggcatatgcctgccatcccagcttctcaggaggctgagttaggagaatagcttggacccaggaggcagaggttgcagcaagccaagatcgcatcactgcactccagcctgggcgacagagcaagacttcatctcaaaaaaaaaaaaagaaattctggagttggaaagtacagtagtaacaaaaagttcacagactaaatggtagataagagctgacatatgaacaagaaaaattaacagtcttggggacctgtgggacaccagcacacgtattaacataaatgtaatgaaagtttcaggaaaggaaagaaagaggttgaagatacattttaagaagtagtagccaaaaactctcacgtttgatgaaaaatattaatccacattgtccaagaagctcaatggacactaagtaggataaacacaaagaaatccatacctagtcacattataaactgttgagagacaaggaatcatgaaagcagcaagaaaggattcctcacacgcgaaggaaccacggtaagattaacagctgacttctcttgaaatcatagaggctagaaagttgtgggatgacatattaaaagcaccaaaagaaaatgtaaaagcagattgggtgcagtggctcacacctgtaatcccagcactttgggagaccgaagtgggaggatcacttgagcccaggagtttgaggctgcagtgagctgtgatcgcaccactgcactcaagcctaagtgacagagtgagtccctgtctctttaaaaacaaagaaaatgtaaaagcacctgattattagcaggtattaatgtcttttaattgtttgcttgatattaaccttaataaagttaaaataataacaggaacataaagaaactctttgtttctttgttgtatcttcccatatagttctttatatatggaaatgtaagaattttctttaaaggagatcaaaaaattaaaactttctagtgaaaagcttaggattcaaagttaaaagtcttaagaaagaattcttggtctggcccaggccatcccagtggcacatgcctgtagtcctagctacttgggaggctgaagcaggaggatcccttgatcccaggagttccagcccagcctaggcaacataatgagaccttcatctctaaacataaaaataaagaaagaatccatgcactaccctgatttccacaatgctaatgaatttccaattctttcagaaaaataataaataaccagcaatctaaaagtctattttctgttaagaagtgataaagcagactttatttatataaggaaaattcagattggattgacttttaaaaaactaaagtattttgacagggtgcagtggctcacgcttgtaattccagcacttggaaaggcagagatgggagtattgcttggtcccaggagtttgagaccaacctgggcaatgtggcaaaaccctgtctctaccaaaaaaaaaaaaaattagccagctgtggtggtgtgcacctgtagacccagctactcaggaagctgaggtgggatgattgcttgaacccaggaggctgagattgcaatgagccgagatcacaccactgcactccagcctgggtgacagagcaagacaagaccctgtctcaaaaacaaacaacaaaaactaaagtattttattaagataataggttaaaatttttaacattttttatacttggagttttccaagccttatttccatagtccccaaattgaactatatcactacaaattaagtgccatctgttgtgatagtttactactatcacaatggagttacataactcttaccgataataggagttatacagtgtatagtaaaaaaaattcagagcaggtgactccaactatttaggcagcaatcagtacttccctgtagctccccttgtccccatctgcaagataatataagtaaagaagcaatgaaatgtagatgctaggggcaggagttcatagtcgtataatgtgaatcctggccccactacttaccagctctcatgaactgaatgtttgtttaccccatccccaaattgatatgttgaagccctactcccgttgttactgtacttgaagatagggcatttatggaggtaattaaggttagataaaggcgtaagagtggggctctgatccagtagggttagtgtccttaagagacaggagagagctctctgtctctctctctgccgtatgaggacacagtgagaagatggatgtctgcatgccagaaagaggttcctcacggggaaccaaattggctggcacattgatctgggattgctagtctccagaaatgtgagaaaataaatttctgttgtttaagccactccatttatggtattttagtatggcatcctcagatgactaaaacactagctgtgtgatgctggcaagttattaaatctctccaggcctcagatttctccttcctaagatgggataatgctgcccacaagattgtgggcagttgaatgggatagcatatgtaaagggctgtgcctagcacagtatctagcgtgcagtacagttcctaaacaaagactcttgtttgttactgcttgtactttagcattttatacttagggtttccactcttctccagatgtctgtcttgtgaagtagtgtgtaaaatcacaaagcatggatttcagccctctttcactgggctggaataggccccatctctagcgagtgagccggtggcagcctcacttccatggcccaacacagctttgtttctctctgctgatcacacaggcagaaataactcttctgaattaaccaaaaaacagttttttgaaaagttaaagttcatggttaatgttatatcattcataatgtaatataatttgatataggatgagagtgaccatattacttattgtaactgtattattcctaaaagtataaggtcatgtttaactgaaattatataatattttgacccacaaattgattttattatattgctagccctagaaaaattgtttcattcaaaaaacatttttaaaaatacgtttttaaataaaacaacatgtgcacattacagcaaaataaaagttatatctttatgctaatcttctgaacattaagattaataagcagaatacttagtcttgatatttattcatgcactttattagtctcttatttatatctgtatctaatatttttctgaagaatatatagatttttcaatatggtcttgtttttctttttttttcttttttttttccagacagagtcttgctctctcaccccggctggagtgcaatggcacaatctgggctcacctcaacctccgcctcctgggttcaagcgattctcctgcctcagcctcctgagtagctggggttacaggcatgtgccaccatgcccggctaattttgtatttttagtagagacggggtttctccatgttggtcaggctggtcttcaactcctgacctcaggtgatctgcccgcctcagcctcccaaagtgctgggattacaggcgtgagccaccatgcccggcctcttttttctttttttttttttagcgacagagtcttgctctgttgctcaggccagagtgcagtggtacaatgacagctcactacagcctcaagctcctgccgtgcttggctaattttttttatcttttgtagagatgaggtcttaccatgttggccaggctggtcttgaattgctggcttcaaacgatcctcctgccacagcctcccaaagcactaggattataggcatgagccactgcatctagccccttacttttattttcttcataaaagtgcccacaatatgcttcagagttgcatattataattagtaaatttggaacagctgacatcttcaattgagtgtctgtaaactacgtaaaaaattgacaaaatactctaacaaatgctgaagtatctggtaaactaagagctaaatggaagagagtcaattccatttttgaaagattaaattgtataactatttcagctgaaatattttcacaggtattgtctctgcttttgtccagagtgcctttctttgacaagtttggtataagacaatacctgtcaaagctgtctctatttatgattctgtctctatttatgattcttctgaaaattttgccaagttcagttacttcagaatcaaatcatttccagttaaaaatggaattccatccaagattcttttcccaaaaagaaacagaagacatgtgaccagatgcagtggctcatacttgtaatccctgcactcttgagaggccgagacaggtggatcacttgaggtcaggagttcgagaccagcctggccaacatggtgaaactccgtctctactgaaaattcaaaaattagccatggtggtgcgtgcctgtggttctagctactcaggaggctgaggcaggagaattacttaaacccaggaggtggaggttgcggtgagccgagatcgtgccattgcactccagcctgggcagcagagtgagactccatctcaaaaaaacacgaggccgggcgcagtggcttatgcctgtaatcccagaactttggaaagctgaggcgggcaaatcacctgaggtaaggagttcgagaccagcctggccaacatggtgaaacccgtctcaaccaaaactacaaaaattagccgggcatggtggagggcacctgtagttacttgggaagctgaggcaggagaatggcatgaacccaggaggcggagcttgcagtgagccaagatggtgccactgcactccaagcctgggcaacagagcaagactccatctcaaaaaaaacaaaaaacaaaaaacaccaagctgttatttgcagaagatgcatgtacttagaaaatctaagataatttacacactattaagaaaactaacacatgaatttcacagggcattagatgtaatacaaggtcagtacaccatcagttacatttctatataccagcaataaacaaagacaaaggtgacactgcagtgcagacaagggtggggggcagggggtaggtctcttcagtaaatgatgctgggacaataaaacatttctgtgaggggaaaatatatcagagccccttataccattcacaaaaatcaatttcagatggatagcagtttataaaatgtaaaacagtaaagctttttttttttttttgagacagagtctagctctgtcaccaggctggagtgcagtggcgtgatctcagctcactgtaacctctgcctcccgggttcaagtgattctcctgcctcagcctcccaagtagctgggactacaggcacgtgccatcataccctgctaatttttgtatttttagtagagacgaggtttcaccatgttggccacgctggtctcgatctcttgacctcatgatccacccgcttcggcctcccaaagtgctgggattacaggcatgagccactgtgcccggccgaaacagtaaagctttttaaaggaaaatgagaagatcattttgtgaccttggagtaggcaaaaacttgaacaggacacaaaagatgctaaactgtaagtaaatggataaataacgaattatggcaaaaccaagaactgtttatcaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctcaaaaaaaatatgtgtgtgtgtgtgtgtgtgtgtgtgtgtgtgtgtgtgtgtaaagaactcttacatttcagtgagaaaatattttcattgaaaggaaacacagacaacctaaaagaaattggcgaaagacatttaacaggcagttcacaaacaggctatgcaaatgaaaaggattcagctttcttggatcatcagaaaaataattattaaaaccacagtactaccacacagtcatcagaatggttcaaatgaagaagacagtaccaaacattgacaagaatgtagagcagcagttggtgtgttggttatgtaagattggcacaacatttggaaaactggctgtaaatatgcaagctgcgcatgcatatatgtgtgtgtgtgtgtatatatatatacacacactatgatctagcagttctactccaaggcatgatggcaacaggagtgaatatgcatattcatcacaaaatatgtgctaggacatttataactattattagtaatagctagaaattgtaaactgcgcaaatggccattaacagtgaaatttataaagtgcgtggtcacacaaatacactgagaatgaaaagctacaactaacaccaatatgtgtgagttcctcaaaaatattgagagtacagaacaggccagttatggtgcctcacccttgtaatcccagcgctttgggaggccaaggcaggagggttgtttcaggccaggagttgaagagcctgaaatttaaaaatttcaaaaatttttaaaaattaactgggtacagtggctcatgcctgtaatcccagcactttgggaggccaaggtgggcagatcacaaggtcaggagttcgagaccaccttggccagtatggtgaaaccccgtatcaactaaaaatacaaaaattagctaggtatggtggtgggttcctgtagtccaagctgctcgggaggctgaggcaggagaatcgcttggacccgggaggcagaggttgcagtgagctgagatcgcgccactgcactccagcctggtgacagagctagacttcatctcaaaaaaatttaaaaaattagccaggcatggtggcatgcacttgtagtcctagttacttgggaggttgaggtaggtcgatcacttgagcccaggtggtcaaggctgcagtgagccatgattgctctattgcacttcagcctgggcaacagactgcctcaaaaaaataaataatttaaaaaacatcacatgttatatgaatcgatttatgtaaaagtacaaaatcaggtaaaaccaatacatgtttttccccccatttatttctttttatagaaagtaaaaaagaggcaaaattaagcaaaatgcctcttggtaataaataataggaaagccataagtagtattcacaaaattatggatagtggtcacctctaggaacaggagggaaacagggtagagcagcacagaaactgaaatgcccaaagtctcaaactcctgacctcaggtgatctgccacacttggttttttaatataattgtctaaaagcttgaaaaatatgaagattttggcactttaccattgaataatcagagatttccaactaattttaaacaaaactttactacaaagactcatttaccaaaagaaggtcattgttattgtaggaactaggttggttttagcatagttcttgagactcaagttttctaaaaatccagtgtgtactgtcatgagattagtttttttttttcattgtcagctttgtcaaaattctgcagttcagttactttaactatggatatataaagatatttgtaagttatataaactataacttctaaaggatagaatgtttcatttctttggatgcagttataaattatatgtgtaccactactagttcctagtagatttctaattcaatgagaatgttattttcttatacaatatgtgttccaccaacatttgtattaccaacataagccaataattttatcttcattgttgtactttttaaatgactttgttttggcaatcacaaaacaatatttcacgttcagtataatgaccttgcaaagttttatttgattccatgattggattagaaaaattgaaccattattggaattgatgcattttctgtttgaagtacttgatgacactgctgtaaaattagtgtctttttgtttgcaaggtttttctgttcatgaagcaacgtataaacagctttactttttacatatgcacaaaaacgtgggtgaaattaatttggaagagtcatttaagtgaaaagttacgtgctacagattgatgtgttaaatgtaccatttgcagctgcacatactgattgtcttttatgtaaatactgatgcttcttcagcagatttatttattttggttttcatgtgatcagtgataccattctggtccccacagagaatagtaaatgtcgatattttgtgcaaattagatgttcatcatcaactgtcttggaaaaaaattgattcttaattttttaattaagcatgaacttccagtttttaaactctgatgcagaaaggtaagtgttaccgaactgttaaatatatatagttgtagatttagacaataaataaagacacaatttaaatacagtgaagagagaattactacaacaagagtggtcgaatattctgtgtatgctctatgacagaactgctaagcctttattttccacatggatttaatttacacccagccatgttttatgatgaccccacctggctacgttgtgcaggttgtggtatagactttggagtaacagactagtagtataacaagtggctggtggggacgggagaattgaaaaccttatcctacccgaacctgaatggagttggttgctcctagccatttgagcctactttgtgggtaagcacgtggtttttattagcaggtgccctttatgctgtccttgaaagggaggtgttagattgcagcaggaaaggatcaggataatactggtaattgctgattgtctttccattttaccatttgttaaagtgtgaactctgttcactgcacatatgtctcacatgtcattagaaaataccaagacaagctgggcacggtggctcatgcctgtgatcccagcactttgggaggttgaggcaggaggatcacttgatattgggagttcaagaccagtctgggcaacacagcgagacctcatctctctataaaaaatttaaaaattagctctggtggcacacacctgtagtccctgctacttgggagcctgaagcaggaggatcatttgagcttgggaggttgaggctgcagtgagctataatcacaccactgcactccagcctgggcttgagagcgagaccccttctctaaaaaagagagtaaagaaaagatcaaaacagaagatggaacaagaaagtgaaggctaccaaatatctcctggcttattttgctgcaaatattaataatgatactttttattcttgttttgaaatggagtttcgctcttgttgcccaggctggagtgcaatggtgtgatcttggctcaccgcaacctctgccttcaggggttcaagtgattcttctgcctcagcctcccgagtagctgggattacaggggcctgccaccatgcctggctaattttttgtatttgttttttagtagagacggggtttcaccatgttggccagggctggtctcttcaactcccaaactcaggtgacccaccggccttggcctcccaaagtgcttgagcttataggtgtgagccaccgcaccaggcccacagttttttcctgtcatcggcagatgtgtcccagttgatacctaagtgcatagaaagccgtgggaaattgggaacagcattcttttgcggctacctctggcttatattatgtcctgagaatatagtaggtccatgttatgatgttcagtcaaatgtttgaattttatgtatccataagtgcttgttgaataatagcatttattgaatgctgtcagtatgcttaagcactttttatgtgttatttaatctttacaacaatcttgttataaagtattactatgcctttcttacatgtaaatttactgaggcttagagaaatgaaataacattgccctgggttataaagctagtaagtgcatcacaagaatgggaatttgattacatctttccattctgtttacgttatagacattgtcactgaaaattttgagtattagaaaaccccactgacagtgacaaataaaggatttatcacacagaacaagatatccagcagtacacagtccaggcctggtatagcaagcacttaattatgttatcagaggccctgggtcttttttttttttttttttttttttgaccccaacgtgatatgaggtcttttaatcttgctgctgtaccatgctcattgtgtgactgtgtcctcattattatgtttgcaagatggctgctgcatctctgagcactgcatcagttcctaagaaggtggaatggtgaaatgtctcaaactttcttggaagccccattaggtgacttgtgtttctgtctcattggctacaactgagttacgtggccaccccttgctgcagtgaatctaggaaagtgagtagtattgatgacttttctggtattgttttggatcttttcgtttcttcaagtgtaccatcaaaaatcctggtattctggccagacacagtggcttacgcctataagcccaggattttgggaggccaagtcaggcaaatcacttgaggtcaggagttcgagaccagccgggcatgatgatgctcacctgtagtcccagctactcgggaggctgaagcaagataattgcttgaacctgggaggttgcagtgagcagagatcacactgctgtactccagcctgggcaacagagtgagactctgtctcaaaaataataataataataaattctagtattcagaagtgtgtgacggcaaaggccaagcatcctgggctgtacacagtgagggagcttttttaagttgggggcattgtagtcagattgtgctttaaaggcatactccgatggctgtgtggtagattgggttgaggagtgaccaaatggaagcaaggagagactgttgaggagacttttgcaatggtctaagtgagattttaggggtctgaactaggaggaaactttttataggaatgaagaggagactgaagattccaaaaatatataggacatcaagtgggtaggactcagtggttgattgattgtggagacaatgagagagtgaagagtcaaagatgatggctcaggtttcttgcagaaaaaaaaatggtgccaccaacagagaccaaaaaagagtagagaagaaagtttaagttggttacctttttagatgcaatgagtcctgaggtatctgggtttccttcaggtgcagatctttagccactaactgggaaaagacagatttgttatatgttaataaatatattttccttaataatttcccttgagattttatttgctttttgttgtccagaagtttccaacatttgtgtagtcagtgctgttcatcttcatttatatttctggctttagttcatagagcatttcttttccccaaatgatagaagtatttaccacatttgttagccttaaatattgtattcatcaggattttattttgatgagtaggattaagtaggtaaagaaaacggaagagcattttcagttgttagaatatgattaacatgacttatgtttccaaggtgtggcataaaatatgaaatactgaatttttcttttaaaagtacctctgacttttttttatatatatacttttaagttttagggtacgtgtacacaatgtgcagattagttacatatgtatacatgtgacatgctggtgcgctgcagccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcagtgtttggttttttgttcttggcgatagtttactgagaatgatgatttccagtttcatccatgtccctacaaaggacatgaactcatccttttttatggctgcatagtataaatcatgctgctataaagacacatgcacacgtatgtttattgtggcactgttcacaatagcaaagacttggaaccaacccagatgtccaacaatgatagactggattaagaaaatctgactttttttttaatggtgttgatgtttcagaaatactctgctgtttgtttctgtcggaataaaaaaggctggacaaggtggcttgcacctgtaatcccagcactttgggaggccaagacgggaggatctcttgaggccaggagtttgagaccagcctggtcaacatagcaagacccagtctctacaaaaactaaaaaaaaaaattaaccaggtgcagtggtgcgtgcctgtagtcccagctgcttgggaggctgaggcaggagaattgctgtaatggggttaagcctatgattttcaggttgtggtgagctatgattccaccactgcacttgtactccagcctgagtaacagagcgggatgctgtttctttttttttttctttttttttcttttcctttttttttgagacaggctggagtgcaatggcgcaatctcggctcactgcaaccttcacctcctgggttttaagctattctgcctcagcctcccaagtagctgggattacaaacatgcgccacaacatccagctaatttctgtatttttagtagagatgcggtttcaccatgttggtcaggctggtgtcgaactcctgacctcaagtgatctgcccgcctcggcctcccaaagtgctgagattacaggcgtgagccactgcgcccggccactgtttcaggaaaaaaaaaaaaaaaacaaaacccaaatattgtattttttttataaatcaaaattaaaataggtatttcatgtattctgacagcaggaggatgcattagcacaacaggcctttgaagaggctcggagaaggacacgcgaatttgaagatagagacaggtctcatcgggaggaaatggaggtgagagtttcacagctgctggcagtaactggttagtactttcccccaaactctcaggctgtgtttgtgatgtttgtgcataatgctttttaatagtttaattttgtctttcatttttaaaaagttgtactctctggctttgtgtttattaaatgtaattgctataaagaaatttattttaattttaaagttgtacatcaattcctcattcattggtcttcataaaaatcatttactataataaggtatattttctcttaattcatttactcaaaatctcacctctttttttcttatttttcaaattatttgtaaaaatcagcttatgttaacagattgcatatttttagaacattattaaaactcgagtaatactactttccatttttctatgaatatttgtcttggttttataactataattgtcagtcatttgtgtgattttaactaaaggaaaatttaatattcaaactattcaaagaacggaattaaactttttcttttaacctttctattgtaaaatacagaaacagaaatcaacattaacaaatctgtagcttcctttgctggtttacttaggatacattttttaaaataataataaataaaaaaatctatagcccaatgaattactgtaaggttaacatccttacaaccacggttggtcaaaaaataaaactttgagcctgagcaactctgtctctacaaaaagtaagaaaattagctgggtttggtggcacatgcctgtagctttagtcacttggtaggccaaggtaggagaatcacttgagccctggagtttgaggttacagtgagcagtgattgtgccactgtattccagcctggatgacagagtgagatcctgcctttaggaaataaataaataatacataaataaacctttgacagctaccccagcagccccttccatatatacatctaatcatgactttctcatgatttctgctcaaaagtaatcattattttgatttttttttttttttgagatggagtcttgctctgtcgcccaggctggagtacagtagcgtgatctcggctcactgcagcctctgcctcccaggttcaagtgattctcctgcctcagcatcctgagtagctgggattacaggcgcacaccaccatggccggctaatttttgtatttttagtataggcagggtttcaccatgttggtcaggctggtctcggactcctgacctcatgatccacccacctcaacctcccaaagtgcttggattgattacaggcgtgagccactgcgtctggcccattatttcagtttttatagttaatttatgtcttgtgtttctttagttttagcacccattgaagtttagtcttgcccagttttaaaatttgagcttttttccccccacttttttaaatctaccatgttggtttctgaattttgatgtgtcttttaattgacaatggaattttaatttttttacacaaaattgtactctgctttaaacagacctcaattataaaaattaatattcaaagtatatacaaattgttcagaaatacagattttctttaaaaattatattctagggccagatgctatggctcacacttgtaatcccagcactttgggaggctgaggtgggaggattgcttgaggctgggaattttagaccatcttgggcaaaatagcaagcccccatctctgcaaaaaataaaaaattagccagcatggtggcacatgcctgttgtcctagctactcaggaggctgaagcagggggatagcttgagcctaggcgcttaaggctgcaggagctatgatcgtgccactgtactccagcctggatgacagagcaggaccctacctcaaaaaaaaaaaaaaaaagacctgcaggcatgcagctgacctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccctcaaaaaaaaaaaaaaaaaaaaaaaaagtatattctagcaaaaataatcaagataagaactaatgtgtttgaaaaagaagtgttgtcaaatgttactgtatatcatgcttcaagtttataaactttgtatcaacatgaacatttcatacaagaagaaatagaaaaagcacacattcatctttgataatcaaaacacattaaaatataattataatatatcaactaaacagaaccatttccaggtgttaaaaatcagtattaggtacctaagattgttaaattcatgtcctatatacttttggaatctacagacagtagaatagtggttgccggggaaatgggggttagttatttaaagagtatagagtttcagttttgcaagatgaagagagttctagttggttgcacaacagtgtgaatgtacttaacactactgagtgtatgctttaaaaatggctaagatggtaagttttatgatatgtgtatttcaccactttttttaagtttttaagtcaatgttacataatgaagaaaatttgtggtttttttccaagcacaaaattatatgtacactattgtttaaattaaggtgtgtgtgcatacgtgtgtgtgtgtgtgcgtgcatgggtgcagacagtggctaagagcccagactctacagccagacagaagtctgaatctggctctgtcatttactttgtcagcttggacagcttacttcacttttctatgactgagtttcctcatctacaaaataggagtaataatcctgcctgtctcatatggtcattgtgaggattaaatgagtaaatacatgtgaaaccacttttagcgtatgtgccactgactaggtgtcaggtgctattattattgttaatattatttaaagtattacataaaatttctagttgtgttaaaatatatttacttagaatacatttaaaaatcaagcctatttggtggttagtgtatgaaataaattgtgtgtgtgtgtgtgtgtctctgtgtgtgtctctgtgtgtgtgtgtgatggagtctcattctgtcgcccaggctggagtgcagtggcacaatgtcggctcaccgcaacctctgcctcccgggttcaagcgattctcctgcctcagtcttctgagtagctgggattacaggttcctgccagcacgcccggcaaatttttgtatttttagtagacacgaggtttcaccatgttggtcaggctggtctcaaacacctgacctcgggtgatctacctgcctcagcctcccaaagtgctgggattacaggagtgagccaccgtgcccagacttgaaataaaatttaatatcttttttttgggtggggggtggggggagatggggtctcactctgttgcccaggcagaagtgcagtggtgtgaacatgattcactgtagcctcaacctcgtgggctcaagcagttctccctccttgacctcccaaagtgctgggattacagatgtgaaccactgcacccagcctaaaatttagtatcttttttttttttttttttttttgagacggagtctcgctctgtcgcccaggctggagtgcagtggcgcattctcagctcactgcaagctccgcctccctggttcaagccattcttctgcctcagcctcccgagtagctgggaccacaggcgcccgccaccatgcccggctaattttttgtattttttagtagagacggggtttcaccgtgttagccaggatggtctcgatctcctgacctcgtgatctgcccgccttggcctcccaaagagctgggattacaggcttgagccactgtgcccggcttaaaatttagtatcttttagtgattgctagatctctttgtcagtgagttaattaatctaatgggctgatagcagctgaggatgtccccaagaatacttgttagctaagagaagaaaatggagggatatatgtgatacttgttttctttgatgctgttgtaattcttgtgattttcatatatgtgaatacaagacttccacaccatgccctttctttcggtatctgtaaaatttagaagctttaaaatgtataatgtacatttgttacatttctgaacctttttgctcatgctctttgttccctgatgtagaatgttcttttctgtccgtcaaggcccaacctgaatgttgtcattaaatgtcaggcctttcctcagtcttcttagtcataatcataaagcccttccattctgtagcactttttatttctactagtgttcttattgaacaacatgttgaaacaattataaacatttgtgccctccactttatggcaatcccatgagatggagcccctgatttttgtgtcttccacattacctaccacaatcctttgtacactgcttagttgttcattggatatcttcaaaaaacagcccctatcctgcctgtctgaaaactagaattataggagagcctgctatgatagttcatgtagataatacatattaatggtctctggaaagattctaaatatttataatgtgttggtttatattaactagttaagtaaagtaataaaccccaagtgtgttggtctgtattctgcattagggactgagaaatatatagatgaaaatgcattgtttctgtctttgatcagctgtcagtcttgtgggaaaatgatggataaacagatcattgcagtgtactttagcaaccaccatacataatggaggttcaaaagggacagcagcagtgtagaggaagcttaagtctgcctctgcttgggaaattcacagggtagtatacttagagggatttgaaggaagagtgtgttttgccagctgttcaagttggagaaagcattctgggcaggacaaacagtgtatgcaaaggcatggaggagtaaggaggagtaagagagcctgccaagtcaagagagtgtgattggtcagtatttctggagcaagctaacatggctttaaatgaatataggaatcattttctaaaaagtgctcttcagctacattatatttggagattaactatttgacaattaatggaacaactgttgaaagcttttgtatgtattttgctttacataaaactctagattaattgactaagaattttctattctaaattgtggtggctcacacctttaatctcagcaccttgggaggctgagggaggattgcttgagcccaggagttcaagaccagcctgggcaacacagcaagactttgtctctacaaaaaatttaaaaactagctaggcatggtagcatgtgcctgtgttcccagctacttgggaggctaggtgggaggatcgcttgagcccaggaggtcaaggctgtagtgaactatgattgtgacactgcactccagcctgggcaacagagcaagaccctgtctccctgaccccacaaaaagaaataaatacattgttaatttgatttttctaatttaaaatgttggaagaatattttggtatgtgagtttatatgtatatatgaacagaaatatagtctgttgatagaagtgtcacataatttgttgctcagatagattgtttctacttgtttttttgtcagtgattgagagcatgggctttgtagtcaggcctagttgagattcctgctccgtcacttgcctcaagagccctaattttctcacagaatttgagtattaaatgggaaaatgcttgtaaagcacttagtatgatgcttggtatgtgtatgcctacagtaaataatagctctgaagtacttctttttagcactaaaagctccaccataatgctggttccagttaattgaattatttggctaacaagaacatccttttagttctctgaagtgtatcaaggcactttccctacattatgacctagagcatagagaaaagagttatattttcatcaatgatttaagatcctgtagtcccttatggcagtaatttaaaacatcagttcttgtagagaactgtcatctggaaaattgggctggaatctgactccagcacatgcactggcaatcacataggggagtttggggtttgtgtgtcttttggcacttagcgtgtatatattttgcttctttgtcttttttttccatccataaaaaattcctaatgtcaccttattttcttgcagtttaccttctttttcctaaaaagagaatattggagaaaaatgttgtttcccctctgtgattcagattatctttagagattcaaacatcatctaatctaacattattacagttgataaaactgagagtctccaaaaaattaattgacttgctctccctcaaatatttggttaatggaagaaacagtgagtatttaaaccagtttcctaaccaggaggcctgcacaaatacagcttagcgctgggaaattaatttccacaccacccgtaaagatgcttaagctgaaaaataaaatctgccaggagagattaagaaccgttttgcctggaatagaaaaggctgaggcagaaaagaaaaataatggttctagtgggtggtcctgatgcctgactggagaggagggccagagaacagtggtaactcatgggtggcagcaagtcagtaaacggcctgtggaagcttgagatcctagcagcacagaggtttagggatgtcctccactgtttggataacttctgaggcctccagccctgccatgctaaacttgtaacagtggtgctcgtgagtatttaatctatgtgtaaggttaagattactaaggggggaagcagaactccaagtggttggtggcccaaggggttttgattttcaacagtgtcttttaacctgaaactagttataaaattccttgagcattcttccatttcaccatgtgtaaaatttagaaagttttcgatccttcatgataggatttagtgttttctttttctcatttttctggaacagcctatttcagtagtacaatattttctttacctttcagaggtaatggcagattatcattaacttgaaatgagaaactatagtgaaatgaagaagcattgtttatgttagtaacctttaccaaatactcttgtcattgatatacattaaaatgatatacataaggtacacagtactgtgtataatatcttactctctgggtatttttcctactctgtgggtaatttttgtttaaatgtgcatagtcattctctagtagaatatctaagaaactggaactagaaactatgggggagaaccaggtacctgggggacaaaataagcaaattattatttttcactgtgtatcttctgtaccttatgaattttgtatcattaattatttagaaaaaaataaaatttgctttcagtattacacagaataatgaaaacagaagattctagaccttgctatctctattctctggcatataggctgttttttatgtgaaacccttcctccatttgaaattgtatacagagccccactgtataaaacagtttttttaaaaggcactgctctgggcaaagccagggtagggattgttctggtctccctctggtgtccctgggggtgtttttacggaacccagtgggtggcagaacataatgaggactctggatgtagtggaatgagcacaaggttttgcatcccggctccactacttgttgccatatagcattgagaaagttgcttattctcattgagcctcatcagtaaaaactccctcccaggttgttgcagagctcagtatctgaggcttagaatggggactcagtggaagccagtttctttaccccttctttctgtgtacttggctcacaatatatctggagtggcaggaaaacagtaaaagtagtcatatcctaactttagactatgaaagtcgaagatactattttgccaagccattttagattctggtgttttttgtttggttggttggtttggttttttaaaacaaccagtaaaggattttggacttttcttggctctgttggaggctaccagttactgtggggattgagtagtgactagaagtgggtatgaagagaacttcccatgttctggtaatgttagttcttgacctgggtgctagttaggtgggtgtgttcgctttgtgaaaattcttcattacatacttaacaatttgggcactattctgtacttgtataaaaagaaggcttttaaaaataaaaaataatcacagacgttacttttgtgaaatgctctccattggcatctgttgctatatagaagcatcctagcaccttttctgtctgagaatccttccttgatctgaaaatgttgacatgtttcccatgacctttctttttggggtatatatgtctataactaattcaaatgtcttttgtgaaggaagatggaggttaataaaggacagatttcatgctctgatcatagttgagttagaaagatagcaacttgtacactagtctctgtttccagagactgccttcaacttgattggccttttgacctaaaactgtaatatagcactcttggcttttaactcagctccaaggtgacagggtgcttaaagatattttctctattatcttaaaaatgcctacatttggttagattataaagtggcagcaaataaatggttgtctttaatgtcagagaatgggtaaattattgtttatcctactatgagcaattttaatacaattcaaatcatagaattttatgtggaaactatttggaaataaaaacaggcaaaaagttttatgtggtttttgtatttgtattttgcatagttttggggccttcaattctgtgtggtccaagaaaaaaatctcagcctctatttattttaaatttccgaagacttcagttttcaaattatttaactctaccaatattctttcttgtgtatggataaatcagcatgagaatatgtctgtgctaggccttcctgggttgtgttttgggtaatggcagtagatgagaatgaactgggagtatgaactcagactgagaatgagaatcggaagaagattaatgaaggaggaaaaggatacgaaatctgacttcccccactaccagaggaagagagtcttggttctctatcagaggagcaatagactttattaagatttatttttgttttagccttgttttagtttctaaaaattattctatctgcaggatatggatttttcaacatttgaatagttatttgaaaagttcataaatggaaatgggaagtgatgaacagctttgttataataacagcatcatgagtgcatcctatgtgccaggcagtgtacattataattttggctttatatttgatctttaaatgctcttgtaagttacctcttcattttgaggaaccgaggctaagagaggataagaaacttgcctaaggtgacatagctgaagtggtagggccatcatggtccaagcccagaaatgcagattattcccactatttcattttaaaatgttactttatatttgaagttttccttaggttgcatactttgtaagaactatattttttgacatgcctgttggaacagctctcgcagtctgcttatctgacagatgtttataattgtctgctgacttttttttaccctttttaaaatttttttttaattttactttaagttctgtgatacatgcgcagaatgtgcaggtttgttacataggtatacctgtgccatggtggtttgctgcatctatcaacccatcatctaggttttgttgttgttgttgtttgtttgtttgtttgtttgttttttgaggcagagtttcgcctttgttgcccaggctggagtgcaattgcacgatctcggctcaccacaacctccacctcccgggttcaagcgattctcctgcctcagcctcccagtcatctatgttttaagccctgcatgcattaggtatttttcctaatgctctccctccccttcccccctaccccttgacaggcccctgtgtgtgacattcccttccctgtgtgtgatgttcccctccctgtgtccatgtgttctaattgttcaactcccacttatgagtgtgagcatgcagtgtttggttttctgttgctgtgttagttctctgagaatgatggcttccagcttcatccatgtccctgcaaaggacatgaactcattcttttttatggctgctttttaacctttttaatgagtttggggaaagtgcattcctttctctcatgttgagacttaaaatttgtgctttgtgtctcctccagacttagcaatagggagaactagcagtgactaaggaggctgacattaatgccaattgtaagttaaaggctcatcttttccataggtctgattctgtgttctgactctgcctccaactatgttacttgggggaaattacttaaccttagtcttaggctgtcatctgcacaatgagagttgaatcagatctctcaagtactttgccactctaaaattctataattctgtattcagaattttatttttctcccttccttccccctgaattttattttattttttttagagacagggtgtcattctgtcacccaggctaggttacagtggtgcaatcttttttttttttttttttttttttttttttttgagataaagtttcactctgctgcccaggctggagtgcagtggccagatctcggctcactgaaacctctgcctcctgggttcaggcgattctcctgcctcagcctcccgagtagctgggattacaggtatgcaccaccatgcctgagtaattgttatatttttagtagagatggggtttcaccgtgttggccaggctgatctcgaactcctcacctcaggtgatctgcccgccttggccttccaaagtgtggggattacaggcatgagccaagtggtgcagtcttatagcccactgcagccttaatatcctgggctcaagcagttcttgcctcagccttccaagcagctgggattccagccacgtgctaccatgcccaactaatttttaaaaattttttgtaggggcaggatctcactgtcactcaggctggtcttgaacttctgggatcaagtaattgttccacctcagcctcccgaagtgctgtaaactgtaggcgtgagccaccatgcccagctgttcttttagccaagtatcaaacaaaaagtgaatactacagtatctggacatagtacacactcaataaaatatagttgtttttaattgttagggaattttcccatgaagagttttcagcaggttttttttttttttttttttttttttgagctctcaatattaaaagaatggagatcaaccaggaaattttcttcattctggataccccctcctcgtggctgtttctgcatagctctgaccagtagggaaaactcaagctgctggtgtgtgttctttcgtctcatttggagtcatctcatgactgcctcctagcaactctatttgccttgttcctgggagatgatatactgagagaaaacaggagagcaactggtagtaagaggtctgtagcacaaggttgagattaattcttcataaatactaagaacagattgtgctctgaaatcagactcatggatgtgtgctttatattaaaaccccaattctgaaataactgttactaaaaggttagaatcaaggccctatggctgaggagaaggaaactagaaattacaaactttgtgcttttaggatgatggagttcagagtttctttgccatcatgtagtatagtttacccatagaggaaatccttcaaaaaccttcattagaaaactgccacagtaagaagtcctgcttcttaaagcagctgcttattcagctgttaagttctactcctatggaagctattttactgaacctaaatctgtttctgtatttgtttccttcatatgacggtcaatacatcttcccttctagcattaaatgtcctcccagatctctcattcttccctcttctgctctcatttgtactgttagacttcctccctctttttttttttttttttttttaaagagatggggatctcactatgttggccggggtggtctggaactccagggctcaatcagtccttccacctaagcctccaaagtgctggaattactagtgtgagccaccgtgtccgggcccctcatttttgttcctactcttgactcttcatcacagtgtctttccttacatcttcctcagtgccttcacaatgtaaatagaaatgaaacccacaaataatagcaagacaacttttctttactcctgttctctgtgcttttatcaaaaatgtaatattttaaacaaatccatggctatttctgtgcagctgtgaccagtagggaaaactccagctgctgatgactgtgctttgtcatatatttggagtaatcccattattattaaaataatttgaaaattatttttgccccaagacacaaaagctgaaatactcttttcacaaagtattattggtaggttagtagtgatttataaatatataattaggatttatttttctcagtgtttcttcattgcttggcccctttctaaccttcattgactgaaagcagatgtttatatcaccatctctgattttgcagaattgatctgtccttacactgcatttagcattgattgtgtatggaacataaattgcttttctgatgcatatgtattccatagctctttgaatttgtgactgtgtactataacctatttaattgaaaagaatgtgctaaaatttagtcattgtccattctgctaacaaaagcagttaaaacatgctagagaaatatatcagaattttaagaaagaggccggatttggtggctcatgcctgtaatcccagtgcttttgagaggctgaggcaagaggatcacctgaggtcaggagttcaagatccggctgaccaacatggtgaaaccctgtctctactaaaagtaaaaaaagttagtcgggcatggaagcgcatgccggctactcaggaggctgaggcacgagaattgtttgaacctgggaggctgaagttacagtgagttgagatcaggccattgcactccagcctaggcaacaagagcaaaagtgtgtctcaaaaaaaaaaaaaaaaaaaaaaaaaaggctgggcacggtggctcacgcctgtaatcccaacactttgggaggctgaggtgggctgatcacgaggtcaggagattgagaccatcctggctaacatggtgaaaccccgtctgtactaaaatacaaaaaattagccaggtgtggtgctgcgtgcctgtagttccagctacttgggaggctgaggcaggggaattgcttgaacccaggaggcagaggttgcagtgcaccaagattgcgtcactgcgctccagcctggcgacagagcaaagctttttgctcaaacaactggtaaaatggagttgcagttatctaacataggaaaactgttgctacttgggaaggtgaggcaggaggatcacttgagcccaggagtttgaggctgtagggtgctatgtttgtgcctgtgaatagccactgcactccagcctgggcaacacagcaagacctcatctgttttttttttttttttttggagacagagtttccctcttgttgcccaggctggagtgcaacagcacaatctcggctcaccacaacctctgcctttctggttcacgcgatcctcctgcctcagactcccgagtatctgggaatacaggcgcatgccaccacacccagctaatttttgtattttagtagagatggggtttcgcccatgttggccaggctgatctcgaactcctgacctcaggtgatccgcccaccttggcctcccaaagtgctgggattactggcattgagccattgcacccagccgacctcatctctttaaaacaaaatgagttaattcagctgggcatggtggctcacgcctgtaatcccagcactttggggaagctgaggtgggtggatcacttgagcccaggagttcgagaccagcctggccaacatggcaaaaccccatcactactaaaaatattttaaaattagccaggtgtcgtggtgcatgcctgttctcccagctgcttgggaggcggggcaggagaatgacttgaacctgggaggcggaggttgcagtgagctgagattgcgctactgtactccagcctggaaaacagagcaagactctgtctcaaaaaaaaaaaataataataattagttaattcatggaaagtacttagtaccacattctggatacaaacagatatttgtgcttggccaacatttggaggcagtaaagaaagcttatagaataaccacatattagaacttgtgaaggagaaaatatacatatatatatatgtatatatatagtctctctattaagtaatttaccataaggggtttaaataggaatgttgactccaaagtgaatcttgaaatcttggtgtttataattgtcaagcctctttttttaaaatagatttggtcaacaggaagtatttttttctaatttttattttatagacctagtcaagcttcttaattgttaaatattgttataacaatacatctgggccgggcgcggtggctcactcctgtaatcccagcactttgggaggccagggcgggtgaatcacgaggtcaggagattgagaccatcctggctaacacaaagaaaccccatctctactaaaaatacaaaaaattagctgggtgtggtggtgggcgcctgtagtcccagctactcgggaggcggagcttgcggtgagccaagatcgcgccactgcactccagcgactccgtctcaaaaaaaaaaaaaaaaaatacatctgagtcgtacatggtggctcatgcctgtaattccagcactttgggaggccaagacaggcagatggcttgagcccaggagttccaagaccagccctggcaacatggtgaaaccctgtctctacaaagaatacaaaaattagccaggtgtggtggcgtgtgcctgtggtcacagctactcgaggcttaggtgggagaatcgcttgagccggggaggcagaggttgcagtcagcagagattgtgccactgcactccagtcttggtgacagagtgagaccctgtctcaaaaaaacaacaaacaaaaaaatagatctggggccgggcgtggtggctcacgcctgtaatcccagcactttgggaggccgaggcgggcagatcacctgaggtcggaagttcgagaccagcctaaccaacgtggagaaaccccatctctactaaaactacaaaattagccgggcgtggtggcacatgcctgtaatcccagctactgaggaggttgaggcaagagaattgcttgaacccgggagttggaggttgcagtgagctaagattgcgccactgcactccagcctgggcaacaagagtgaaactccgtctcaaaaaaaaaaaaaaaaaagcatctgggaatataagtgcacccaggactctaattttatatttctatttttaacatatgagacaatactttatccataataaagtgctacatttttcagtcatataattagtagaacatatacttctctgtgattcagtttttttatttgtaaaatagagataaataatagcacttatgtcataggttgttgggagggattaaattagttctagccaggtcctatggcatgtgcccatagttctagttacttgggaggccgagtgaggcaggaggattggtttagtccaggaatttgaggctgtaatgtgctatgttcgtacctgtgaatagccgctgcagtccagcccgggcaacatagcaagaccccatctctctaaaaaattatttaattcatggaaagtacttacaacagtgcccgcagacagctgatactcaataaatgtcagctattactaaaaggaagagtttgcttctaaggcacttggctaatgtgttaaagttaaatcctctttttccaaaactgtaaatatagatttgttgtggggttttttgtttgtttgtttgtttgtttgtttgtttgttttttgagatggaatctcacttatgtcgtccaggctggggtgcagtggtgcgatctcagctcacggcaacctccacctcccaggttcaagggattctcatgcctcagcctcccaagttgctgggattacaggtgttgccaccatgcctggctaatttttttgtatttttcatagagacagggtttcaccattttggccaggctggtctcgaactcctgacctcaaatgatctgcccgtctcagcctcccaaagttctgggattacaggcatgagccactgcgcccagtgctagatttgttgttatttcttatgtagtacatatttatggtgattttcttttgaataaaaatgatttttattcttgatttttaaggaaactttagtaaaatatgtcagacataattttaattggtttttttttgcctgttacatgtgactatattggctgaaaactttttagttatgaagtttttctgtgtgctactgtcttgtattttgtatatctagtattttgattgtcaaaacactttttgaccccaaattatgattttgtcattgcaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaacagggtcttggctctttcttgacctaacccagtaatttctaagaaagcaacaacagtggcatctagtggtaatttctgttgattccaaagaagactactttaaatataggtatcacaaggtatacaaatcccccagtgtatattatggttttcaagaaatctggcttgatttacccatcctgtgagatatgaccataaagtagtgatgttgggagaaagaattttaaattacacatccaaattagttccatctttcaagctagttgttttggaaatatacagccgttttgattgtgctggtgttatatcaaacattcttaagactcctggcattttcctacaacagaaaagtaagcccttttccttgaaagtatgccttaagcttgacacatgataaacagattcactcattaaccacaagacttactgcaaatgacaaaaatgcctttaaattctgaattgacaccattaagggaaattccaaagagtaggattcatgctctgagagttaatttcaaaaaattgagcagtaacagcatggttttagtaagtatatcacttctagaaacataattggatatgctagctcggggctgcttggtgaaaaatatcttacttgatttatgcctcatttggcaatgaggagcttttcaatctataaaccattgtattatccataacacattaccccaaaacttagcagcttaaaacaataaatacgtattatcccacaggtgagtcacaaatctggaagtagctaagatcaatggttctggttcagagttcctcataaggttagagtcatcctgggctacagtcatctcaaggattgactggatgaaagatcccctttcaaacccactaatgtggtcactgactggcctcggttctttgcagcttgctagatgaaaggcagatgttccttgctagatgttggacagagacctgcttccatttcatgcccagctgggtctttccataggacagtgcacagcagggtagctggcttcccccaaggcaagtgatccaagagagcgcacacccaagttgaaagcacagtctttttttttttttttttttttttttttttgagatggagtctcgctctgttgcctagactgactggactgcagtgctgcaatctcagctcactgcaacctccccctcccgggttcaagcgattctcctgcctcagcctcccacgtagctgggattacaggtgcccatcaacatgcccggctaatttttgtatttttcatagagacggggtttcaccatgttggccaggctggtctcaaattcctgacctcaagtgattcgtccgcctcggcatcccaaagtgctgagattacaggtgtgagccaccatgcccagccaaaagcacagtcttagaactgaatcttgggctgccatattgtatgttagaatcaagtcactgggtctggtccacactccaagggggaggaatattaagcttcatctgttgaaggcggggatgtcaaagcattgtggacatctttctaaaccaccatggtgatattaccaaatatacgtaactgagtataagataccttggtgtttgccgggcgcggtggctcacacctgtaatcccagcactttgggaggccgaggcaggcagatcatgaggtcaggagatcgagaccatcctggttaacggtgaaaccccgtctctactaaaaatacaaaaaattagacgggtgtggtggcgggcgcctgtagtcccagctactcgggaggctgaggcaggagaatggtgcgaacccaggaggtggagcttgcagtgagccaagatcgcaccactgcactccagcctgggcaacagggcgagactccatctcaaaaaaaaaagatacctttggtgttttaatctaaacattctttaaaggtaagatttcagtcttgcagatttgaatacatgattccccctagatagcatcaaccccttttcttgcatcaccatcatatattcatatatggcatt

SEQ ID NO: 15544 - DNA, 75929 bp, Human; identical to SEQ ID NO: 15543
  misc_feature (1)...(75929): n = A,T,C or G

SEQ ID NO: 15545 - DNA, 74881 bp, Human
cttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaatcatgtggtaaacttaatctcctgtgtgttgaaaaacttgatcttttgtgaagccaaagtttcatgaatccatccgtctcttaggccttctgttatgccatttcctccggcaccattgtgtacactgaattcttaggagatactgtcaacttcgtaagggaaggtgtgtccaggaagtggacactgggcgccttaaagaggtcaagggccctcagtgcacaggggaaggtggccttgtgataggtaaggaagtggtgagatggttggctgagaagaattggaagaaaaagttggattgaggacctgtcctttttgaatgaagaaaaagaagctgaagcttggctatcttcaataccaaagacagctgtgcagcactggtagattgatgaagctgaagctacaggttgaagcactgtgaagcgcctttcaacggtgcttgggaaagagctttctgatgcctcaggttgatgtacccagctcatcaatctggtgttatggaagaagaaatgatccaggccaaggtgtccgggtggactggccagcctcagattcttttttactctgacaggttctcactggcagatatggtagttgacaaaacattttttcatgcttctcagtctgttgcttaagtctggaattccttcacggcgtgcatactgctgacaacctccttttggccttgctcctggagaccttagaataggagtcttcagctccccgcccccatcgtggggctctgtgcgagctcagagttgtgcttacagaactgattcttacccttcccctcaagtgagttgtcagaaatacacacttggtgttttcatgcaatgaacagttatgaagaaactgctctgtgcctggcactaggaaaaaacttcgaaaaatagttttaagaagtagtgttgaacagtagatgaggctttttcatgtttcttttaaatttcttttgaataagtctaaacagtagtgtgaaagatatactgacttcctgccgaatacccagatactccattaatgattgcattatcaaatgtttccccttcaatccagctcaaagtgtttgtgagaaatacatggtgaaagaatgagcagggtggagtggaaattggaccttccggagaagccccaggaagacattaccactggaattcccgtcccaggggaaaggcccctcccaacagacttgattctggttttggtctaccagtttcaaccccagcacagcttccagaagtctttgcgggaattcagagctgatttaggacgagtcacctatcgagaggacgggaagctttgctggggacgcttgtctgtccaagtaagaggaggccatgtggctgtgtgacagatgtgttttgtttctcctcgccaccctggcgagaaggtgcctggaacccatggaaggggtctgagaagagataagggcggggccatgtgggggcgggacccggcttagggggtggggttgcagggagcccacaccaggctggactgcgcgggcggggcagaggccgggggtgggcggggacatacggtgacgggcgtcggggacgcagggttggcggcggagccctgggggggcgggcccctgggggcggggtctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcaggtaaagtggcgcctggcgcggcccctcttctccttcccgccgcggcccgcgatggcggccgccgctcgcacgaccggacgggaggcagccgctgccccactttccgcgccggcactgcggcgttcttgtcggaccgcctgtgtggggctccgggacgggcctcggcccgggcggcgagagactggataatccaaactccggcggcagggttgagtggactcggcagcaggggaggctgcggggcgggggtgccggcctgggcctttgcccccagtacctgcctcgggtctgcggctcccgggtgcccccggccgggcgatgccccctccgcggggcgagtggttgagcccagctcccgaggcagagaggacccccgcggggcccctcgctggtacttagggccctccacgataaccgactttgtcaccagttcgcagcctggtcccgagcccggctcctccgcctggggtattcctcccggcctccccgcccagcgtgcgctccctgatcctttgtccctccccgccgtaggtcagttcgctggcctcccattcatcccggccaccctaccccttcccctgaacctgctgctgctcacttctgcccgcttctgtccggcctcgtggaagagtgacgtggagactgtatgacagttaatccagatgcacaccgttttgccaagtcccgtttgggatgtgtgcgttactgtatttgccaatcagctaaccgacgccctgagttttaggaaagtttttgtttctctgagctgggttatatgcagcttcagggctagaattcctcacttaggtctgtggtaagatgccaagcactgtggggagtgaattctgtgccttcgggagcgcgttggcgatgtgtgactcacatctaggttgtaaccacttcgtgactcatactaggattaccaagattttagaggtagaagaaatcttaaagattatctgactaaaaattctttctttagcatccttgacacctggccaccagtaccctgcttaaacatgttcagtgaaggggagcctgtagctgttgcatagaattctaaatgctattatctcttctcctgcccagccctgcgcatatttgaaaacagcagttacacatgtccctggattcctgttatgctggttaaataaacatccctattttcttcaccttcgcatggctaacggagcagtgatgaatatatctgacactctccttcccttttcctgtgtctcattgaggctctgaccagtgggaaggggcactgggatccctcagtaatgtcagaccctccgctcctcgcctatctccactagcacaacacaaccaaaacgagaaacactggagcagttttaagaggcagagagataagagagtgatggagttcaagttgatagtattttatccattttttaaataacacctatgtaatgcttactatgtggtaggccaggttctaagcactttgtaaatattaactcattaattctcataacaatcatgtgaagttggtatatattctcgtggtatgggagaggaaactgaggaatagtgaggttaaataatttgttgttagggctttcaataagtgccaaactgggatttgaatccaggtaccctggctccagaaggttctctttgctacactatgctgtgtcctctctagagattagaagcagtaatgagatctagagaaaaagatggtacatagtggaaaaacaagctagaaagtcataatctggagaaatggcaacttttcacagtatccactgctaaaaatgtatcagtcttacagctctgcattgtgtaactctggggtaaaagaagccagagaagggtaggagagcagaggaagaaaagtataaatcactgctgagagttagaggtcaatgccaaaggggaagaatgcctgcctttttttttttttctttttccagttaaagccttgttcagggtcacagctgaggttttgcatcccacacattgtgtatctacagctacatctctaccacaacaccataactgatattcctcataattgactgtccttaacaagaaaaagttaaaatcaagaagtgtattaagcatggccagaatactcggttaacaaagcagggaagtacaatttagaatgattttaaagtttcagtgttaggagattaaaacagcagttctccagaaaactcatatgtccacaagtctcattttctgagaatgctgtattattacccaactcatgtttcaccatctcatccacaaggatattttaagcattttaagcaaggatttattgtgtgcttatttgttgctgttttttgaggggcttatattctagttggtagataggtcatgtatagaacagcacatgcaaagtgtcaaatgaacatcatcaatggtacatactctaaaagctcagagaaggcatggatgagtcagcagtgatgtcatggaggaggcagggttttgaggtaaacaagtaggactggcactatacggtttaaagtagacagtttctattctggtatcatctagcttcttctgactctccaagtgaaaagtcctgggttactggccttattctaagaatgcaagattttatcaatattagaaaaatgtgtatagttttttttgcattcacagattataaaagatgtattttcctaacaatgatgcagaaaaagcattcaactaaattcagcttctaataatgataagaagcacttagggaactagtgttaggaaaaagtgtccttaacctgatagagtatctacagaaaacttttacttaacatcatagcaacagtcaaatttaaaataaacatttcctttaaagccagaaaccagagtggggtgcctgctatgcttctactcagcactgcactggaaattctagccagtgtaatatgacaaggagaagaaataaaaggaataaatataggaaaggaaaaaccaaaagtctcagtgtgatataataacctatgcagaaaactcaaaacagtctacaagtaaattataaaaattaggagtgttggcaagttcactgagtgtaggatactaaaatcaattgcatttttctacattgataacaaacaaggcacaggcgcactggctggtgcctgtaatcccagctactctagtctcagctattcaggaggctaaaaaatgggaggatggcttgagcccagcagctgagggctgcagttagctgtgatcacgccactgtgctccagcctggccaacaaggaccctgtctttaaaaaataataaaaaaaaatagaaaaagtaattattaaaaaaatccagttatattaacagtaacagcaaaatatgagcttcctaagaatatgttgcttttgctatgtatataaagagaaagagctctatctctatgtatacacagcaaaagtggtcaaacttcatggagaaaatttaaaaattttatcaaaagccaacatggatctaaataaatgggagaaaagtactgtgttcaagcctaggttgacatattatagacatatcagttatccctattggtcaatttaatgcaatttccatgaaaatttcagcaagatttttcagtagaacttgataaaagtaattctgaagtttatatgaaagcacaaagggccaagattaggcagaagagaaacaaggtggatggacttgctctgccagatttcaagactcattataaaactatagtaattaagacaatgtgggtatcagaacagggttgaaaaacatagacctgtgatacagaatagaaaaccctagaacagatccacacatatatggaaactcggtaaatgacaattggcattgctggtcagtggggaaaggaagaacttaaaaaaaattaagctgggacaattggatatctaaatagaaattatgaaattggatctctgtctcataccagtaaaaagtcaacttcagatggattaaagacaatatgaaagtaaaagctcacaacacttttagaaaaaaaaaatagggcagtatcttcattaccttatgctgggaaaggatttgttagtataccacaagtataaaccttaagaaaaaaatggataaattcgacttctttaaaatgaagaacctaggccaggcgcagtggctcacacctgtagtcccagctctttgggaggctgaggtaggtagatcatttgagtccaggattttgagaccagcctgggcaacatggtgaaaccccgtctctacaaaaaatacaaaaaattagtcgggtgtgatggcatgcacctgtggtcccaggtactctagaggctgaggtgggaggattgcttgagctggggaggttaagcctgctgtgagctgtgatcacaacacttcactcagcctgggtgacagagtgacagaatgagaccctgtctcaaaaaaaaaaaaaaaaaaaaaaaaaaaagaacctctgttcatcaaaaggaaaacgtaagtcattaagtgggagaatatgattccaacacaaataaccaacaaatgatttgtagtacctagaataaataaaatactccaatgaataaaaaataaaaagattagccattaaaaattggtcaaaaaataatttcacagaagaggaaacagctaaaagatataggaaaagatattcaacttcattagaactcaatgaactacaagctaaaaaatccacagtgagaataagtgttggtgaggaacgtggagatggtagcaatatccgtgttacaaccattttgaaaatggtttgttgtaatctattataattgaaggtgggcattacctgtggcccagcaattccactcctaagtcagtacccctagagaaactcctacacacctattagaaaagtggattggggctgggcgtggtggctcacgcctgtaatcccagcactttgggaggctgaggtgggtggatcacctgaggtcgggagtttgagacctgcctgaccaaccccgtctctactaaaaatacaaaagttagctggcgtggtggtgcatgcctgtaattccagctacttgggaggctggggcagaagaattgcttgaacctgggagtcagaggttgcagtgagccgagattgtgccactgcactccagcctggtaacagagtgagactctgtctcaaaaaaaaaaaaaaaaaaaaaaaagaaagatggattggaatgtggatagcatttttacttctgatggcccaaaactggaaacttcccaaatgtcttttaacagtagtatgtttacataaattgtgctatgttcatataatgatatactctgtcactgaaatgaataaaccacagctataattatcaatggggatgaatctcaaaaacataatgttgagtgaaaaaaaataaaggttcaataccagataaaactaaaccagatatcatttagggtatactgtatgtacaatagttataataaaggagtggtgaacacaaaattgggacaatggtttcttttgggacaagagagtgatatggacaaggagtagccagatagtacatgggctgtcagagatactgacattgttctcttaagcttggtggtggctgcacaggtctttctttcatttctttaaactccacacatatatgttatatatactcatatgttttatattttataattcagacattttcttgaaaagccctgggctaagaaccaagcatattttatgtagagtacctccccacctcctttaataatcactttattcttcctgtcagaactcccactccaagtcttataatgcttttatccaaggaagggaagaaggatatctgccacagaactccaccctggtgtggaatattattctactgcccactagtcttttcctgtctatgatagatttcctttattcactatttgtacagaccccttaaatttctaaggtagcctacctcattttcccattactctctgcattgttctggaagcttttcaggattcttgttgcagttatgttgtcgatgaagagagtagataaggcgccctctctgctctttgctgatttgtgtatgtgaatacatgcgtgtttttttttcttttttttcttttttgtgatggagtctcgctctgtcacccaggctggagtgcaatggcgggatctcggctcactgcaacctccacctcctgggttcaagcaattcccccacctctgcctcccaagtagttgggattacaggcacccaggcaccttacatcaagcccggctaattttttgtttgtttgtttttttgtagagatggagtttcaccatgttggccaggctggtcttgaactcctgacctcaggtgatccaccagccttggcctcccaaagtgctgggattacaggtgtgatctgccacgcctggctgatgggtacaattattatttccattttcacaggtgagaacacagagtcacagaaaggtcagatagcttgccacatggtcacatggcagagccagaattcaaaaccaggcagaatgatgtccatgcccttaactgctgggatattctttggtgttttgcacttcttgacaccctttgttagaagctatcaagtaaaccctaattcttattcttttattccacagcagagttctttagtacaccagatcttctttcttccccaagggatgccttttctgccctcttctctggttcatttaggtgttctctagactctggtgtcagggcaactccaagttatgactctcaatttaatatcattcctatttttgcagaactatagttaagattgtatttggcatattatgatttacaaagcactcttgctagttgtcttttccttgatccttaacataatcctggaaggtaagagagacggtgtagtgattaagagtgtaggtagctcccctggctttgtgacctcgggcaaatacttaacttcttcaaatttcagattttgtatctgtaaaattagggtaataatagtatgtacctattagatgctggagaagcaagcattaaaagaattgatacatgtaaaacacataggctagtgcctggtactgttgtgcttaacaaatgttagctagtcttattttttatatgataaggaaagtgaagtttaatctcaattttgtaaaactgtgtatttaagtatctatatgtacaaaacaagactggaaagaattatgccagaattctcagaggttagtaggattatgggtaatttttatttcttgaggctctcctatattttccatttctgtttataaacaataaacatgtataacttttgaacctaccttttaaaacatttgaaactaattttagaatataagtagaccttaaataaagaatgttacatattgacttagttcctctaaataaaattttaaaggcatactatatttggattgaacatttcctagactgctttccagtgaaaggaaggcagccacacctaattatgcactggggaaggcgcttctagtgaaagcaaaatgtgtcttttggaacggaacaatagttcatattttggcttaattgcaggatcttttctttgtaattgaaattttaaaactttatgtaaatgaaatatttaataaacagaatcaccttaatctgttcggattgctataaaaaatagactgggtgccttaaacaacagaaatttatgcctcacagttatgtaggctgggtagtctaggatcagggttcaggcagattcagtatccagtgagggtccacattctggttcatggacagctgtcttctcactgttctctcagggtggaaatgagtgagagagctttctgaggcctcttttaaaaggcattaatcccattcatgagagctcctcccccatgaactaatcgtctcccaaaggccccacctcctaataccatcacattgggggttaggattttaacataaggatttgtggagggggagtgggagggggaatgggacacaaacattcaatctatagcaagaacttaaactcctttccactgcagtctcttccaagatggtagcttggaatagtcaatgctgagcaagttctcttttttttttcatgtgatagtaacaattccctagagtctgtcaggtgtggaaaaggattaagctggtgccagtaggatttgttctgtgcttcccagcagcatggcccacagtcattctccaaattaaaattatcgtgactctttcacatgattatgtaatgagcttttaggtaacatttcaattaaaaaaaataggaaagattgtaaacctccagtaaaagaaggactattaggtgggatttggtgtcagtttaaacctgggttcaaattctaaactaggctacttattagttgtatgagccaagtatgcaattttactcagcctcagttttttaatctttaataatacctgaggattaagtaagatagctaattatagtatgtctttgaacacttacaataaactgtttatggtactatgttaaacataatgctttcattattttattaactcttcttatttatttatttatttatttatttttttcaagacagagtctcgctctgtcacccgggctggagtgcaatgccatgatttcagctcactgcaacctctgcctcccaggttcaagcaattctcctgcctcagcctcctgagtagctgggattataggtgcacaccaccatgcccggctaatttttgtacttctagtagagatgggatttcaccatgttggccaagctggtctcaaattcctgacctcgtgatccgcccaccttggcctcccaaagtgctgggattacaagtgtgagccactgcgcccagccaactcttcttactaacattataagtcagagaaggcaatatggctaagtggctaagaggctagtctctgcagtcagaatatctggatttaaatcctaactctcccatacttcttgatgtccaacttcctcatttgtaaaatagggatgattattacccccattttccaatttggggaaatgaggatgattaatattaacctatttcactggattgttgtacgacattatagggtaatgtttaggagtacggtctctagaattgaaatgtctgactctgaatcctaactctagcacttattagctgtgtgaccttaaataagcacctttgagcatcagtttccttaggctcatgatgtgagccttcccacttggccggtgaagtgtcttcatgacatgggaattgtctttccctagggtgaaccgagagaaagaaagatgaaaaccacagtgactttatgacttgccctcaaaagtagcatactgtcactactgttttattctattagttagaaataagtagctaagttcagcctgtactcaaggagaggggaatgagacttcacctatttaagggaggaatagcaaataatttgtggacatattttagaactacctacagtctaacctctgcacacaaattgtttaccttattctcacctgcaagtaacctcttcccatccatatcctctccaaagtcacaacatcagctggaaatccatgatgttggcatctattacaaatatgatccaggagagacttcttgtatgtagtagttccttaagtgtaacgtctttcagctttaggatgactactatagactcttctgttcaaaaaatgagaaaatagaaagtatagaataactgctatacagtcctgttcaaaaatggaaaaaaaataggagccactggtttatggtattctgaactcctcctgggcaaatgttgccagttccttgattaagactcaagtcctgggaatagttcatggctcttgattctgccctctaagtcattattttacatgaattgtagctcatgtttgcagctgcgtagatttctcagcctgttccctgcttatggaagtttggagcaggggctggtatgaaagcttcttttcatacaaagatgtattcccttttagtccaagctgatagtgtttctgccaatacgattatcttaaaaattttgttggtctcctgtgagtcatattgaattcattctactagacaaaagcccacacccacaagtctctttgatatatgctcttctttaacttgggcttctcctgggactgctgaggaataatatctttaggcttcttgggagatctgttgtttacctgaatggttgtctgaagcaacaccttggacctttctgagatcttaagattttatagtcgtacccttagcttcatctttagatgctttcttgacacagccctagattttatttttgcctggaagccattgttaattttagtatgatgtgccatctggagaagatttttttttttgagatggagttttgctcttgttgcccaggctggagtgcaatggcacgatcttggcttactgcaatctctacctcccagattcaagcgattctcttgcctcagcctctcgagaagctgggattacagccatgcaccaccatacctggctaacttttttcttttttttttttttagtggagatggggtttctccatgttggtcaggctggtctcgaactcccaacctcaggtgatctgcctgcctcggcctcccaaagtgctgatgattataggcgtaagccaccatgcacggcatggagaaggaatttttaaaaccagcaagttctggcttgtttttatttatccgtgtttcttttaatttttctcttctcttacattttactgtaagcagcaaaaagaaaccaggtagcaccttcaaaatctgctttgacgtctccttagttagatctcccagttcatcggtatatattctccctttcatgttaatgagggtgactttctgtcaccacataacaaggaaccccttttctccagtttccggtaagatttttctcacttttccttaagcttttacccgtcgcttctgctatggcctgattgttggcattcccccaaaatttatatgttggaacttaatcctcataatgatggtattaagagttggggcctttgggaggtgattaggtcacaagggagccttcatgaatgggatcagtgttcttataaaagaggcttcagggagccttgtgaggacacagaagacaccacttgtgaggaatgggtccttagtagacaccaaatctgttggtgccttgatcctggacttcccagcctccagaactgtaagcaggacatttctgttatttataaattactcagtttaaggtattttgttataggagccctaactaagacagcttcctcaaaggtcatcatgcttttgcaaagtttctttgacgtttctagtttttattcgctcgaagttctttcaattttcactgcccgattttacagccactctcacattttaagttttgttacagcctcaccccagatccaggcaccaaaatctgtattagttatctattgatgcagaacaatttaactgaaatttagtgcattaaaacaacaaacattatcttatggtttctgtgggttaattctagagtggcttacctggtggttcaggagtgaggtctctcataaaatcaaaataaagatgattgaccaagcctgcagtaatccaaaggcttgactggggctggagaatctgctctcaagttcactcactcagctgttgacatgaagcctcagttcttcactatcttttggccagaaccttcagttaccttgtgggactctccatagggttgcttgagtgccttccattatgtggcagttggcttgctcccactgtgattgatcctgcagagagtgagtgagtgagtaagatgaaagtcactatgtgttctatgacctactcttagaagcactccattattttcactttattccatttattagaagtgagtcaccaagtccagtccacactcatgtggagagaaatgaggctctccctcttgaggggagaatttgtggacatgttttaaaaccactacagagattatatcactttcctgcttaaaaaaccttcagtgatttcaaaccactgcggagattatatcactttcctgtttaaaaaacccttcaatggcttcaaattactacagagattatagtattttctagtttaaagacccttaagtatcttcctgtaatacatagaataaaatataagttctttttttttttttttttttttggagatggagtctcatactgtcacccgggctggagtgcagtggtgcaatctcggctcactgcaacacccacctcctgggttcaagcaattctcctgcctcagcctcccaagtagctgggattacaggcatgtgccaccacacccggctaattttttttttttttttgtatttttagtacagatggggtttcactatgttggccaggctggtcttgaactcctgaccttgtgatccgcctgcctctgcctcccaaagtgctgggattacaggcatgagccaccgcacccagccaatataaattcttcattccaattccagaaccctatattccacgctggtccctgcccatcccatctcttggatattggttttaacttgcccccgacccactatcctttagccacttccgacttcacctcattccttgaacaggagaggctcattcctaagggctttttttttttttttcctccactgtttcttctcctagaatgctctttatcctttgatgtttgctggtctgactgctttgctatcatttagatctcagcttaaatatcgctttgtcttagaaggaagaccagtcaatttcaggtagctacacagatactttatatcacactatcctaacattttgtacataacagttatattaaagtttattttttgtttacctatttatgtgattattagttctcccccactccttcactagaatgtaagccccatgggaacgtgggcttttctttcttgttgattgttatttcaggtttgcctagaattttatttgggatatgatagtgtgcaacaaatatattttgtgtaactgaattattgctattctaccatactgtaaacctaatggtggtgggattgtcttagtctcattcactgatacatccttaggaactggcatatagtagatattcaaaatttgatgaaaagcaatattgtagttgaggaaatttagatattaaatttccctagaccacttagcaagtaatcgccgagccaagacttaaacctaggtctattaattctaaaatattaatacctaaacatacatataaagtgcttggcacatagtagttgtacaaagagtagaagtgattctcttccccttcttgtaattctcttccccttcttttaatactagtacatgtacattgagcaatagttgggaatctatgtttttcatacaacatttctttaataaatattcttagatgtcagcatagttcatgtactagttccctaagatattttgaagaattatgtttgtttcagtgagctgaagttgtcaccttttgtattttatttcagggcctgggatcaagtgttaaaactctcggtatttcgtttattttgagtcggatgcaacaaaacttagcaaaatgtgaaatatagattacaatgctcattctaaagtatctagttaatttggtaaacatgtatggcacaagtactattttgtacagcctgtgctccatggtaggcaacggagtggaatggagaggaagaagagctgtttctactctcatagcatctgaagtcgtagtagaggaaactagacctgaagtactttggctttctgaatgtaatgatctatccgcttctacttttctccttaagatttgttgaaagatctggagggcctctggaactgtatgccccagataaactgcatgccccagataactgccctcaggtgaacttggagttgtaattaatggaaacattgtcttaaggaatgatgcaggatactttgctggttgtctctgttgaagcatctctaactattgatttagtctattgagctatacagtatgccaggcttcattttctttgactttgtgatacagcttaaaaaagaaaaggtattgagataaaagttgcttttatcttttatttttagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggtaggtggatattgattttgaagactattcataccacttttattgctttggttatgatgaaaaattattgatttatttggaataaagatatacagctctttgattatgtctgcctcagacattaaaggcctggattagcttccgcgaatactgcacttggcttggatcaagtcctaaatctgaaacataggactccttcactggtcagagttagtgatcggccatcctcatcagccattgagatgtgagagagatagagaagtgggagctgtggcctctattctctaagaacatattagtctactttccatgacataggaaatggaaataagcattagtatccattagtattctacagcaaacaaatcatagtgacttcaaacttcatgatggttcacagttctctatagatggtagcacagaagcctttgagaacctagagtgttttgaggactgcagctttgttgaagtatcatttatccattaattttttcaataaatattcactgaatgctggtgatataccaggcattcttttaggccatagggagataggcatggacaaatcagtccaaaatctgccatcttgggccttgcattctgctgagggagacagatcataaatgaatatatatgtaatgtcaggtggtgatcgttaccatgtaaaaaaaaaaaaaagcaaggtaagagttaggagaacaatgaaggtgctgttttagagagggcagggttttttaactttggtgctactgacatcttgggttggatacttctctgttgtgggaggttgacctgtacattgtaggatgtttatcagcatcactagcttctacctactagatgctggaaggtcccctctccttccatgggacaaccagaaatagctctagacattgccaaatgtcccgtgaggggtaaaaatggcccccagttgagaactcctgggatagggaattaggaagacctgctaaggaaggaacattacagcagagactgcaatggaatgaaggcctgagctatgtggatacttgggggaattttggactatgttctaagtggaatgagggattagtgggagattttgtgctgggcagtgacatgttctcatttgtatttttaaaagggtaactggtggctcctgtatagaaaatacattttagggggtgtgaggatgaattcagagaaaccagttaggaggttgtcacagtggtccaggtgatagatgatggtgacttagactagaccatagcatttgaggtggtgaaaggtggctttgtttcaatatattgccagggtggagctgataggattggctgatggtttggatgtgatagaagagccagggataactccaagatttgggatatgaacagctaggcaaatggtggtgccatctactgagatgaggaactctgagggaggagcaggtcatcagcaggaggagagtgattgcgataaaaccaagtaaatgtagaggggtggacaagatcatacacggtcctgtatgttatgtggatgatttcaactattattccatactaggagtcattgagaaattttgagccagatgaaagacatattgttttgtgttattttgttttgttttgttttttcaaaacaagaacatttcacagatcttttatgttagatagaagtctttctgatggtgtggaggaagtgaacgaatgaggacagcctgagagaaggttgagactgaaggcagggagattaatagggaagcttttgtggtaaaaccagctaggccaagtcagtgtaatagggctgtaaagagcaggaagagtgcacaaaatactcattaaggtggttgaataggtaaaagtagattgttaactaaaggaaagggaagaccctgggttgacttttggatttctagccattcactgggacagagaataggttttatgtgggaagcagggggggatatccttattctattcataatttatatttttcctactttagaaaaggatgtgaaagcacttacaataaaagacatgttcaataaacttattaaaataggatgtgaaaataaataaaccagaaactttggcaaacattattattttaattaagcatgaaatttatctttgtacttcctggaaggcaagacaaaaatgtgggaaacaaagggttatataatctcattgtttgttgaaaggaagcaaaccagcttgtaagaggagagactttttttcctgacactaaattattgtgtgggtgcttatgaaacagacattacataatggacaattcaacagaaaatgtagagatggtcttcatattactgtttcattttgcaagaaagctttgtggttaaaaaaaaaaagaaataaaaaaatgactgtttcttctaacaaccgttgattaaagcaggagtacagtatttttaaacaaaaggacaacctgagtcctgtgctccttgttggctttgtagcatgtcattgtgcccagtgtaaggtgagagaggaggacgtggtacactgacatgagtaccatacgcccaggcagctccataaacggagtattttggaagctgtcaggtttcatgggctccacatgtcatcttcctcctagtgtcactcaggtaagagtatgagaatgatgccttctggagttgtaaaatatagaagcctttttttctcttaacacatacaaatttaagacttcattaaatcactcctgtaatgtttctagcccactcaacccctacgaatcattttctttgtttgtcaacagtgttcatttgagggaactaatataaagtagtagataaaaaactggagctggctgggtgcagttgctcacacctgtaatcccaacacttggaggccaaggcgggtggatcgcttgagctgtgtttgagaccaacctgggcaacataatgagtccctgtctctacaaaacataagaaaaaaaaatagccaggtgtggtggtgcgtgcctccagtcccagctacttgggaggctgagatgggaggattttttgagcccaaggaggttgaggttgcagtgagcagtgatggtgccactgcactccagcctgggagatgacagagagagaccctgtctcaaaaaaaaaaacactaaagtcttagggtcagattgcctagactttaatcctagtgcttctacttgcaagcagggtatattgggcaatctattaaacatttctaaacctcagtgttctcatctataaaatgagactgttagggtttatagaggtgttttgatataatgcatctatcatttcacacatagtaagtgctcaataaatattagttgttattattataattaatttttattcttacttccctgtgttgaactcttacattgtattgttgctttttacttggctaccaggcaaggtttatatttatgttttatatggaagttcaacaaatatttgtgtttgattgaccttgggttttcctattaaggcacagcactagtaatgacatataataaattaaaaatgatacctgtgaagctgtaagacagctttgttacttttttagggaactgatttctgaacagtttacactttgaacaactttataatgttaagaaagcatttgcccatgttggtggagccaaccaaatgttactgtcccacgtacttatgagttaaatgcctggggtctagtcagaaaaaggaaaggttgaataatgccatatgtgcaggcttatatgtcgtatcctttgtggttgagaggtgtagaaaaaaattaacattttccagaggatcagaggaaacatttttatccttttagctattaatgataggatgcaaactgatacttttcctcctgccctttctgtatgccttaaggttaattctaagcacttttgttctctgttctttgctatgaaaactctgtattagctacctatttctgtgtaacaaattaacccaaacttagcaacttaaaaccacaaacatttactatgtcagtttttgagagggcaccaatcagggagtggcttcactgggtggctcagggtcagtgtgtctcatgaggtagcggtcagtgtgttgaccaggcctctgttacctggaagcttgagtgcactgcaggtctgcttccagcctccctctcatggttgttggcaggcttcacttccttgctggctgttggctggaggcctcacttcctctccacgtagttatctgtgtagtaagggctgcttatgacatggcaactggcttctctcagagagagagagcaacccagacagctgcctcagttattttagaacctaagcttgggagtgacataccaccacttccaccataccaaccctggtatgatgtgggaggggacagacagcacaaggttgtcaataacagtaggtggggatcatggggagcgatcttgaaggctggctaccacagaattcctctatctgtagagcttcagctattgtcattatacacaagacatccaagtctgcattaccagtccatgtcttgcgacttatctttggtgtattcctgtgttatttcaaactcctgttgtctgacagtaaaattatcatctctcttccaatgcccttcgattttctttaagcaacttaggtttacaactttgaggccatttttttactcgttctttccttcttatcattggtcaggtactaattttgtgttttcttaatgtttcccaaatcatcttcttaatgttcctatggctactatactagtaaggtccctactatttcacacccacaattgatacaatagcctggctctaagtctttcctttccattctattttatgtactcctactagactgatctttcttttttttttttgagaccaagtctcactctgtcacccaggctgaagtgcagtggcgccatctcagctgactgcaacctccgcttcccaggtccaagcgattctctgcctcagcctcctgagtagctgggattacaggcccctgccaccacacctggctaatttttgtatttttttagtagagaccgagtttcgccatgttggccaggcttgtcttgaactcctgacctcaggtgatccacccgcctcggcctcctaaagtgctaggattacaggtgtgagccactgtgcctgccagactgatctttccaaaccttgacttatacttcaccctgtggcctctccattaagattccagtactttttactcaagatccttagcctatgagctgacacattattgtgtgtatgtaatagaattgacaggagggcttttgtaagaaaatcaatccattaggcacacaggtatatttaggactttaaaaaatgatcttgaacactataagttggttaaaggtttattattttaaaaatctttttaacagtatggaggtttgaagaatattgtagccttgtattataatacaagaatacttggattgttttattagtagataattaccattacagaaatcaaaagttttgatagcaacagtgaagaagataatttttctagagggttgggagttcaattaatagaatggtttatgctgggcatcataagaagtttatataaattcaaactgtagcctaaatgagggccagcctgtggtttgaattctcaggagggaggcttttgttttgtttactttccccacccaaagtccaggctgactgacagacaaacttccttattgtttctttttgcctattgacagttctttccgggcccccattatattgaagatgtcatcccttggggcctaaagccctgtcttttttctctctctgaggatccgtgaaaacccaagggtgaaaacccaaggccgttcagcttgtggagattggcagtgacccctgacttctccccggcctcgccccagcccaagccttggcacctgcttactgctcgggttttagggtattctttggtttttgactcatgggatttctcttactgtcttgtagggcaggaggcttttagattgtgtagtttgcattaccactggaaacaaaaattatgatgtttttcaaactgggtgagggcaaaatttgtcacagttcttaagagtgtgctattattttctggttagaaagcttcgtatgataatccctacaatcgtcaaggtgaaaccgtttcttgttcctgaagtaagactccaaagctgagtttctcctcattgtgccttaccttcaaggttagagagaagtctagattttaatttgtatgcctgtttaactttctcccctcgtctttcttgttaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggtacttacctttctgatgttgctgtatttttgtctttctgtgttgttcaaagtgctttttatgactcttagtggtggattgcttggcttgtgtgtcgatgaagaatgcagctagctgtgggaattaatgtgcaatgcaggatacattgacacactgatcatctgtacgttgaatgcacttgtggccctgggttcctcccggggctatgcatgtctgagcgttgcttaaaaaaaaaaaaaaagaaaagttctttttaggttaattgtaagtaatttggcaatgcttgtctattataattgtttataactctgtctgtagtttaaaagtagtgtttcttctatatgtgcaattcttaaatgatgggtatgctgtgcctaaacttttgaatgcaagtaatgtctcctcttagagaatcattatccacttgttaaggcttattggtaaaagctttaaatgtgtacaacatttggaaagaaaaggtgagcactatgataatgtatgtagcagaaacctagttgataaaaatactgaattcttctgtactttttttccctcccaaatcagagactaacaatatataacttaagacacagttaaatcagtggaaatgataattatccacagctacaaaatttctgtactcagagtccctaaatgttactgaataatctcaaaacttacagaacagatttaaactcttccagtccagaagttaatctctcagatgatggtcatgctccatgatcatctgggaatccagggtatgtacgatcacttcttgctttggataattccctaggcaaagaggagagcagttggccagggaaggagttgtcctagaggatttgaggataaaaccacttgataagtgttgaatgaatcagaaattggagaggtggatctggcagcgctggagaaatacaaacaaccttcccctctttgaaagatggaggttctcacagtggtggcaacgtgccttatcagtgttagtcgcctgaacttcctgagctgccagggcagattaacatgccaaatattcatcatattctcaggaaaaataagtaaacagaggatatctgtgtttttttttaacttatcttgttgcgactaaaacaatctaataatgttattttaaagaaaagtatttgaaaatatgtttcacatctatttactttgtttcttacatcaagaaaacacataacattttagtcactggctctaccagattcacacactctttattcacccctgatggcccattcctgactgagccagactaattttcccacccttaaagtcccacacttccctttcgactctatactctgaagatgatgaggttccttctgctttcctgagaatgttagggttcctgtcatcctggttcactgaaccttaaagcttgtgtgtgctgactttcatcctcaccccttcccagttctctgaagatttgattactgtggtcctgcccattcccaccttttagacttggctacataaatgatcccttcctttgtatatgtagtcatttcttttattctttttccttttccttttcaagtaactcaaaatctcatcatataaacaaatcattcccctaataattctgtgccttgaatctacttctacttctctgagcatccccttgtgtgtcttctatctggctcctcctcctcagctttcacctagaattcagaattttccttttcttctctctactcagccttgacaatctcagtctcttgagtagctctcaccaaataatgaattattatctgttttgcaggttctcgcaactatggaaagactagagaaagtgaatagctttcaagagtttgtccaaatattcagtcaatttggaaatgaaatggtggagtttgcacatctgagtggagatagacaaaatgtatgtattcatcacattttacaatcttcagataaatacatactttttagtttggatggaggtatgatcgttaggattgtttggactggtttctttgcttattaagtctatagccttggtcttgaaagcctttcatagataagccaggataaagtaagtagatctatatgtctttttttgtacatttataacagttaattttgttcccacctcacacactgggaaaggtcatacttgctatcagggctcaactcaagtacttcttccttttatttggttactttctcttttatgaagctttccatttgattcctctactagggctcaggcacataaaattgagtcatcatatgtattcttatagtatcttgttagatatttgttattcttaccgtattagattaatagtaataacccaagccattatttatttgcactgcctatgtgttaggtacttaatatacatgatctcatttaattttcaaaacatccctatgaggtaggtattgttaactactgttttacatatagggaaactgaacctgagacaaggataaactttcccaaggtcactgtgctagcagatcgaactcagttatatctgattctaaagtctgtagttctcaaactacaacatgatatttgttttttattttattttattttattttttctgagatggagtctctctctgtcacccaggctggagtgcagtgtcgtgatcacggctcactgcaacctccacctcctgggttcaagtgattctcatgcctcagcctcccgagtagctgggactacaggcatgcaccaccacgcccagctaactttttgtatttttagtagagacagggtttcaccatgttggccaggctggtctcgaactcctaatctcaggtgatccgcccgcctcagcctcccaaagtgctgggattacaggcgtgaatcaccgtgcccagccaatattagttccttatgggtctgttccccaattcagacagtaagctcctcagttttgggagatggaagatcatattatgtctaggattgacttttccttgttggggtatttgtgtaggagtctgtcttgttggcaggttaaatatatataataattgaccatttcttgggatggttctgggtgtagtcccataggctagtctctcagtttttgatatgaactttcccaattgcagctggagttgaaaaatgggtattggtctggcaagtggcaggctaaataatggcattggtttgtaataccaatggtgtttctataggcaggtactttattgtttcattttctgtctgccattattgttctttataaaacaaattttctttcttttccttctctttctcttaatcttccttcttctcctcattctccccaatgataattattagcctgagtatttttataataatagtagcttataatctagcattttcttgatcacttgagcaagcgtggcatgagtcataggttctaaagctaccatccttcagttacacttcctacaggatcctcttcagcttctggacataactgaaaaactttcaccatcattttgatttgtagttagaaatttggcatggagaacattttatttttctcaattcttgtaatattgtgatccaacatttaaaaacttctggctgaagtggtatctatttttagcaatttagctcattaaatgtgggacccctgaaacttactggcagcctttttatcatctgtgtttgataagtgctactcctgggtcacttttttggaatatgcatccagggttcaaatgctttctcctttagaatagtcaaaatatcctgcaaagagctataggtcaggtgcattctcagttttctcagcaaatattcatcagctgcttactgttaaccaaatactacactaggtgttgaggattcaacagtaaataaaagtgacaaaaacctctgcactcatggagcttatgttttagtaggggtgggaggagatagacaataaaacagaaacatgcatggtgtgttcaaagaacacgaaggccaatggatggatcaaagtgagcaaacgggaagggtaataagatgaaatcagagaggtagtgggcaggccaaactgtgtaaggactttggctttaagtaaaatggggagccattggaggttttgagtaggagaatgacgttttctgacttacattttaacagtatcactctagctgccatgttgagaatagtttgcatggagacaagggcagaggcagggagaccactcaagaggctattacagtaatctattgagagatgatggtgacctggaccaaggtggtagaaagtggcagtggtgaggctgggcatggtggctcatgcctgtaatcccagcactttgggaggctgaggtgggtggatcacctgaggtcaggagtttgagaccagcctggccaacatgatgaaaccccatctcttctaaaaatacagaaattagctgagtgtggtggcatgtgcctgtaatcccagctactcaggaggctgaggcacaagaattacttgaacctgggaagcagaggctgcagtgagctgagatcacgccactgcgctccagcctgggcaagggagggagactgtctcaaaaggaaaagaaagtggcagtggtgactcctattcaacatagtgttggaagttctggccagggcaattaggcaggagaaggaaataaagggtgttcaattaggaaaagaggaagtcaaattgtccctgtttgcagatgacatgattgtatatctagaaaaccccactgtctcagcccaaaatctccttaagctgataagcaacttcagcaaagcctcaggatacaaaatcaatgtgcaaaaatcacaagcattcttatacaccaataacagacaaacagagagccaaatcatgagtgaactcccattcacaattgcttcaaagagaataaaatacttaggaatccaactacaagggacgtgaaggacctcttcaaggagaactacaaaccactgctcaatgaaataaaagaggatacaaacaaatggaagaacattccatgctcatgggtaggaagaatcaatatcttgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacaatacctgacttcaaactatactacaaggctacagtaaccaaaacagtatggtactggtgccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagacggattaaagacttaaacgttagacctaaaaccataaaaaccctagaagaaaacctaggcattaccgttcaggacataggcatgggcaaggacgtcatgtctaaaacaccaaaagcaatggcaacaaaagccaacattgacaaatgggatctaattaaactaaagagcttctgcacagcaaaagaaactaccatcacagtgaacaggcaacctacaaattgggagaaaattttcgcaacctactcatctgacaaagggctaatatacagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattgctcaaggatctagaactagaaataccatttgacccagccatcccaatactgagtatatacccaaaggattataaaccatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcatagatgggaattgaacaatgagaacacatggacacaggaaggggaatatcacactctggggactgttgtggggtgcggggaggggggagggatagcattaggagatatacctaatgctaaatgacgagttaatgggtgcagcacaccagcatggcacatgtatacatatgtaactaacatgcacattgtgcacatgtaccctaaaacttaaagtataataataattaaaaaaaaaaagaaagtggcagtagtgacagccttacccaagtctgggaaaatacttctggaggtattgggatgcttcgcttagtgcttcatggaccatctgggttttatggacgcctctgttttgtcctgtggaccagccctttccaggttgagatgccatctttttctgtcgcttgttatcaccatacagcctatggtgtcatatgtggcttgtaagtgtcaggtatggcatacacacttgatgcattgtcagctagacccacaggtggttttgaaaggagtcctgtccaaaatgttaaagacaagaggaatgggtggaaattttataagcaacctcagcctttatctgataggtacccatgatggatgatactcacatataggacacagttctttgggatgtgatctgcattagctttggggttatatgcactttgtcgtacactatttgtaattccatctctatcttttattaaatctatattgggatgcaagtgagtgagagtgatattattgtgtaggactaacttctgaatccattctaatttattcaagcaaatttactttcaaaggcaaatcattctcaaactttaggttttacttatttgtaagaaggggcctttaacctaacttacaaataaaaaaggctaacgtgacagggaaaaattttatgtaattcaaatttcaatgtccatacataaagttttcttggaacacagctgttcttatttatttgtgtattgtctctgtttgctttcacactacaatgacagaattgagtagctgtgatggagaccatatagctcagaaggcctcaaatgtttatctgggctttaattgaaagtattgcccacctctgatttagatataataaccaaattattaacagagtattttgttgtagatttgatcagcaaactttggctacctcatgtgaatagcacacattctattgagggctctgtgaggagaagtcaccccccaccaaaacaaattcaatacacagtgctttcttaggtgttccttttcaatcttgttggggaaaattatctacccaagaaacatcttaagaatatttcagagcagcatattgattaagattaagacaaacgaaccccaatttgagatgcatagcagttagatgggattaattagacgaggctccttaaagaatcgacttttaagtgtctgttttgaaggaaataatagtcaatagatgctcagtagacaatttacttttaattaggtaagacataggctgggtgtttctggttaggacgcagtgtgtgcatttgacgtgagaatgtcaggtatgacagaacaccagaatgtcagccatgtgcagcctctacctgtgtctcagtttctggctctctagcccttactaagagtagctttttctttctactcatattgtgttgatgtgtttatattgaagcagtgacagtttgtaaaactttatcctggtttttttttttttttcacttaacaatgttagtgaattcttgagtattagtgttgaataaatacttttttaagaaattgggttgttcacatggtcttagactcctccgtgattttatttcatatttaggatttgaaagatgaaaagaaaaaggcaaaaatggcagcagctagggcagttcttgaaaagtgtacaatgatgcttctcacagcttcaaaggtaagacaattttggttttactgtgtaataaattaataattagaacacccgactaaatgcatttaacttacataatttacattttaaaaaagatcaaagtgattacttagaacataggcctgaatagttaaatctcagttattatttataagaatgctaactttcttccccaactccaaataataactaatttatgagtcagctttgattgaacagctcagcagaacatggtgtattaggtgctatgaattaaggcctgtcacacatggtagctgcctgcagggtttttccagtctcattgaggagccagcacatatgctctagaaaaagctagacaagttaagatctgttaaatacagtggagtaagaagtcagcacttagtttattctgtaaattcaccctttaattcctgtttccacttttaacaaaattatcaatcaagagtatttccaaacagcagttggccagcaaattggtgcaattctagaatgaatgagtaaaatgtctctttagcagtttgtttggaatcaccttttcttctgagagtatttaccccatgctagaatcagtgaagccacaaaaacagacttcgtggaacccactcagaagactctattttgtctaggcccttgagtttttcatttacatcattttttaaaagtcaagatgcatccatgatcatatatcatctcatttttcttcattctttttcatttctggcatgtgtaaggcaacatttaaaatagttttaatcatgatgaaaagagattttttcctaaaaaatttttaagtaaacttactgttgaagtataaaggtatagttttgcactctgcattttttatttaaccttgctatcgctttttactcatcctgcttccactttagtgaggagaagcagctgagtgagccagggacccaggagattttggtaaagaaccatttttcttagcatgacatgttctctgtaagatttttgtgcattatgacataaatcaaatattaaaataaaaattttcaattgttttgaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaaggtaagaataaagagagtatatttttatttttctcttcttattttattttattttattttaattttttgagatggagtctcgctctgttgcccaggctggagtgcagtggtgtgatctcggctcactgcaacctccacctcctgggttcaagcgattcttgtgcttcatcctcccaagtagctggtactacaggcatgtgctaccatgcctggctaatttttatatttttggtagagacggggtttcaccatgttggccaggctggtctcaaactcctgacttcaggtgatctacccgcctgggcctcccaaagtgctgggatcacaggcatgagccactgcactcagtcttttctttccattttaaaggagcatcattatgtatagtatccatatttttgtgtaatgttttagaacagtgcttcacaaaagcaaatgtatctatttaaagcaatgccactctgtacaaacttgttgctcagtaatatttacattaaaggtgtatttacaaagaacactggtctttggttatagtagctactctggctctgtttagctgtatggtttagctgtagcctcctgttcaaaagaatgttcccttcctgttttttgagcagtgccatatctttttgagcagtaccatccataggatgatggtgagcagcaaatcatttctgctagaattcctgcttttctctgtgttagagggttggtactttgagactatagtaatagtattagtaataattaaaatttaaaaatcaacagtaatacacactaacagttattgagtccttattctgtgccagcccttttctgagtgctttaaatatatgaacttatataatcctcaaagaactattgctattatttccattacactgttgaggagcttgagaaacagaaaggatattaacttgctggctactaagtaccagagttgggatttgaaactaggcagtgtgactccaggaagtctgacttctcatcagaagtcatagacatggtgaagatgctttctgggtaagagcagtgtctgagttgggagggccctaagaagtcatctagtacaatgccctcctttaacagatcagaaaactaaggccctgagaagttatccaaatgctaaaggttcccacctctctaacagacagggctatgatgagaatggcattctttccattttactgcactttgatttattttatttatttatttttgagatggagtctcactcttgtttctcgggctggagtgtggtggcacgatcttggctcactgcaacctccacctcctgggttcaagcaattgtcctgcctcagcctcctgagtagcttggattacaggcacccaccaccacagccggctaatttttgtacttttaatagagatggggttttgccatgttggccaggctggtctcgaactccggacctcaggtgatccgcccaccttggcctcccaaagtgctgggattacaggcgtgaaccaccacgcctggccctggactttgatttctaattgtgtgaaggtctaagtaggaacatggggtgaaaagacagtaatggaaagaatatctctttttgctcttaataaatattttatttaatccctacctgccctttaggtggatataattatatactgtttttttttgttttgttttttgtcttttttttttgaggaggagagctagtaagtggtagaacccttctttaggcccaggattctctaatcccaaagtccatgacctttcactttacacctctgggtttgtttatatgatgccagtcctaccactgagtcttcctgaggggaaagaaactgtacagaccaaaccttctcttagaaattttattgctgaaagagatcttagagattatttttctaatcttccctttttataaatgctgaaggaggagatgtgttgtcaaaggataattagggaaacaagtaagtcaagtgagagacatctttcaccacctgctgctgcatttctagtgcaggtgaaggaggggcagtgctctgcctgtggctgctgccgacagctctggctgctgccctctcgccatcaggcatgctggaggcagagctgttataaataggctcagtctcactgtccatgattatctctttggcatcttgctttttttctgatggagagtataatctatggagggaaactgggtactttgctgtatttggtaccatgaatatatggacaaatgttatgaaaccatatcagtaaatagcctctttaaaaaaaccccacaaaactccactaagttgctgtctaaaaacatgtatattttctctctaaagggaaaataaaaaaccttaacataaatggtatgagaccaatataactgatttttatgttttaattctgtttaaattctcaaatttaattctcttaaattaataaaataaatttaattctctgagaagatccccattgtaaattccataccttactattatctgtattctttcctagcttaaatacaagtttctgtctacctaggatggagtgatcacctgacacaacttgggccaagagcaggaggggaagcaaggactctcctatggcatcttgactttcccaaactttgatattttcatggatgatgttaaaatgggtcacacataaggattaattaaaataacatttgtgaaaggactttgaagtgttaaacaaatgtaaggtatccttattatcacattcattgtgaccataatcatgatcattaccgcttgttgcctcttggcccaagttgtctgtgtgacatatttcatggactgtagtgttttacagggttgaaatggcatgatgcatcgtagaaagctgagagagaaagactgcacacatgagcatgtgttcatcacatagtcaaggaactccaaacaggatggctgaagtgaaaggttgttagggggttcagggggtgagatagactgttagagaagtatataaagacaggccatagaggattttgtgctatactacatagacgtttgggcttgattctctatagatggcgaggaactattagagggaggtggcagtatcagatggtttacattttagattatacagaccctctggtagaggatgtttgggtcagtaaggtgctgttggggactttaaacaaaatgtagggagaccagttaggtgactaggagagtctttgctgaattaacaaaggaaaaatggatgtcttccccagtgcttctcacaccccacatcttccacaccatccttccccctgggctcagcacatttcatatttgggtgtaacttatcttccaggactttgcctaggcattttctcagatgcaaatcttttacctggaggctggttcatttttcctgccagttgctagaggatgatgctctttctgccttagtattcactgatctcatagcaatgtcattgtattaattactctaggaatggtgctttgcatggatattgaaggcttttgagcaatgtatccttctgggttagtggcgaatatagatatcattggtggctgtatttcccctcagcttgggaaaaggaaatgctagtgttttcctgggcactgttagaaattacagcccattttggtcaggtgggaatattgactcacatggatggatagatgtcctttttgttctcagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctgtaagaactttttttaaaatcaaagtaaatcttatataatggctttcccataaagttttgcaagatatggaagttacataatcaccaggagtatgaatttgttccagaatgggacaggatatctcatcccttctttccctcctagttggccaaaatatccttcccatctagcacttacaatacttgacatttatttccaggcctgttgactctcattctagccagtctcaattatatgcctctgtcactatcactagttcacactgttgtccctactcttccaccaaactcacctctggaaaattcctccccaaaatacttcttcagagtgaagaacagaggagtagaccccctcctagaggttcttgggacctgagcctgactgctggagccattcacatgtacacaattcttacctctgaggacagctgatttacagagacaatgatttagaaaacttattggggtgtagattcaatgaaaacaagggtagatccagctggcaagtaaaagcttttcacccttgcacaaattcctggtctaaaattggtgggtggccactctgtgagccttaaatgggctgttggtgtgcttcaaacagaggagcttatttgggcaagaatggccaagactgacagaagtgggacagacaggaagtgtgtgtacacaatctcttatagcaggtggattgcaaagtggagagacagagagccctgggacatgtctctagcattatttatttcttaggcccaggctctgtcagaaaagtatttaacatggcttacaatatacagcagtgatagtacaaatctggaagtcatgaacaaagctttggcagtaaagatgatgaaggagggtggatatggctgagactgaagaaagaaggagcagttgatttccttgtaagtagattaatttatgaatgaaagtagatatgaatcacagatttctctgatgttttcttggcatcacagtagtgcacatgttcttattaacagggaatcttgccctagagtatagtcgtgtgagagacttgagcaatgttttgtgtttagtttgaattatctgtgtgatacacaatctgaagtgtagattgcttcagtgttcagttttaagtccaacactcactataaagagttgcttgtgatgaaatactctgttgggaatgtgattctatcaatactcaaatttgcaattagcaaatgtcacaaatttagcaaatttacccgtgcatatttcacaagcactcagatctctgatcctgcattctaggtgtatttttcattcattcatttttttcagcagttgttactggtgccttttatatgccaagcaccataaatctaaagatgaataagctaaaatctttgtctgcaagaattttacaatatagaaatttgcgggaaggggtgagacaagtacaaatagctttgtaagtatcctaagagaaagtgtagactatgcattgagagggtttgaaggaggacaaatttatatttagggagggggctcaagaagtcttcatgaagtagtgatatttaatttttatttatcatgcaaagaattgaatatctacgacctaccatttgctatgccaggtactgtggatttagtggtgtgcaaaatagatgtgaacccagctttcgtggcctagtggggaagatagactttaaacaaacaaaaaataaaaaattccagatggtttggactgaaaaaataaatatgtaattgcaaactgggacgattatggagcaaaaagattacagtgagtaagaagagggtctgatttagattgagtgatctgagaaagcctttctgagaaaaagacatttatgtaagatcttaaagatgagtaggattttaatttttaactaggttaggagtgaaagcatggacattctaggcagaaaataaaagagattaattttagacttgagtttattaaagaaaattagattttaaaagttcacctttcaatataatccataggttcacagaaaaataaataaataaaaaaacagaagttcatctatttgtagttagcattgaaaaatataactaaactgaaattttattttccactgtaacttaaacaggtaaattttgaaaatctacttttatagttcacagaatagtattaaaatttattacaatttacagtccaaacaaaattgtaattaacagattaaagagatgcggtaacattacatgtatactttttaaaatttttagcaaagcaagaaaacaaaaagcatcgctgaagaactggaactcagtattttgaaaatcagtcacagtcttaatgaacttaagaaagaagtaagtatagtttgaaatttagcctcttctaattctttgtgattttcatgttgtatgggtgtatgaaatacattagtattattagtatgtctctgtgcctagaaaatggttttaaaagttttcctttgaggccaggcatggtggctcatgcccgtaattccagcactgtggggaggccaaggtgggaggatcacttgagcctaggagtttgagattagcctgggcaacatggcaaaaccccatctctacaaaaaacacaaaagattagccaggtgtggtggttagcacctgtagtcccagctactcgggaggctgaagtgggagaatcacctgatccccagggctcaaggctgcagtgagccatgatcgcgctactgcacttcagcctgggtgccagagtgagactgtgtctcaaaaaaagaaaaaaaaaaaagttttcctttgacatagttattttgaagccatgattttattaatgccatcattctcaaagcttgcacatgaattttcatcactttattcataataataaaaaactaataacctagaattccatcaacagaggaattgataaatgaattttggaataattctaccaaatactattcagtaataaaagagaacagtattgatacatgcaacaatatggatgaatcactaagacatactaagcaaaagaagccaggcacaaatgattatatgtataaaattccatttagaaaaaaacaattctagaaaaggcaaaactaatttataatgacataaatcagatcagtggctatcttgggtcagaggttggggtatatttactgcaaaagggcatgggaggactttttggcatgatggaaatgttcaaaattagttgttgtgattacatggctgtatatgttcatcaaaactcactgaacagtatctttaaaatgggtacattttgttttatatcaattctatctcactgaaataaattttaaaagatattcctttggttgagagggtttccctgttccctgaataaaaaattggtcatctcatgacttagttggccactctcaggttattgaaagtcctatggtcactttaagtcaggtgttcacaaactacaactggaccgttttcgtcagtagagtgtatggggacacaatgctgcccatctgtggacctactgtctactgttttctcactacaacagcagagttggatagtcacaatagggcctaaaatatttactctctggcccttcacagaaaaagtttaccaattcctgctttaagtcacaaaacataatctcagttgaaaattagaatgttaatcattatttaaatcttcatttagttgtagagcttctcccctgttccctgttttcccagctccaactagatagagctgggaagatgtggtctcttctccctttttcactttcctcaccctccgttacgtagctgttgttgatttttgtcaggttgtggcatagagagagaagagagaaagttgagaggcagaaggtttttagtgaccagcacccttatcaaatggctttgggcttggtagacatttacagtggactctcactctcatggataccttagtggttcttcagaggctttcctgttgccccccctacccccacccctgcccctcaacccctttatcctgttgctccctgcgctttgaggcatgcctggaggagggagtcacagtgggcacccagcagctctccagacagaccctcctcacacagacctctcatttcccttagctgtgctttcttaattcttttatttttatttatttatttttttgagatagagtctcactctgttgcccaagctggagtgcagtggcgtgatcttggctcactgccacctctacctcaggggttcaagcgattctcatgcctcagcctcccgagtagctgggattacagatgcacgccaccacgcccagctaatttttgtatttttagtagagatggggtttcaccatgttggccaggctggtctcaaactcctgacctcaaacgatccacctgccctggcctcccaaagtgagccactgcacccaggcttaattcctttatattcttgaagacagtcaagggctcaagacaatgaaattagaattttaaaaaaattttcttatttttgagatggggtctcactttcttgcccagacaatggtgtgaacatggctcactgcagccttgaccttctggtctcaagtgatcctcctgcctcatcctcccatgtagctgggccacaggtgcatgccaccatgtctggctaattttttgtagagatagggtctcactattataagctcaggctggtcttgaactcctgggctcaagcagtgtttctgccttggcctccgaaagggctgggattacaggtgtaagccatcatgcctggctgaaattggtttttggatgtttcttatataaattttatacgtggtgatctgtttcacatcttacttggcactgatatgtctattgaaatctccatttaaacatcctgttaaacatagaaagacatggttttctatgctttataaaaagcctgctgcccttgacacaaggaaaaaaacaaaacaaaacaaaaaagaaagaaaaaagcctacccatttcattccagactattcagttttaaccaaagtattgttaaaatcctgactgtcagtagaagatgatctccttgtgataaactgagtggctttccacaggcttcattttcattacctcttatatgggtatatccatgtcaacctcatagaattcttgtaaggattaagggagataatgtatataaggctgctgtcaggacgttgcatagagcaggaactttgcgtttgtcctgcctccctctcttacacgtgacaagagttacatgaccttggcaagacacagtctctgtggagctgtttcgtagtctgtaaaataaatgactggcattagatattctctaaggtcctgctggtgaaacaaaatctttttaagttcttatgtggcatttagtttccacggaaagtgaattttagtttctttgtttctaactgtaattattctcacttagttgcatgaatgcagagggtatcctattgttaattttggagacaatcctctaatttgaattgagattggattacttccaggaaaaaagaaatcacttcattcaaatagatttaattcaaagtcagatttttctgagaacaatgttattaaaaatgatctatttctggacaaccccaaaataacctgtcacatcattaaaaaaaaaaaaaaaggcaagataagaagaaaagattttggagttaatagtgtccaaagatatccagtaagagtgagccaggcattccacacaaagtcaataaaaccatggggttcgtgttaccctttaatctattgtttctcctgggacccaatttgttcatagaggcagagagtacaagatctggatggcaactatagacagattctaacctccctgagggcaggggttgtgtcctacttgtcatgtatgcccagcctctagtacagtgctacagtgcttgccatgatataggtatttaataaaatttattaaatttattgaatctcacattggtactttttcaaaagtatgctaaagaacttattaatgatcacaaagtgccaattttcttagtactctaaatattgcactcttaatactcttaatactgtttcattcctcaccaactttaagattagcagaagcatttttcacctaagggaaaagctacatgggaaagagctggttgataacagaatgaaaaagggacaagggtattcagccattgaatacccagttcatcttctagaaacagcattaccactggcaccagggggttaaaggatgaattagatatcactcctgcccttgagagaaactgtaagctcaccagtgctacacaactcctactgttacacagggaactttacaccctcccctcagtggaacccatggaactgctttgcggcttctctttattaatagtttttaaagtgctgatgtggtgcttggtcacaaaatgttattgtttgttttctttccttcatcacccttctccttctccaccctcccacccccccacccacacacacatctgcagcttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgaggtgagtaaacaaggtgctaaagaaattgtagtttaataatggctttattaaactatgtgggaatgttaacacaaatacagttttgggttaatttatctgagcattttctctctcctttggcatcttaaaagcataccatgtatctgttctgttcctgcaacagtctggcctctaaaacaaaacaaaaaaaatgctaagacccacaaatgaacttcttaatcttcttttccttatcctctcagagaagttagaccttggagtagagccatggaggtacgtcgtatgaccttgtttctgtttgaatctgtcagggtctcagcagggaggagatgacacactcaaattaggacaatttgaagagagtttaataaagaagctgtttacaattgcatagacagggcatgggggaaaccatacatgagagagcagtaattggggcgagtggtagcaaggctggtaccaccccaggcccacatcagcaggggaatgtggaatggggaagcctttcagagaactgccttgagaggtttgtgattttaggactaggcccagagacagcccaaggtgaccctcccgggaggagcatgggagtcaaggcccattctctcctcagtcctgctcatctgtggatggggcttcccattggatatcccattaggataatcctaataatccaaacataggtgtagacaatataagtcagtctcccagggcaaaaggcagatgtgagaagggaggagagcagttaaggagggacaatgagaagacatctggcacatgattccaaatcttaattatgagttactgatgcttcacctgatacttgtgttataattccagttaggcttattaattgatattctgagccttctgcctattgaaaatgtcagatatctactagaaaaaaaacccaactgtattagtctgttctcactctgctgataaagacatacccaagactgggtaatttataaagaaaaagaggtttaatgaactcacagttccacatggcagaggaggcctcataatgaaagcagaaggcaaaggaggagcaaaggcacatcttacatggcagtaggcaagaaagtatgtacagggggggaactcccatttatgaaatcatcagatcccatgagacttattcaatatcacaagaacagtatggaggaaactgcccccatgattcagttacttccacctggtcccgcctttgacatgcggggattattaccaattcaaggtgagatttgggtagggacacagccaaaccatatcaacaaccaaacaaaaaacggaacccatgtatagcttgtatgtatgaggtatttgctagccaacatgtgtataaatgcacagatatgaaccatctagctatcttcacataatctaacataccctgttcaccaaatctcaaagactaatggttagaaggaacctttagactaattgaactggcttcctcttctttacttgtttacataggagccaaaaaacttctgggggaacattcttaaaatgactgtagatatagcttcttcatttaataaatttgatgctgctatgtttataaaccaaatattataactatagggaaactgcttattttaggaatcttgcagcaaatctttttaacattgaaaaaaaaaatgttctctgattttctgttttaagcgtcaagattttcagtaatttcctctgatatagggtctgtccttattataccagtctgcctaatccagtgttagctccattggaagacagtgttgatagaacatgtagcttgtagtaactctgacatagtttagctgtgagaccttgggcaagttacttctctgagccaaatttcttttttttttcccaaatttctttatatataaaatatgtgggcactactaggtctttccaaaggttctttctgttttaatattctgtaaccaccttgccatgattggataggaagtagaaacaatgttatacctttattgatatctgctttgttcccagagaatctgttggtgaccaatataatattataataatcttctcagtaatgtttaagtttattttaataggttttaagaaattttatttgtaaaattttctttttaattataaaatgatactatgtattgtggaggatgaggatgtgaaagttaaactgtagacatattgtcttgtagacctgtcgattgttacgacacatatctgggacagaacctctggaaataacctgtatacatgcagaggagacatttcaggtgactggccaacaggtatgataatagcagattgctccttctgtattgtgtcctatctgagtgttataacaagttgtgtggatggaaggtataaatggtttttcataactagagtccaaatatacatagagaaagaaagataatggaatttctgttggtagtgtgccagaacatggctaaccttccattggagctggtcatctgccaaattggagactggttcatttaattaatactctagtttatatctattttaaaggaagctgtttacaatgcacttgttataacatgtttggagattaagttatcatgacataagaagccatatgttatgtaatattcacatttcaacctaagattcaaatacatttcatgctaataattaggacatgagactaaaacacaaacaaaacaatgttatgacattacttacaagattcaattgggaccaggcatggtggctaacacctgtaacccagcactttctgaggctgatgtaggaggatcgtttgagtacaggagtttgagactagcctgggcaacacagcaagaccctctgtctacaaaaaataaaaaataaaaacaaacaaacaaaaattacccatgtacagtggtgcttacctatagtcctagctactcaggaggctgaggcagggggatagctttagtccaggagtttgaagctgtagtgagctatgattgtgtcactgtacaccaggctgggtgacagagcaagagtctatatctgggggaaaaaaagatccaatcagaagcaaaataactatcttaaattaggcaaatagtacattatagtgttaaaataataattatgataaccagaattagcaaccactgaaagaatgttctgttcaatgttaaatgaaaaaagtagggtacagatttgtatgtatacaaattattcccataatttcatatgtatagagaatatatacatatgaaaatacctatatgacaatatccttgtttagctagggtttttttctggattttctatagtagaggtattcatttgtccttataattttcaaaagcctttttaaaactgattatctcatttaatactgttcctgtcaaattaatctaaggaaaatggttaaagacagagcttcctcctttttttttttttgagacggagtctagctctgtcgcccaggctggagtgcagtggcgcgatcttggctcactgcaacctccgcctcctaggttcaagcgattctcctgcctcaccctcctgagtagctgggattacaggcatatgccaccacgtctggctaatttttttatttttagtagagacagggtttcaccatgttggtcaggctggtctgaaacccctgacctcatgatccccccgcctcggcctcccaaagtgctgggattacaggcgtgagccactgcacccagctgtttccttctttcttagagtctaagctctaaaataacgttttgcagttgttcttttgtttatttttttaaatattatttatattttaatttatactttatttatattcatttatttactgtcagccaaaaggattcctcctaacttgcaatattgggcagtagaggttgagtccctgcatctttgatttatagctgagaacagtgcaagtgacctagactcaacgatggtgtgtgccctctaggagaatcatgttggatgttggagggatgatctcatgctctcctgtagagaacagtgtcaaaggcttatcatgaaagcaggaactatatgaatgaacctccacaatgattatctgctgaacactttattacaaccaagggatctgtttactgggagaaactgtgtcttcaatattggcatgggagtcacttttcttgccttggctgcaaaagtattccaatagaactggagggcttgactctcctgccatatgcaatcagttgttgctcctatcctcaggccctgcttgccatctggttgcaatttttggtttattgttttattgcagcagagatattaggaatagccatattttcttccccaggatagtggcagagcatgttgttaataacctgcataacttgagaagctttttctgttcccaaagccttagcttccactcctagtctttgccatctgcctcacaaaaggataatttaaggacattgagcatgcctctgggataatttatttctggatatctctgctttggcaatgttatttttatacttcctttaaaatgttagacatactgagggaacagttgaacagtttgtacactagttgagaggagagcaatgccaaaatctagcctgtagtccatggcaagttatgtgcctgctttccctgaagaggggaaccttgttcttataacactgccatctgcttggcaagtgctgtgcctgtgacactatgcccaccccagagggaggaacagctagctgtaattcattcaaaggtaccaactattaatatattagctaacatggccctgtaattcattcaaaggtaccaactattaatatattagctaacatggccctgatcatattaatcttctgtaagttccccaatgactttctcactcagaagaaaatccagtccttaccatctatgcttctccattacatggccactggccaccttcctcttgctcatgtcagtctgttcctctggcttacttgctgttccttgaacactccagaagtgtttctgccccatcccaaatgacttcccctcgattttcctgtagctccctcaccttttcagtgactctctaacttaaaatactgtgaccacctaatcccctccatcattctcaccctttattttgatacatatttttattcccttctaaaatattttataatttattttaattgtgtctctcccactgcttgttataatgtgagtcccatgaagccagggacatttatctgtttcattcacagctgtttccccagcacctggaacgtgggcacagtgcctactagtatgtagtgggtgaatgaatagtcatgttagttgtatacatgtgtgtgtgaataatcccatataatcaactccatggaacaacaacatcacttgttagtaatgggcatctctatcacattatcctattaatttccctcatagcagttatcataatttatagtattttaattgtgtgcttgtttatagttccaaatctccactagagtataagcttcataatagagggcttttatcttctttttttatcaccttatccccagcacctagcatgattttttcacatagtggattctctaaaatactacttactagatgagtatttgatataatatccccagtctgtgaaacaagaaggtagacagaatcagtgcctgttgtcatgaatagaaggtgaaagtggtagaagggaaaggatctgctgtgaacatatcaagactgaactctgaattcctagctcctggatctttgtgtgtgtgtgttttatgtaatgggccatcaggaaatttcagtaggttgggtctggtcgatggcttctattttgaggtagaagctaaagtgtaatttctactgaatgtcaggtcaggaggtgtgtgaagactcaacccagccatccattttctgcctatattacaattagcatccatcaagtcctttgtgttagagagtgattattatatgaaagataaaatgttagttgattcattaattcattcatgtagtagctaacactaaataaaaccccaaatgccaaaatctcaggcttaatataatagcagtttatttctcacttgtattaagtcctgattaatggtatgtctttctccctcttggcaatccggtcccctttcattttgtgcctcgctagccctcaggacctcaaagtccctactggagcctgtgcattgaaccatcagatgtggaagggagagagcactgaggggcacgagggaggtttggatcagttaggatggaagtggtgacccacattcaagtggggacagaactcagtctcgtggccatatgtctccaccagggaggctgggaaatgtaatcttcctatgtatccagagggaagacaaacagattttgatgaaaacatagcagtctctgcaacaatttatttatttattcaacacatttatttagcccatgtggtggtacgtaaaagtaccaggatgatttctgccctctttacaagtgttttgtgagtggcagtgtgatgtgatggaaagagcctgaacttggatcaggtagatctgagtttagatatcaactctgtgtatactcgtaatagggtctggcacaagttactgggtatctcggagcttcaacttttccagctgaaaaatggaataatgcttatttggaaaaagtagtattttatttgtatattttgggggatattaatgtattaatgtatctcaaacaccaaacagtatctcaagcatgtatctaccaagtactcatgggtgtgtatatatgttacttattattatcactaccattcctactattaccactgctactaccaccaccactattactgctacctttgctactctgtatacagtacactttttgtggtctgagtataactgtttgaattattctatgggaacaactttgttcaaacagagttttacttgagtgaagagaattgctccctgaatgcaggtttgtatataataatgcatactatttgtctgcaggtcagattataagaaacagcaaattttgtcctactgtgcatcttcatattgcccaacatggagcttgtgtatagaaattacttcatagttgtttattgagttgaattgaacagcagacttacttacctttggtcttcaaagtgattctgagggctaagattttgaaattcacacaggtgtatattgtgtttctttagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggtgagaaactgtccacataatgaaatatgttattattttaatgtaactcttgttagttttttaatgccaaacctcaactgcaaatgaattcttgtcgtaacccagctgggttatttttgtagtaaaatattgttcacaaaaaaattacaaaaatattattttatcctcctttattttagtatccaagcagtaaagtttgttgtacaacagtgtagtaggccaggtgtggcggctcacacctgtaatcccagcgctttgggaggccaaggcaggtggatcactttgaagccaggagttcgagcccaacctggccaacatggtgaaaccctgtctctactaaaaatacaaaaattagccgaatgtgttgatgtgcgcctgtaatcccagatactacggctgaggcacgagaatcacttgaacccgggaggcggaggttgcagtgagctgagatggcgccactgcagtccagcctgggcgacagagcaagactctgtctcaaaaaataaataaataaataaataaataaataaataaaacaaacagcatagtagatctctgaattaatattaacatcctagttttcctattgaaatagtcatttttaaatttcttctgaattgttttttaattataatacaacagctcttctataatgcagtaattctatgttttaattctactaacttcataatgaaatgaatgtagttatttgatttttgaattgctttccttccacttggatggaatctctttccttgatgactacataatcttggaatattgcctgtggtgggtaagttcattggtatttctacaacatgtagaatagtgccatacaatgtataggaaggcatcatttttattctttattttaataccgagtggaagttttgtttattttccattgtactgtgtgtcctgttatttatatttacatgtttatattttttctcttcaaatggcttctgtagtgtcaaagcttgcttatttttttaaataaaatgtcatttacaattatatcaaattacatattttttattgagtatgcccatttaaacatttcatattttaaaaatactcatttaggataaatgttaatttgcttaaaaatcagggcataatagaattatagctataacatcatttgtaaagtatgataaatgtttaccatgcttccacatttaaaaatttctgtgatagtctgaatggcaaatcattttgatgctttgtatttatagttacatagattttcatatgagccaaattttggatattaaaaggtaaatgatataattgatccacttttaaaaagaagagtggtcacttagccttagggactgttgggaaatgaagagaagtggcttgctgttgtgataagatacctggtgtgggttatcctggagtatctgtaaggcccaggtctttctcaaactggtgttaggcaagcttttccctgctccgggcccaagtgtccttgactcaataatgaaagtcttaggctcagtgatctcagtgacctgtcagctctaaaagtcttttgtgagcactacctgaagttagtgtactttcgacttctgggcatgaatataccctgcactgtgtctttatcctggctggctctctttaaaggccagaggaatattgtcttctggctttatcagttgtcatcagcccatgacatcagcccagtagggaggctggaggagtgccacaggatggctatttttctggcatgtgactgactttatgtacttgtaaacgtgttccacgtgcactgtgagaagctttactaatagctgcagccattctggaaagaatatggcatcaatcctggccagctgattctcctctttaccagaacaccattgagcttagtacaggtatctcctatagtgttttcagtgctgaagaggtttgtgttttcattcttgtaaacatgggctatggctgagttttcattacttgtacttcttccatgtccctaggccagtgagttcatcatcatctgaaatggatatggttctagttttcttgaccaagggcctgagcccccttcctctttgtgtttgagatgctcgcagtttctaaatcgggctgttctaccagcattttggtctattttcttctctcttttatttccataagaagaggagttataacaggcttttcccccctctcaagaaagatagcagtcatttaacagttattctctgccttaatcccaggcgatgttctgagtagcaattacggtagcaattagaggttgataagcttggcaagggggttttctttctataaatataagtaatttttttccttaaaacagaaaacaaacccaagttgcattttccatcaaggggtctcttccttcctctgagatctgagtgctaatctcatgttagggatagaattgggtagaagttgaaatacaggttctgaagtggactgcctaggttccaatcctgcctctgctatttcctaacttaatctctctatgcttcaagttttacatctgcaaaatggggataatgatgacaaaactacctaatatggtaagtgtgaagattaaataaaataagttaattcacagtaaattctcaacaagtgttacctctatcagcatcagcatcatgaccactgttaccttgtggtaaaactaaatagtttatgagaaaacattaggtccaatttctcttacttaatctcaatctctcctactttctggcatccatctctccctatgtcctttctcctactctagggaggactagccagtctggccccaccgtagaaaacctctagatctgcagaagcaaaggtaaactccttgcttctttgtacaaatgaagctcatcccttctccaatggtgaactgacaccctctgaaagattcctctcaccggacatctaatgcaacattaattcagtgttctccttttctgtctctgagatttgcctttcttctaccaaagttaggctctttaaaaaaaatagctagggaagtttaaggaaaagtaaaagccacaggctactagggtctttgtgggtaaaattgtaaacatgatccttcagaggcccgtgactattataaccataaaaataatagtagctgccatctcttgagaatgtactgggttccaggtactttcataagtgctggatgtccattttctcatttaatcctctcagtaaccctggagacaggtattatttccacattttatgtatgatgaaactgaggctcgaagtatcccacagtgagtaaactataggagctgggacccttactgaggtttgaatgatgccaaagatgaaattttattaactacccatactctattactcaagcagttaaactccactccaatcctaaagttttctaatgagaatgaaccaattctgtgaaaaatgctcacaactgcagctctgagttctgcttttttccctcccaaagctatttcagaaatgactgagagatcccaggaagtacagggcaaggaacaagtaatgactgtattcttgttttggttggtccacttattggctgaggatggggccagctaaattacagaagaggtaaaacaatctgttagtaatggaatcctgggcacattacctgcccttttgagtttgtttctttatttcaatggatgtaaatgaaataatgtgtaatactgcttgcacatcctatgcctgttttcagactatgtgagcactgtggtttcttttactttcaagctggatattatgtaaataatctcttctttaggttcagttaacttatgttaaaaaaaatcagcattacccaaacttcctaaggactgaacagaaattccttcttacgtgggaaacgcctcagccttcagtcaatgagacacttattgtttcactgggaaagtgcctctctgttcaggaagggtttatgtaggtttcattgagatggagttggttgattgtgtgtactgcctttatttgtcctgatttttatcatgaacctcatgagcatagctttttcctcaaagaagtccatctctgggttaaccattctgactgaactgaatccagtgccacagtgttgttcttcctgttatgcatggttgatgtgacaaacctgctcattaccttgcacctgcccactgctttccatacaaaggtgtattcttcaggtcctgatttctctttgctgctgttatgactcctgttatgactattgttgaaaagcctttgctgtattctagccaccttagttctgctctgcataacttgcctcctgtgattggcaaactaccaggcatacttgtaagtatcattcaaccatccaactaagtggtaaacatcacgctaagcaataggagggaggctttagtgttcacatgctaaaagttagtctgagacctaggtcattgtccaccttaaccccagacactgaaatttcacactaggacctcctgggattgtttcaagaaggtaaaaatcaatacttgtcttcctgtcttctgctttcatcccattctgccttctcacccaaacctccagggaggctgtggtccttgtattagaagggaccacacctaaaagactccacttttccttagtggtgaatatgtgtcagtttagaatttgagattattttggataataagtgtcagaaaaaagccttatctcagagcttgcggtctctatccttcctttaaggaagctgaattccctttgttctatttcaatcatttcagagtaaatatgactacgcttcagtttatagagatgcagctctaactaaactatgtagggcagttatgatcacaatcgtgccaagaatcttaatttggttttcagttctgtaactacttttctcattttcctggcagccctatttcatagccctgcatttacattatcgtttggcagattggatgccactaaaaatgggggtacaggaagataaacatgttcgtgggtaaagatgagtttgtttggggatggtaggagcctgcaacaagggagtgatctatccagagaagagatgatggtctatactagggtgatgatagtcaagatgaagataaggggactaagaagaatttaaaaactaatattggtagggtttattggtcaattgaatatagaggtgagggagagggaggagttggaggatgatagctgggtttagattagaatacctcattcctgctcctgagtttagctgataagctgcctatgctttagtggtcagggattcattttaagtgggtctggggacattaattttttgattgatcataccatatagagtgcctccagaactaaagatagctaattataagaaatgtgaatcagggataatttagcacattttcagtgaaatgataaggcttttccattcttggggaattcgatttattttgtagatatacagaaaggctctatatattgtaactgagaacatttctcaattaggttttcataagaaataattttagtgctcccttaagatgagagggcctttaaacttaattgtgaacttaatttatctgaaggtataaactcagaagatggcacaattgtagtgttgactaaacaggatttagggagtattaaacatacaatacctcgttgaggacagtgctttgaagacaattctatatatcagatctgtactaagtatattttctccaaatagtcctgtttttccaactatttttaatgtttataatatgatagagttttgtttatgctacttctttgatataacagctaaacataatttagccagtttattttattattattattatattttggagacagggtctcactttgtcacccaggctggtgtgcagtggtgtgatcatagcttactgcagcctcaaactcctgggttcaagggatcctcccacatatctagaactacaggtgctggccaccatgcccagattttttaatttttttcccccagagatgggagtctcgctgtgatacccaggctggtcttttttttttttttttttttttgatatggagtctcgctctgtcacccaggctggagtgcagtggcgtgatctcagctcactgcaagctctgcctcccgggttcatgccattctcctgcctcagcctcccaagtaactgggactacaggcgcccaccaccacacccggctaattttttttttttgtatttttagtagagacagggtttcaccgtgttagccaggatggtctcgatctcctgacctcataatctgcctgcctcagcctcccaaagagctgggattacaggcatgagccaccatgcccagcctactcaggctggtcttcaactcctggcctcaagtaaccctcccgcattggcctcccaaagtgctgggattatgaacatgagccaccgtgcctggctgagccagtttattctttttttttttttttctgcttagaatcaacggcaataattagattcacatggaaataacatctataattagccgagcgtggtggtgtgcacctgtagtcccagctactcagctactcaggaggctgaggcacgagaatcgcttgaacccaggaggtggaggttgcagtgagccgagattgcaccactgcactttagcctgggtgacagagtgagactctgtctcaaaaaaaaaagaagtgggaaataacatctataaaaaaattgggaaataacatctataattaactataatttagatctcttgttagtattagattgctttttcttgtgttattgtcaacttgtttggtttctgttggaactgggggaaagaggaagaatcttacctgcatagtatgtggaggaggcctatctgaaaaaatgatcaattttgcaattatcctcaaattcgtataaatcatgcagagtctaactaaaggatgggaataggaagcaaaacaaagtatctgtaagaggaccagagggattagaactatcaagtgataaatactactaggtggatgaaaatagtagcaaatcaggttacataaaagctttcttttcattggatttatttctcaatgcatttatttatacattctacttgctttaactctgtggtatcttagagatataagagataccgaaacagttggttttgccccaacttgtggagagtaaatatgaacattttagggccatgggcactatagatgattactaagttagataatacaagattactcctgtagctgatgacatttaagtaatgatagtgccctttcaaaattcaaaattcttttttctttattatttatttatttttagtactttcccactttgtttttttttttttttttttttgagacagtcttgctctatcacccaggctgaaacaaaacaaaacaaaaaacagaaaaaagaacagactacaggcatgcaccactacgcctggctaatttttgtatttttagtagagatggggtgtcaccattttggccaggctggtcttgaattcctgaccttgggtgatccacttgccttagcctcccaaagtgccaagattacaggcatgagccaccatgcccgggttcctacttctgtttaatgtgccctttataatatgctaagagcactttttaaaggatattatggacaggattcagactttgaattaagatagatggtgaattttgaaattctgagtgaccggaagactatcttctgttaatattgcaactaaatcgagcacttttcacatcagagcttagagccaaggcatgaaaatagcctcttcctttttaagttttttcccctcaccattctgaaatcagaaagccattaattaataaaattcccttacaattttgacattacaaggaaatgatttgaatcataaagctattcccaagtaccattaactcactcttagtaacagttcttcttctagatcagcactgtccaagagaaacagaacgtgacacacatatataatttgaaatttcctaggctaggcacagtggctcatgcctgtaatttcagcactttggcaggccaaggcgggaagatcacttgagcccaaggagtttgagaccatcctgggcaacacagtgagacctcatctcttaaaaaaaatacaaataaattagctggtgtcacatgcctgtggtcccagctactcaggaggtggaaggtgggaggaccaccggagcccaggaggttgaggctgcagtaagcctgtgatctccaccactacactccagcctgggtgacagagcaagaccctgtctcaaaaaaaaaaaaaaaaaaaattctaacaggcacaagaaaaattaaaaagaaacatgaaatttgttttaataatttttaacccaaatatccaaaataccatgtaaacatataatcaatattttagtatataatcaatattttaaattaatatattttatatattttttctccctttgtactacatcttcaaaatctgttatgtattaaacacttgtaagtgtttaatacacttacacatctcagtacagactagcacatctcagtacagactagatgtacacatctcagtacagactagccacatttcaagtgctaagtagtcacatgtggctagtaggtttcatatttaatagtacagttctagatgaaattttaaatatttgtataagccattctgagacaaacaggtttgcccatttcctgtaatagtcattctatgagaaaaggtatgatttagtgctcttatattatgtttacttttattagtttggaccatatgaaatttcaaaatggttgaataccagcaatttcatatggttcaaactattctattatagctgaatatacttgttttccttgaagaagaaatttttcttcaagaagcaattactgcttaggtcttgaatttttacctcagatgtcacaaaccagcatttataaaaagtctattattcattgtaatctgactgtatacatgacctggaagttgtaaagatgatagatggggcagggatgatgtgggcattgcccgtctccttcctttcctcgttatcatgcttcatgtgacgtgtcaattcacagtcaaaaaacctcctgttatttgctttatttcatcttcctatcttgtacagagggttttcttcttccctgactgagagaatacattatgaggttagttgtaaattatttggtctggtacttgcagaaatggaagaagcgctgatactggtactgataaaagaggaatcaggtttcattagaggcaaactgctgtaaaaggagcactctgtgaatgaagctgattgcaagtggcagtaaatgtcagtgggacatttgcctttctcccttaatgttgggagaggtggagattgaccagcataggtaccttagacatgcagctgttgaaagtcttcatgttcaccagccaaattacaattttatttctgaattttatgtaatgaatagactgttatcaaaactaatgtactaacattcctgtttgtttaattaatactttaaaagttaactatgaataatagaaaaatatattaatagaaaaaattttttaagttatatgtgttatttgtaggagagaagtatggctacctttcacttccaaagccaatggtaagtagaagaattatgtacattgcagaatgtttttattcagaattcaaattatgctcttgttgcctgttgctgctcccctctaccacaaataattgacatgacagaaaaaagttaggatattaatgttgacttcagagttgttattctgggtagcaatctagttgtggcttacactctgaatatttgttttaggtttgggggtttgagagaataggtaacataatttgtgattaataaaaagccatatcccagtaatagcatcataaaaataaataaataagccatatctgaagtcagaagttgttttgttcttccaatcttggatctactttgagaagtcatgttggaatcactttcagcaaactaaggactttcatatgctttctacctagatgaaaacatgtcacatgtcatacttatgggaaagagatacagagtggtatattaaccaagtagtggtcccaagatcccttttgggggacaaaaatattggaaattgtgggctgggcacggtgtcttatgcctgtaatcccagcactttgggaggccgaggcgggtggattacctgaggtcaagagtttgagaccagcctggccaacatggtgaaaccgtgtctctactaaaaatacaaaaacaaaacaacaacaacaaaaaaaattagccaggcgtggtggcagaggcctgtaatcccagctactcgggagggtgagtcaggagaattgcttgagcctgggagatggaggttgcagtgagccaagatcgtgccactgcactccagcctggccaacagagtaagactgtctcaaaaaaaaaaaaaataaaattactgatgattatcaatagtaacagtgtggtgaagaacaacagatggtgagtatcagaagagagaacttgcaatgaagagagatattaaagtcttaagtctggaattttagaaatgatagtgggaatgcttgatggtgtaggggaagaacaaatgataaatcaaatccccaaatcaaaaaatggtccaaacttaattagtgtactttttgaaaagggactggcatttaatactgaaatacaacattaggaactgaatgtagctggtgtaaaagcgatcatgatactgcaaattaattctgtgacttaaaaaaaacagtttttgtgccttaagctattgtcagaacagtttgaaagtacaaatagcaatttgtctatttttgttattttaagataaccctaacagatggttttatagctaatatcctactgggtttaagcaagtaaggatagactcactgtttttgtaagtgctataatttagggctactacaaaataattttttgagaattagaaaaggcatcacaaagcttttaacaggttgaatggaacaaagattttattcaactgaatagtattttttatctttagtaacaaatcatttcagagtcatgaaccattttcttagttgagggatagcatagctaattatattcctagaaaattatagttctctcttttaggaagtgaagttggagtctggtgctatttatatttaggggactgacgtcttttagctttatataactgaaacgaatgaatctgactgcattccaaaatagtgtccactagatggcaagcttggttacattattaagatggtttatttaccttttcaggcaattccatttcagtcgtcattaaactttaataatcatcatcattagtaaaagtaaaaataaaaatcatgaaaatgcaactatatttaaaagaataatataaagtataaaattctgaataaaactaaacctaaaaaccttgagggtgttccttactttcttaaatgttttatcagttgccttatagtcaactagaccaaggatggagataaagatgatgtgaccattcaaggaggagccagagagatcattggtcatatttgtttattctctctctctctgtctttgtctctttctctctgtgtgtgtgcatgtgtgtgtaacaagagttcctttatttttattttctgtccttcaacttcacctgtttctttaatagtaaacatcattagaaaatctcaaaagggctatgttccatgagcagatctaaactccacgaggctgttttgttctgtggtgaaactggtgacagaatagttggtcagaagtaaaaagtcatggtaataagggaaataaaaatatatgtatgagaagatctttttccttaaagtattagtgatgattttccttcctaagctaagtgtacacatgagtgttttgttttattgtaatttatactgtgtgtgcaggtatgtgaatccatacccaatgtgtgtttgtgagtgtgtatgacttaaatatatgtttccattgtaaaaagttggcccccttttctctacaaaccctagctgttctgggactcctgcctctaccatgggagctttcaccagatctcagagttggaggaatcccctctgtgggctatcatctccagagaacttcggaatatatttttcaaagaaatgttgctattggtggtggtgtgatttgtcctggtactctattcttcaagtatacaggcatcagtggactagcctggtctaactaggatggaatattttctccccttctagggaaaatacactctgagttccagatagtttacatgaaaacaaactttctctttcaaaaatagggaaccattgaacattggttcacatattaaattcagaatcctaagtataatctctttataacttgggatatgagattagcagttgtgatatctatgaagctagagagttgaaatttagccttccaagagcaaattagttaaaggaattgaattctggagtcataacataaggaatgtatagaaaactacatatagtggctaattttaatatatcatttcataagaataattcaagcattataagaatcttgttgaacagagaagccagggaggtttgggggacataataattggactccaggaatactgcagaagttgtcttgagtccctggaagcccttgtgaaaagaggagagcagctgtaagcacagaggccacagagcagggaaggcactgacttgctttctctggctccagatttcaaactaacaacctattcaaagctgaactcacttactagtagagtacttgcaattggtaaaatattcagtcattacatactgaatattttaaacttttgttacaagtactttgttatgctttgtattactattgtatttccttacagtttaatgtactgctttttaagataatcttaatctttttattgtcacagaagaataatgcaaacctgaaatcattaaagccagacaagcctgactctgaggtaagaccaattcctacatctaatcttcctttaacatgaatagtgataaagtcgttgtgattaaaacgtctgtttcataggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactaggtaaatgtagttgtatttttattttttaaatcagtataatgatatctggtgtaaagaaaaaagttccatgttaaatcattgacaggttaaagtcggtatcaaatatatggtaaaaagactaaaagtagttactatgacaatttacgtaagtgaatgcaacaacaagacacatgtatttaattaggatttagatttagaagggatcttctgctaggtttctgcccactctttccatcattgaaataattttacatcctgcttttttgttatcctgcattgttaatgcctctcccagccagcatcagtacgttaagaaaacatgtcttttatgcctttatacagtgattgactagatacagatgaagattgattagacacagatcaaagaatagagctatgaggactatgtcaatagcgtgccaaatctctgtgagtcaccattcattatgtagagaattcccctaactttaatgttatctgacctatattctctgtcttgatcatattacaagactcttgatcaaatgccttgttgatgtcaatgttagtcatatttcagtcttccattttagtaatttatacataaggtatagtaattctgcttagttaaaatcagttatctgctcaaaaatcccttctagaattttctcaaggaataacttcaagcttttcactcagtttctgaaatctatctttttcatttttggaaacctgggaaatacttgatatctccagttttctggctcctgtcctactcattctgattttggaaaggttatccaccgtgggacacacctgcaggttgcttcagtattctagagactgaagctcaattaaagtagtgaaggatctctacaactgtgtgggatttgggactcaataaatagcaccccctgccgggcatggtggctcacgcctgtaatcccagcactttgggaggccgaggtgggcggatcacgaggtcaggagatcgagaccatcctggttaacacactgaaacccggtgtctacttaaaaaaaaaaaaaaaaagttagccgggcgtggtggcgggcgcctgtaatcccagctactcgggaggctgaggcaggagaatggcgtgaaaccgggaggtggagcttggagtgagctgagatcgcgccacttgcactccagcctgggtgacagggtgagactccatctcaaaaataaataaataaataaatagcaccccctattcccacccaagttttgaacaaaatgaaaaataagcaaaagaataggtagatgggagctggtaacatttatattgataaagctgatattggagaaagtactttatgtccataggcaattaagttttgaaaaatgatccctagaattacaaagtcttacctcatagggacacaatgtatctctataaaacacatggaagaccagttatatctcaaaggcagcttcacttccaagagaaaaaggagaaaagaaagggttaatgtgttcaatttatttttgcaaagtcaccagaaagactgaaaagatgagcatccacctccttttatgggatgggataggtgaggcagcagacagaagtgagggatcctgtgctcgtgaagattccttcctatagaaggaggattaagagtggggaagatgcagtcccaagcttagaggcatcattttcctcttgatgacgtcttctaccttttctagatagataattctctggaaaaagaaggcagaaatgataggagttagaaattttgctgctgtttagctgtcatttgtcagtaccttatcatattttccatcattggagaccattcctttggtggtttccttccattgttcttaactgttgttagcaagcttatcctgtgattgagtcttcccaacatgaattttgacctttttaagttcatacctttttaaaatctgatggcccaggcctctaaaagaatgcaaaatggaactcctgtgtttacccacaataaatttgcacagactaactgaaataacaaaaatctcagcttttggctggaatcaagctagttatttccatggtgatgaaaatcatgcttttaaaaaatgtttttgactaataagacttgggggaatatattattaatgaatatagtttgatatgtaaaatattcccaaatgaagggttcatcaatagacttgcctggtttttttttttttttttttgagatgtagccttgctctgtcacccaggctggagtgcagtggcatgatctcggctcactgcaacctccgcctcctgagttcaagcaattctcatgccttagcctcccgagtagctgggattacaggcacacatcatgacgcctggctaatttttgtatttctttattttttattttttttgagacggagtcttgctctgtcacccaggctggagtgcagtggtgcaatctcggctcactgcaatttccatctcccgggttcaggtgattctcctgcctcagcctcccaagtagctgggattacagttgtgtgccaccacgcccggctaatttttgtagttttagtagagatgggatttcaccattttggccaggctggtctcaaattcctgacttcaagtgatctgcccgcctcagcctcccaaagtgctgggattacaggcgttagccaccacacctggcctaatttttgtatttttagtagagatagcgtttcgctgtgttagccaggatggtctcaaactcctgacctcaagtgatctgcccaccttggcctcccaaagtgctgggattacagacatgagccaccgcgcttggccaactttttaaaaaaagattatagcatctcctttgattagttttatttcagaatatttcaggatggcatgctcagtattttttgtttcagtgtcagaattgtagagtatcccatggacactgggaaacatgaggggttgcactacgaggggaagctctgtggaataggacttcttcctagaatatagttattggatagtagtgatgacattccagaatagaaaatggatttttctgtaatagataaataccttgtagcagttttcctgggcagatttatagcccttcttcaggttactgtttaaggttgtcttaataatttatatgatttcttaatgatttacatgtaatcattcatatttcttaataatttagatatttaaggttttctagtgccttatagtttttcaatatttcaaacatactagtaccttattgtttttaatgtggtttttgcttcatcatttcatttgattttcatgacggtttactggagaacaggaatgatatgttcacatctcctaagtggcagaactggttgctactagattccagattttctgacttatccctagtccattgctcttcttaatgcatttggttattcttattgtaatttacttttcattttttagagttcttaattcttcttggtagtttttaatctgctgttcctcaatcttctgatgagagtggtagcacaagtattattatgattgctttattcactcaaaatagaatgttcagtgatatgcctcatcaaggttagataactgagttactaccagaattgaaataagaattagaagtgaaatgtcctgagttttggtttgatcctctttccattacgtaacaaaggctttcggtcaagacattatcaaatctcacatatttaatttatgaagtaaaatgaaaaaggttaaaaagagaaatggaacttaaatattacttgtttaaaattttttatattatgaaattaacataaggtttacttggggaaaaatatcttaataaataattgtcaaatattaaagttgctttaagcataaagttacaatattatcagtctattcatattattcttcaaaatttaggatttgttaatacacaaatgctctaaaattttaatattataaagtcaattttcaggtaataactttttgttaccttcttaacaattaattttattttagaggagaggggccactgaaaacttcccaggatttaattcatcaactagaggtatgccttgtttccgttttatgctagtactttaatttcgggctaaaagtgggtaataaatgttttccagatgatttattatatcatgtgtatatgcttacatctgtacctacctgtgtattacagagagcagtagaaaagtagaaaggtagatggcttgcaatgacattttgcaaaactatcctgacctcattggaaagaaacttaaatattatgagcataaagtagaatgggctttgttggtagtcaatagatgcaataataagctttaggtttacctaagtaggtgaaaatatcctgtaagcagatgcaaatccagagttctagaaagatttttggcctcttcattattgaattggataaaatatattgattaaatgagataacacatgagagagtatctgttaaaatgcttaagactattagagggtattaagtacatcttagtttccttctttccttcagtattcatgatgatttagggcattaaaggagagacagatatgctaacatccactcttgtgccatgtgtcttaacaggactccacataggcccatctgtaattctactccctctagttagaggctttagattggcaagtgggttgcaaaattccttttatgttttccctgatccccatgttagcctgtttgcctctctagaaccaagagcattcttgtgtgtaaatttgaaatttctgtcactttatcactcatatagtctcctttggcattcccatgtacatctgagatttgaaatttctatcactttaggccaggcgcggtggctcacgcctgtaatcccagcactttgggaggccaaggtgggtggatcacgaggtcaggagatcgagaccatcttggctaacacggtggaaccctgtctccactaaaaatacacaaaattcgctgggtgtggtggcgggcacctgtagtcccagctacttgggaggctgaggcaggagagtggcgtgaacccgggaggcggagcttgcagtgagctgagatcacgccactgcactccagtctgggtgacagagcaagactccatctcaaaaaaaaaaaaaaaagaaagaaatttctatcactttatcactcatatagttttatttggcattctgtgggaaagggatttcagcttaagaggatgattgtcaacataatcagaagtattatagaaaatgtgtcttctggatttttctgtaaagcagactataaatgagctatttcccttaagatagttgaaattctgaatttattttttttttcagtttggcccaagtccattctgtcataccgccctgtaggggtgttttactacaaaagatccactacttaccttcttcctatgtgagcttagtcattaaatcaatgttcaatgaattgtctccaaactgtgatgaacataaaattgcatacttcattcaacaaatatttattgaacttgtgctatatgtcagatctgggagaacagagctctgtggagaaaagtgaacaaagcaaagctcctgcccccatagagcttatgttctaatggcagaatatagacaataagaatttaagcattcagtgcacatatgtaagtacttggagataaaatcacgtacgactagaatacagaggtgatagaggggtggtcagaaaagacctctctaaggagccagtgtttgaatagagacagtaatgaagtgagagttggatggataaatgtgggtagaggattttagatagccaaaacaagtgcaaagccccgaggtgcaggggtagggctgggtgtatcagaagagtaaggaggcaattattgatgggagtgaagtgagccagaaggaaaggggtaaaatatgatgtctctgtaggccatgggaaggacttttttttttttttttttgagacttagtctcgctctgttgtcaggctggagtgcagtggcacgatctcggctcactacagcctccgcctcccgggttcaagtgattcttctgcctcagcctcccgagtagctgggactacaggtgtgcgctaccacgcccagctaatttttgtatttttagtagagacagggtttcaccatgttggccaggatggtctcgatctcttgaccttgtgattcgcccgcctcagcctcccaaagtgctgggattacaggcctgagccactatgcccagctgatcctattatgttttaagtaaggtttttggcttggccaacagagtgagtggtagtgccattttctgagacagggaacactgagggagaacactagatttagagggtggaaatcgagcattttgttttgcacatgttaagtacaaaggtcagataggatatacacttggccctccctatctgcaggttttgcatctgcagattcaaccaactatggattgaaaatattcaaaacagtaaaaacagtctgggcacaatggctcactcctgtaaccctagcactttgggagaccaagctgggaggatcacttgagtccaggagtttgagaccagctggggcaacatagtgagaccttgtctctacaaaaaaacaaaacaaaaaaaaaaaaaactagcggggcatggtggcacacacctgtaatcctagctactcaggcagctgaggcaggaggatcgcttgagcctgggaggtcaaggctgtagtgagctgtgatcacaccacttcacttcactctggacaacagagtgagaccctgtctcaaaaaaaaaaaaaaaaggaagaaaaccaataaaatataacaacagtaaaaaaaaacaaaatacattttaaaaggttagagttccaagggagggaaaacaatacagtataactgcgatttacttagcatttacattaacttagatattataatttagagatgagatgatttaaagtttatgggatgatgtgtgtaggttatatgcaaatactacactgttttatttaagggacttaagcatctacagattttggtatccttggggaggtctgggaaccaatctcccatggatactgagggatgactgtacaagactgatgtcaggatagttcaggagtggagagagagacctgggagttaccagctttcaggtagttttaaaaccatcatactgtatgagacagacatggattttgtccccaaggggtttgcaggctagaaggaaagagaaaatttgcagaatagaaagtggtaacatgaagtgataaggaacacttggggaagtgaatcatttcatttggttggagtctagatgtaaagcttactggtttcccttttaaagggaaggttgcaaagtacgatttgaccttgagatcattttatccagtgatagcaaggtgttaagccttttgaatagagggtaaaaattaaccctggaattattgcctcctccttcttagtattctttaatttattatgaagacctattattttcattcacaaaccactctcagattttccctgttctctccattattactgacgccacctaaaactaagccttcctccctttactcccctggcatctcactctaaaatagtctgcaaaccattttaacataatatgctaaatacttctgtcttacctgtacaaccttctttttcactctacttctccatcatcctgttcatctcattaaattatagaattcatggtacatggtgaatagtgaaaattaatctgaaaaaaagtggcaacaaaaaccaaccacctggattggttctctcaaatgtctggttatggaatatgtatgggtgacaaattttgtcttgcctagatggaattgggaaggtcctaacccttttgacctcatgcttgaaaattcatcatccttttataattgagcatatttgagatgagctctaggtcccttgcgtaatctagacataatttgtgtggctgaatatcacaggtctgtgtgaccctccagaataattggaggtctggtgtagagaagcctctccagggatggattctgcatctggtctgtggaaactccttctgaaaacagttaaacccttgtgcattcctggtactggaaaaagtttaggagttcctgacagactttttatatctaggctttatttttaaaattctacgtaaaaattattagtaagtatatttcttaccaactatccatagacatcagtctaaaatagtggtgttttctctttctaccaggtttttgctgcagagggtttaaagcttacttccagtgttcaagctttttcaaaacaggtaacacatgtctacctacctggagctggtggtggtattatgtataacctactttgggggtataatatcaatgtataaatgtgtttaaggtattaaagatggagttttgttgcgggctgttataacttgttaaattacatttcagctgaaagacgatgacaagcttatgcttctcctggaaataaacaagctaattcctctatgccaccagctccagacagtaactaagacttctttgcagaataaagtatttctaaaggtaaaagagacatatgaaaaactttcacacatctatctttatctggttaaagcccctttttcttcaaataaactgttagtacccacagaagggcaatttatttccttttttcatgccttgtctacaagaatcatttattatctactctcataactgaccccagagagtagcagattcaccaaataaagtagttttttggacatcattaattccatagcactgaacagctgcccttcaattctgaagtcattacctctgcaactaggacacaggtgcctccgagtctggtctcccataatttgtctgagagaatatgggtttgtgcccacaaaatagagtgcaaggaattgcaaaggatgggatttaattccactatttggagtgttttgagaagcccctaaacagcctgcagtagaatgattaattttccacccactctttctgctggggttccatgagatagacatgaaatctaggcagctacccctgcacctgtgtcctggggctttgagtcagctcatgtgcctaaatccatatctctttcaagatcccttagatttccatatggagaaattttatcatgttaaaactaaataaatggtaaggtcttttaagtactacttttagaatatcatttgcatgctttttgtcattgtaggttgacaagtgtattacgaagacaagatccatgatggctctcttagtccaacttctttcactttgttataaactgctgaagaaggtgaggtagtttttctattttagactcatactttaaaaaatggtttaaaagaaaatagttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattctaattgtagtgtgatttttaaaatagaacattgcactaatgttctttaaaagtcaaaccaaatatcccaactgtctcaaggacaatttaatccacaagaagctattttgaatatgtgcttagctttggcatattttaccttaactgttttctttatcatctagatcactaatgtcagcagcaaacatacagtagtctgggtgaatgcagggttttccttaaacctgtggactcttcaatccctctgtttaccaagtgtgacaaaaatccccttgatgaccctgtcccagattgtccatgccagcagcaagtttgttccctaataagcattttgtacagcaagggtgggtctgctgtgctgtgtatgtccctcacctactcccaaaagtaaggtaatggaactccacagaatcctggaacaactcctggagagtatgagatgggtttttggttctagttctagcatagctggccagtctgccctgaatattagctgggattctaagcctatcttatagacttaaaagatattttgaactttctcagtattgattgatggaatggaagacaaagacagaataaggaagccaagaatctatttaaattctgaatatcacacatttgaaatgttcactataaaacaaaacaaaaaacatctttctttagtctttttaatttaggagtttaaagcttttcttgtttttgtgggtggggtcatgattgaaggatctggtttataggttttctccttataatatagtatggccaactttgtgttagacttcagtcgtagtatttgtatcttaatgctttgacattcattttgaaatctaacagggtatgtcagttatcaaatggcagtagataatataagcttatctgatgatctttatctgggtcagccaccacaatcagtattcacaaaagatccggaagaaccacagtaatgccaattgaccacagctagtcaatattttattgaggaaaattttcactgtagtccttcgggagaaaatgtgatgcactcagctctgttaataacctttttaaaatctttccttaaacagtcaaaatcattaagcatgatttttattctctgaaaccaaagtactcttttaaattacaatagaaataatgggagaatgatgtgaggtaatgttacatgtaaaatgttatacacaattcttttactacgtttactgtcatagttttatgacgccttcaagagtcattgtgctacttaaagtgaggatctgctggtttgtttatattttcagctaatagcaccatcatggaggtgtttatccacttactacatgtatcatgtctggggggtatatttagggggatagtcatgctggcactcagattacaagtttttcctatgaaccaaaatgttgttttatttacaaaataagtaagtattattttgtaaataattaaaacttaaaaattccaacccccacttgtactttcattagataatatttttgcatacctgaaaaaatactgttctctagtgaaagaaagagcaagtgggggttgggaaggggtaacttatgacttcaacagcataagaggatagataaccaatggaattaatacatcgaatgatttcttctgtataaaagtatattttatttaaaaacagtgatattgacatgtatgttatagcccttacagaaaaataacacgttttatagtccttttatttgaaattcagtgtaaatcactcttaaactataaattcacagttgttggaggtttttttttactttaaatgatgtgaaagcatttgttccattcaaaggcccctatgcctttgaatgacatattctcagtaacttctttgccagtaactagagtatgtgagactgagtaactataatgtgcatatttcaagaattagcttcc

SEQ ID NO: 15546 - DNA, 187595 bp, Human
  misc_feature (1)...(187595): n = A,T,C or G
actgagatcggttagcacttaaatccctttcaaagccccggctcccatcgcccctcctatggcctcctacctgcagagaagcaaagcaggtacacccagtgccttaggcgggccaagcctagcactgtgggagcaaaaaacatggcttcatcgtcagggtgcgctatgaccagcagggtccggctttcggctcccagccgtcctccctgctcccgactcttcattcgttctgaggagtcccaaacccagaggaagccccatgccaagaccgccaacgccacacacaggagccacattgcttccatgatgggtaagcagcactgagcctgcgcagtaggaaaggctgcctctgaccctgactccggctggaaaacttcaccggggaatgttgggttccgctgttaagtccctcccgccgacatgctccggaagcttgaggttttaacgttaagggttctcttgtgttttaacacagaagtctccatgccgtccagtttcctaccctagtcctaccacactgtacaatcggtttaaaaggaagcgtcttatatataagctcccacttataggaagagttccttcctcttcattttcgaattcatttcttaaaactcgggcctttctcgtaattatagggttagacagcccgttatccgtatgacagttttccaaaatagccagttacaccaactttgttattccttctcacttttggatggctttctttacctttttttttttttttgagaggctctgtcgcccaggctggagtgcagtggagcgatctcggctcactgcaacctctgtctcccgggttcaagcgactcttctgcctcagcctcccgagtagctgggactataggcgcgcgccaccacgcccagctaatttttgtatttttagtagagagggggtttcaccatgttaactaggctggtctcgaactcctgacttcgtgatccgctcgcctcggcctcccaaagtgctgggattacaggcctgagccaccgcgcccggccctttcttttttttttttgaaacggtctggctccgtcgcccaggctggagtgcagtggcgcgacctaggttcgctgctacctcagcctcccgcgttcaagcaattctcccacttcggtctccccagtagctgggattactggcgcgcgccaccacgcccgcttaatttttgtatttttagtagtgacggggtttctccatgttcgtcaggctggtctcgaactcctgaccttaagtgatggcccgcctcggcctccctaagtgctgggattacaagcgtgacccactgcgtccggtcgggcctggcttttctaaaggaacgtatgcgtgcggttacgaggaaccgtcgtttccccagcagggtgaggctgagcgtgcacttaacagtcgcgagggccacaggctcctcttgcaagtaacttaaggttaaggagcaacatcgtggacaaatcggcctcgcccagcatttcagtgagggcttggtgcgaattccagccagagccctagaaagtatcttgggcaggtcgaaatgcacccctccagctcccagccacgaggggaccggcttccctgtacgcagctccggccagaggaggccgccgccgccccaccacgccgcggaggggtttgcagggtcccttccacggcctggagtttttccttttcccacgcctgaggaaggcctcgggcgcgcggaacagacgggcaggcggggggcgcacaagcccagggcacgatggcagcagcgctggatccggctgggcgctgctcggccctgtatccgtccgagaggaccgccgctgccaggcctagaggagacatgaagagaccgggcgcagcgcgacccgggaagctccgccgaggtaggagaggcgcccggccagcggagggagttggtctcccaactctccggaaggaggaggagccggcgctggagccgccttagccgcggctccgcgggctggggggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtgagtaggccctggcgcctgcaaccccggcctccgggctcctgctagtccgggggcttccgagggctcccggggcagcagccgctgggacggtttctccgccgggcggggggtgtcgcaggcctgggcaggtcgggacccgtcctggccgcctggcctcttccactcggcagcccaggagagagccgggcgcggcggggagctcgggctgggctagcggaggcttatggagtttggaggaagaatgggctgtggccgggccggggctggccccgaggtgtcctgtgcggaggggcgtgcggagcctacagggcctgcgagggagagcgggcagccggtgccccgggtggggccggcgcaggtggcgggcctgggctcactgaggcggagttggtggccgacttggaagtgtagaaggggctgcggaggttgacagccatggacaagtgcgtgcagagtaaattagttcacctttctaacagaccgcttcagggtgtaatggcgaaggctgggtactggtggagatggcaaagatccgaacactataccttctgccgtttattgttggtgttttcttaagcgaagtccgtaagtgcacccctttttggggagagaggaatttgagaaactgtagttgtgaaatcagcctttatggagaggagactgaattcttcaaattaactggatcaggaatagtcatgtattaaaggaatggatgggaataagtgatatggacgaaaactatttgctcaggaagtgtcagttttctttatgtgatgttgcatgctgcggtgcctcttccacagagttaaccttggagagtagtagtataggtaattctaatctttgggattagtatgtaaacctgcatcagatttgcttctctaattatatcctaattatattgaaatttacattccttgtgtgcaccctggtgaggcagtgatggaaggctgaacatggcactgtgcaaggagcaacaggcccgggatttaaaaatgcctacaaagattcattcattcgttcaatatatcttgatcaatagctgctgatgctgggtcacatgtgattgtcctgtggataactgaagagttgatggcatcgtttaatttttaatagctttttaaaatgttttgatgtaccttttcatgaagatatttattggatgaaccaacttgtacttgcccgggctcaggagcagaccaattttagaatgttatttagacaagggtaacaattacagaagaagtaaccgcaagttactggagagagaaatcttgtatctttttttctttttctgttaacatccggtggaattttatttatttgttttaatatttatagtacccagttgcttggccttgctttaagcacacctgttaatggaaatcaagattaattgtatatatggatatagctatgtataaaatgctcacagtaggaactgattacttacaatactaaaatactctttccttttacaaaaggcttgccatatgttgaactactcccccggagaaaatataatacaaagtatcttgattcttgctctaactatgtgattttggaacttgatcaacctttctgtgcttcagtttcctcatcttgaatattaggtaaacatctactctcctagggttggctgttgtgagcctaaagggagttaatagttataaaattgttttaaacagattgaaggggttatatttctgtgaggtggtaacagctccctctgggctcctgtaatgctttttctgcacatctctcgcggcatttacactttctatcttgtaggtatttatgtacctattttatctcttgagagcaggataggcccttcgctgattttatcttttttttttttttttttttgagacagtcttgctctgtcacccaggctggagtgcagtggcgcaatctcagctcattgcaacctccgcctccgggttcaagcaattcttctgcctcagcctcccgagtagctgggactacaggcgcgtgccaccatgcctggctaatttttttgtactttgagtagagacggggtttcaccgtgttagccaggatggtctcaatctcctgacctcgtgatccgcctgccttggcctcccaaagtgctgggattacaggcgtgagccaccgtgcctggcttatttttaattgaatacttgttggatttaaaaaacagtaaaatttgtgttttgcctatcctcttaatcaaaaaagaatgaaatgatggaaattaacttataggaaagattagattagttaataacttttttaaagctttttttttttttttttggagacagggtctcttttgcccaggctgaaatacagtggctcgctgcagccttgacctctggactcaggtgatccttccacctcagcctcccaagtcgctgggactacaggcacaggccaccacgcctggttaatttttttttttgtttgtagagaaagggtttgaccatgttgtctaggctggtctcgagctcctgggctcaagcgatctgcctgtctcagcctcccaaagtgctaggatgataggggtgagccactgcacccggccttaaaagcattaaaaaaaattgtgttatgaattggtgaaattttcttttcttacctttgttatctgctgtagaaggcaaaggcctttggatagactgggggttgatgtaggtgagtgtcaggctgtttgttttttaaaaaatatgttttggttatttggttttaattgtattctgtgatctatcttagttgtaatttcaaattcttcttgatgcctgggaatgatggaactcttgcatatttagttccatctgttcttttacttaagatactggattttactagactatgatataaaacaactagtaaagattgatcagaatttattgtgtatagtcttatttgtagattagagattcatatatttttgtttactcacttatattcaaccagtatgaggtgctttttatgttctggcacactactaaatactagaaagttataaaatatagtcgagcagatcagttatattcacaaataactcagtctatagattatcttttttttttctttttttttcctttgagacagggtctcgctcttgtcacccaggctggagggcagtggcgtgatctcaggctcactgcaacttcagcttcccaggttcaagtgattctcctgcctcagcctcctgagtagctgggattacaggcatgcgccaccatgcctggctaatttttgtatttttagtagagacgtgttggtcaggctggtcttgaactcctgacctcatgatctacccgccttggcctcccaaagtgctgggattacaggtgtgagccactgtgcccggccctatagattatcttatatttggtccttttcaggtttgaggatgcaaaaaatacatgtatacatgtaaatggttaagaaaacattttgtttctttttctattagcactttttaagagcactggaaaactatgaaaagcttctgtaatgtagtaataaccgtatgtggagcatctgttttttattttggttttcttgtggtggcatttttccttgaacacttatactgttcttctaccatttttttcctaccccagtagcttgtgtggtcaaaatattactagaatagtcttcagatacaacctattttttttttctttgcatttgaaagtctgagactgtatgaaacactgcgaatgttcctatggagttcttcagacagtttgcttcttccgtatgtcctgctgttacttttatttaacagcgatctcaaaaacaacaaaattggttaaaataaaatgttaatggcagggcacagtggctcatgcctataatcctagtactttgggaggctgaggtgataggaccacttgaggccaggagtttgagaccaacctgcacaacagagcgagtcccatctctacaaaaaaattgaaaaattagcagagtgtgcttgtggtcccagctacttgggaagctgagcctgggaggttgaggttgcagtgagccatgatcatgccagtgcactcacttcagactgggtgacagagcaagactgtctctcaaaaaaaaaaataaataaaaataaaataaaaatagctaatttatagaatgtagagtcagattatctagtcttgttttactttcgataacactgaaggtcggagaagtgaagtgatttacctgcctaagttgctaaagttgggcaatagcagaatctaagtcttttcgtatctattatagtgttcactgtgttacactgtatcatccatgggatgaatcgatttgatgattgacacttaaaaatcggccaggcgcggtggctcacacctgtaatctcagcactttgggaggccgaggtgggcggatcatgaggtcaggagatcgagaccatcctggccaacatgatgaaaccctgtctctactaaaaaaatacaaaaaattagccgggcatgatggcacgcacccgtagtgccagctactcgggaggctgaggcaggagaatggcgtgaacccgggaggcggagcttgcagtaagccgagattgcgccactgcactccagcctgggtgactgagtgagactctgcctcaagaaaaaaaaaaaaaaattggagtgaataggaaatgagagattactttggatatttagcttaggtattgaatttaagatacttcttaatattaaattttggcaatgaaaatatagtttgaaaaaattgatactgatctatgtcagtgttacagtgatcaccaggaattatttagtttgcttaatttttaatctgctttgatgaatagcttcttaaacaaaaatgtctttgaggttatctgggtccagtgacacttcatggaatttaagtattaatagtgatggaaattttattatgccagtggtttaaatacccctgaggcccaaataaatagtttaaattattattattactattatttttgaggcagcgtttcactcttgttgcccaggctggagtgcaatggcgctgtctcaggtcaccataacctctgcctcctgggttcaagcaattctcctgcgtcagcctcccaagtagctgggattacaggcatgcaccaccacgccctgctaattttgtattttttagtagagacagggtttctccatattggtcaggctgatctcgaactcctgacctcaggtgatcctcccgcctcagcctcccaaagtgctgggattacaggcgtgagccaccacacctggcctacaaataggttaaattattttataaaattagctgttgcttgttttgcctactctcagacttctggattttttttttaagtatgaaggatttcaattgttatattaatataaaagcttagataaatagcacaaacatgaacatttttttttttgacagagtctcactctattgcccaggctggagtacagtggcacaatctcagctcactgcaacctccacttctcaggttcaagtgattctcgttctcagcctcccaagtagctgggattacaggcatatgccaccatgccccgctaatttttgtgtttttagtagagaaagagtttcgccatgttggccaggctgatcttgaactcctgacctcaagtgatctgcccgccttggcctcccaaagtgttgggattacaggcgtgagccatcgcacttggccgagtgtattctttatggttttttttttttttttacatccaaaagcttatttgtaatattcattttctgtatgtattcatgctataaaatttattttattttaattttttaaaaatagagatggggtctgattgttttgcccagcctggtcttgaattctgggctcaagtaatcctcccaccatggcctcccaaagtgctgggattacaggcatgagctaccatgcctggcctataaaatttattataaaggaaaaggcatattcttattaagctgataatctttacataaatactgaagcatggcatatttctttattctacttgggctattttgtgttgcattaagaagaattttttgtttttttttcttgttactatgcttgtttctggaatactcctttcctcccttactcttccaaactctactacatctaaatttatcctatttttcaagggtttgatcacatattacatcatccaggaagtgtctctcctattccctcttctccaaaatgtatattttttattctgggaactcttgatcctttgcctctagaccgtaagccctttgtaggcatgtctgtatctgagtttttaaaaaattttttcttcttttcccactcccagaataacaccctgtgcctagctcataaaaatgagcttagcagctagagttagtgtggttgctgtagaagatctctgatacacatatggcagtttgatgctgaatagtttttggaaattaaaaaacatgtagaaatttcaccaatgtcagtgactaacatagctgtaattagtaaattatcaaaatatttcttttttttttcttttttacagagggtctgtctctggaggcttcaggctggagtgtagtggtgtgatcatagttcaatgcagcctccgagtcctgggctcacgcggttcttctgagtagctgggactacaggtgtgtgccaccacacctggtcaatttttttattttgtagaaacagggtctcattatgttgctcaggctgacctcaaattgctgggctcaagtgatcctcccaccttggcctcctgaagtgctgggattataggtgcgggccactgagcccagttaaaagcatttctttaaaaaagaaaaaaaaaattctgtttattggaattttggggagaaagagaaagtaaacatgggattggttcatcctagacagcactcatggttctagataatattagaatgcaataatgttttaatttttatatgcagggaattttggagtagtttcaatcctaggaaaaaactgtgagttagaaatacagaacggttggccaggcatggtggctcacgcctgtaatcccagcactttgggaggccaaggcaggtggatcacgaggtcaagagatcgagaccattctggccaacgtggtgaaaccccatctctactaaaaatacaaaaaaaaaaaaaaaaaaaaaaaaatagctgggcatggtggcacgcgcctgtagtcccagctactcaggaggctgaggcaggagaatcgcttgaacctgggaggcagaggttgcagtgaaccgagattgcgccactacattccagcctagcgacagagcgagactccgtctcaaaaaaaaaaaaaaaaaaaaaaaagaaagaaatatggaacggttggttgataggattataatagaattcaggactccctttgaaagaataatatcgactagttttatataaaaaattaagtagattagtcaggagtaaaggaaaagtcaagaatcctaacttatttggatttctttcccccattacagtgtactcgaggaacaaaatttgggctgtttggctgtttttattctttgttatacacaaataagctgatatcaaaaccaaatatattgaggttacatttttcttttcttttcttttcttttttttttttttttggagatggagtctcgctctcacccaggctggagtgcagtggcgcggtctcggctcattgcaagctccacctcccaggttcacaccattctcctgcctcagcctccagagtagctgggactacaggcgtctgccaccacgcctggctaattttttgtatttttagtagagatggggtttcactgtgttagccaggatggtctcgatctcctgacctcgtgatccgcctgcctcggcctcccaaagtgctgggattacaggcgtgagccactgcgccccgccaagattacatttttctaggaaattttgactcttagatttatgatgagagtcacctttatgcttatagattgcccctttaccccatactttgttgaactgacagacattcttcttgccattatcactgtcatacacagttcacattcagagtaatttgttttaggcaattcatttcccctggcaataacatagagatttatgtaattttgaaaatgtttgttttaagtagtcatcatcatgactttgagtttctgttcaaagatgtttaactttgcgttacttttaagatttttaaattcatttttaattacaataacttttatgtatttggaggtatttggaatgaaatcaaaacttgtgctatctaggagttataacctaaaatatgcagaacgtaaatatacctgatgtaagagtatatacattctgttgggggggaggaagaagttactttatattcacacaaaatcattataatgcatgaaggaggatatgctattttaaaatcttatctttcactaattataagtaatacattattttatatatataccgaaattgaaagaaccacttcttggatgtaatctactgagtttgttgcatattcttccagttttcttttctgtgtttgtctaattttctatattatgggatcataatgtactattcttttatatactactgttccaagtttgtctatttatttcagttacctctatcaatcattaacagcaacttaatatcccatttctagtacatgaagataccataatttgccaggcatggtgactcatgcctgttatcccagtactttgggaggccgaggcaggtagatcaccggaggtcaggacttcaagaccagcctggccaacatggtgaaaccctatctctactaaaaatacaaaaattagccagccatggtggcatgtgcctgtaatcccagctactcgggaggctgaggcaggagaatcacttgaaactgggaggtggaggttgcagtgagctgagatcatgccactggactccagcctgggcgacagagtgagactccgtttcaaaaaagaaaagaaaatactgtaatttgcttaatcaacttacggtcactagattttttttttttttggccagaaaaacaaagctgtaaacaattgtgtgtgtgtgtgtgaatatttatgcacatgtacatatgtatatgcattttgtgtacttgtacaaacagctttgtaggatagattcctagaagtggagttgctgaatcaaaagatgtgaataatgtagatatggatagatatttatacattttccttccaaaagattgttgtaccaatttgtaaagctaccagtagtattcaggtatgccccatactctggccaatactagatattacagtttaaaacattttgacaatttaggaactgaaaaaatgtgattctgattggccttttatccatcaagattgaggctaaacattttttactatggggagagttgtatttctttctttcttttttttttttttttgagacggagtatcgctcttgttgcccaggctagagtgcaatggcttgatctcagctcaccacaacctctgcctcctgggttcaagcgattctcctgcctcagcctccctagtagctgggattacaggcatgcaccaccactcccagctaattttgtatttttagtagagacagggtttctctgtgttggccaggctggtctcgaactctcgacctcaggtgatccacccaccttggcctcccaaagtgctgggattacaggcatgagccactgcgcccaaccttttttttttttcttcttttcttttcttttcttttagacagagcctcgctcttgttgcccaggctggagtgcagtggcacaatctcagctcactgcaacctccgcctcccaggttcaagcgattcccctgcctcagccttccaagtagctgggattacaggcgtctgccaccacgcctggctaatttatatatttagtagagatggggtttcaccatgttagtcaggctggtctcgaactcctgacctcacgtgatccacccacctcggcctcccgaagtgctgggattacaggcatgcatcactgagcccggccatgtgtcttttataaattgcctacttttgttctttggttatttcctgatggggttattgcgttttaacaggttaaaaagttctctacatactcacttttttctttcttttttttttttgtgagacagagttttgctcttgttgcacaggctggattgcaatggcaggatttcagctcacctcaatctctgcctcctgggttcaagtgattctcctgccttagcctcctgagtagctgggattacaggcctgcaccaccatgcctggctaattttgtatttttactacagatggggtttctccttgttggtcaggctggtctgaaactcccgacttcaggtgatccacccgcctgggcctcccaaagcgttgggatcacaggcgtgagccaacgcgcctggcctcactcactttattcatgtgtgtgcacatatccccctagctattcttttgtaatgttatgtagtcagatatatccaaacccagcaccatgctgctgtgggaccttgggcacattatttaatctctgtacaccttaatttccttatttgtaaaatggagataatgtaaatagcattaggcatagtggctggcacaaagtaagtaaataataaatgttagctgtgactcttattagtctatttatgtgacttttgtgttttgtgctctacttaagactttccttactccaaaatgtaaaatattcacctatctactaaactagaaaaacaaagcgaggaacattatatgcctctatgtgtctttgctttaaagatgaaaaacaatgtatacatgtttgcttgtatatcgcaggatatatgatacttggaaacattggttgtcatagtaagaagaatgagtgagaggaagactttttaactgcatgcctttttgtatttttaaaacaaaggagtccccaggttgtaatttaatacttcagtggtttctttttctccttttccttctctttttaaaacttctaattctttgatccatctggaatttatttctggtataagaagtgagacatattttgggggataaaattgtgtgtgaattctaccctaactagctagttgtgtcagcaccatttagtgaataatctgttttttgccccactattagaattgcagcttttgtcatttactaaatgtgtttgggactatttctgattggtcttgttattttattttgatctcttgtgtattattttattttgatctcttattattttattttgatctctttgattaccatatactttaaattactatcattttataattttaatacagatggggttagttacctgttcattactctttttttcagactttgacaattctggtctatgtgttcttctagatgaactttagaatcattctgtgacattcaaaaagaaatcatagagatttttattgaatgctgaatattgattgggaatactgaaattgtaggtgaagtttggggaaattgacatctttatatactttctgtcctgtgttcaaatagatttttatgtccctcaatagattttcacactttgcttcaaataagtcctgtacagataagtctcgtatattcgtatatttcttatttcttttaaaaaaattagacccatgaatgggagtttgtttgtttattttattcaacaaatattgtagagaatcaaacaggtagtttttattctagtgagggaagacagaatatacttaaataaaatgaagtacgtaatccatttcagattatgataaacctataaaggaacaaaaagggtgatgtgattgagagtaacttgtgggagcttaccttatatgtagcgtggttagaaagactcttctgagatgacatttgaactgagaccttaagtttgaggaggagctagccacctgaatgagccaggaacagctttcctggcagagagtaaaggacaaagacccagttaggaaggacctggcagagaagggctcctgaagaaactgaaaggaaactcatgttgctggggcctagtgagcaatctggaaagtaagcaggccaaatcaagtagggccttgggtcatcgtaagtacttgagactttatttgcggtgcgtaggaaatccttggggaatctgaagcaggagagtgacatgttctgatttaaggtttaaaaagaacacttggctttttgagttgagaaagtattgaagtgggaagcccagttaggagtttttttgcagcaagaggtaaggatggtggtagttagatggagaggcctgggaagcttcagagtgtgtgtgtgtgtgtgtgtgtgtgtgtgtgtaaggaacagctaaacaacttgctgttggagtgggtgttactgagagctaagtactgctagctgctgcagaggccatgtagagcagaacagagctgatctttaccttcacaggtgtttgatagttctgtttgtttctaaggtgtgtaccaaaataaagtaggctaagagcatttgactttaagatttatggagctcgggggtgctgagaggggtgcagcaaaaaacagagtctgttcataacccttgattaacctgtagtctctgttagtgggtcaaaggggaggcagcagcagatgatctttaaggtatctgtctctgagttagaaaaacatagcttgaggaagttatgtagctttcctacagccttagagataatagtggaaccagacttttaggtgagctcacgcacacaccaagtcttagtacactggctagtatatatctagagctcagtaaatggtaactcttttagtaatatccacttagacattgttatatctattaattcaggccaaatatctacattaaaattgttcttatctcaatttctttgttcttcttttgtgttaatcaaggagggaattggcatgtagtcatccactttggttgtgaagtatatttgttctttttttttttttttgagatgaagtcttgctctgtcgtccagcctggagtgcaggggtgcgatctcggctcactgcaacctctgcctcccaggttcaagtgattctcgtgtctcagcctcctgagtagctgggattacaggtgcgcaccaccacgcctggctaattttttgtatttttttttttttttttttgagatggagtctcgcccttttgcccaggctggaacgcagtggtgcaatctctgctcactgcagcctctgcctcccgggttcaagcgattctcctgccccagcctcccaagtagctgggattacaggcgtgcgccactacgccccgctaatttttgtatttttggtagagatggggtttcacatgttggtcaggctggtcttgaactcttgacctcatgatcctcctgcctcagcctcccaaagtgctggaatgacaggcgtgagccaccgcgcccagccgtattttttgtatttttagtagagacgaggttttgccaggttggccagactggccttgaactcctgacctcaagtgatccacctgcctctgcctcccaaagtgctgggattacagacgtgagccaccgcgcttggctggctttgaaatatgtttgttcttataagttgagtgagtgagtgagtgttgttcagttcagagaattagttcaatgtagtgtcgacataccacagagttttcagttggatattgttacattgtactgctgtcttgggacagcactttttgtagaggtaaaatagcatcatttttctttcatttaagaattatgtatttattattattttttgagatagagtcttgttctcttgctcaggctggagtgcagtggcatgatcttgtctcactgcaacctctgcctcctgagttcaagtgattctcttgctcagcctcctgagtagctgggattacagacatgtgtcaccatgcccggttagtttttgtatttttagtgtagacggggttttgtttttttggccaggctggtctcaaactcttggcttctagtgatccacttgcctcggcctcccaaagtgctgggattacaggcgtgagccactgtgcctggccagaattacttattgagtatgtgtacccatagatttatcaaataattatatccttattaaaatttttctttcaatatcatactttataagaggtaggataggttaactaaaaagctttttctttagcttccatttgtttctctgtctttaagtaagatgtcatgatgtcaaaagaggctgcaaataaaataccttgtcaatggcattcccccagattagatcttaaccaaaaggctgagaagcagtagctttttttccccccaaagggaagaatgctttagtttattttacaggagaaaatttattccagtatagcaccactctggtcttgtacaaattacagaattcacttagataatttctagtctttcctctcctgcatgctgggctctgtaataagtttaggaggtcggctttctttaaattatccccaggttggaggattttaggtgttgggatgcccagggtggtggtccttcttagccttgtcttgcctaacatacttttagaattggtgtagagctggacagctttgtgggaactggtgtgacctaattttcctcagtttaataactaatattttagcatttgaatgtcataaaggcattgccctaccccatacttttgtatcagtaggttttattattttatcacgtaaaaattacatattttgtgggatcctttttctgctttggtgaaatgtaggcttcacctctattgtgacgcttggtggattcattcttgctcatctgaagtggcatctgcagtcctgccacagtgaagtatatttttagcttttttttttttttttttttttttttgagatggagtctcgctctgttgtcaagctggagtgcagtggcacgatgccagctcactacaacctccgcttcccagattcaagcgattcccctgcctcagcctctcgagtagctgggactataggtgtgcaccaccatgtccggctaatttttttttttgtgggtgtgttttagtagagatggagttttaccacgttggccaggatggtcttgatctcctgaccttgtgatccgccggccttggcttcccaaagtgctgggattacaggtgtgagccactgtgcctggccatttttagctttttttccaagatagcttaggccaccttgaacacctttgcataacacattttggttatgcaaaaattgtgggccaaaagccaggagttcctgctgagaggaaaaattgcttttttttttggcaggatagtatttgaaattttgttgttgcaagattttcctgttgagtaaatatgtgtgcgtttatttaatatgagaggatttaaaaaggaacttaaatagatcaatttcattttgcaatattgtattacctgtttgcaatatataagaggatagttctgggtttatctgtataattcagttagaagtgctgttgtcttttatgacagtgacatataattattactatattattcccatcctaaaacattatatgttgatatttaagagatgaggaagttgcttataaaatctcgatcagatttcttaaacaattcatagaatttttttagttcatgagtcaaccatgtaactaccctgagttaatgagttttggtgctaagaactgaaattataatttgatactgccacttaaggtgctcccttccccttcagtctgaactttaaactagattcttttatttcagtgggtttcaaatgtaaagtattctgccgaggtatcttagtgagccaggactagagtgaagggtggagggaaggatgggaaagggcagggggagactgaaaagatgaatcctaggtctcccattcttactagatcggaatgtttctccattgtaccttttgtacatttagctttcatttaagacttttgaggaaaacattctggttaaaaaacaaaatctgagcactgttgccgtgtatctcatggataagttttgaggaaggaggttgtcgtggtctccaggctgcagttcatgcgaggacaggaagggcttgctttgacctgtaaatttgtatgctagtaggggctaatttcctgattttgctagtgtgtgtgtgtgtgtgtgtgtgtgtgtttttttttttttccttctgtattgggcggatagtacttttaaagaaaactgactttttttttttttgagataataaagttaaacttcactaaagtcataccacaaaacggacaaggaaggattactgagatgagggaaaaaatggacaagtcacttaacttgtgactttgagtgacattgagtgtaattgttgaactcaggactcaccatagctgaaagttaaacaatgtgcattaaaaaattgtacctcatgggtttctaatcatttaggccactgttagaaaaaaattggatgaccctgggttaaaatctttttttttgcctcttcattccatttatagctttatttatttgggatatctgagttgggaggagagtgcagagatagataacttaaagcatgttttaggacagcagatcagaattagttggaaaacttttacaaaatgcatgaatgttcatatagtgaaatactcttttttttttttttttgacagagtttcactcttgttgcccaggctggagtgcaatggcacgatctcggctcaccgcaacctctgcctcttgggttcaagcgattctcctgcctcagcctctcgagtagctgggattacaggcatgtgccaccacgcctggctaatttttatattttcagtagagacggggtttcaccatgttggtcaggctggtctcgaactctcaacctcaggtgatccacccgcctcagcctcccaaagtgctgggattacaggtgtgagccaccgcacccggcccatatagagaaatactgtttagcaatagaaagaaccataaattgatgagaataattgccaagatgtttttttttttttttttttttgagacggagtctcactctgttgcccaggctagagggtagtggcgcaatctcggctcactgcaagctctgcctcctgggttcatgccattctcccgcctcagcctcctgagtagctggaactacaggcgcccgccaccatgcttggctaatttttttgtatttttagtagagatggggtttcaccgtgttagccaggatgatctcgatctcctgacctcgtgatccgcccgccttggcctcccacagtgctgggattacaggtgtgagccaccgcgcctggccaaccaagatgtattaagtaataaaagcaagatacagaacagtgtgtttctagtatgccaccatttacataggggaaaaagtgtgagtgtatgtatgtgtaggatatttctaaaggacactctagaaactagtaactttggttgccttctgggagtgtaactgggtagcagctggagaagaagggcgaggagatttttcgctttatattctgcggtactttttcttaagtcctacatataatatttatttccaaaaagatcaaccctcctcacgatgccacatgctggcttttccccttccacctggagcagttgcaggtgtatggatgaggagaaagctcctcaggtggttttaatgtgtgctctcactgaacatctcagctcctcctagttcactgcttgctgagaaagctgcaaagcattgcagaaaacattagtttttcccattttgccacaattttgtgatattagaggaattattgactttctctgatcttcagatttctcacctgtcaaatcagtgttagttgggtaatctcaaccttacaatccttaagatttgctgatctccatgcctcaggaagggagcagggaaaaaacaggctgagggtcagctggtcagtcttctgactcttctcctggtcagctttcacaacagcaggaaacatgacatcaggaggaggatggtatatttatttaaaatatttatatattacatggtaccacatagtttttaaagttctttttttttttttggagacggagtctggacccctcacgcaggctggagtgcagtggtgccatcttggctcactgcaacctctgcctctcagcttcaagtgattctcctgcctcagcctcccgagcagctgggtttacaggcacgcgccaccatgcgtggctaattttttgtatctttagtagagaccaggtttcaccatgctggccaggctgtccttgaactcctgacctcgtgatctgcctgcgctggcctcctaaagtgcgtgagccaccgcgcccggccttaaagttctttctatacgtttttcttttattttttgagtcagagtttcattgtatcacccaggctggagtgcagtggcacaatcacggctcactgcagtcttgacctcctgggctcaagtgatcctcctgcttcagcctcccaggtagctgggaccatgggtgtgtaccgccatgcctgactaattatttttttcttttttttttcttttcttttttttttttttttgagacagagtcttgctctgttgcccaggctggcatgcagtggcccgatcttggctcacggcaagctccgcctcccgggttcacgccattctcctgcctcagtctccccagtagctgggactacaggcacccgccaccacgccctgctacttttttgtatttttagtagagacagggtttcaccgtgttagccaggatggtctcgatctcctgacctcatgatccacccgccttggcctcccaaagtgctgggactacaggcatgagccaccacgcccagccgcctgactaattgttattattattattttaattttcttgtagacataggtctggcttcattgcccagactggtcttgaacgccttgccttaggagatcctctgatcttgacttcccaaagtgctgggattacaggtgtgagccactgtggccagcctataagttttattttaaagttagattgaatgacaattccctaaaaaattttattttttaaacctaactggataaagaatatattgataaaaactgggaaattgatcaagttgtcacagtgaattatttttcgaatttgccctcttcccaaatcccttgaaatgatggaaacaaaattaaaactttactaataaaatactaaatgtgtggagattttatatatataaaattatatatgttatatttttatatatacaattatataattttcatcatatataaattctattttttaaaaccacccaattaggtaataatagaactcctgtcttaaagtaagagagtatgcacacacatgcacgtgtgtatatgtgtatataaaatttttgtcatgggagttttatatataattaagatagaaattatatattatggcacacatttttatacatatgtaatattctctatcatatgtatgtaaaatacatattaattatgtataacataaacatttgtgctatcctgaaacataaacatagataatcatgttttaggatgggaatactcaggagtataacagtacctgttctcccattagtcagtctgtaaattcagtatttatgtgttctcatccagaattctctgggacctgacaagctgactctgatgcttgtgtgtaagaggaaatgtgctagaatagctgggaaggcggtgaaagtagcagcaacagcaaagcacaatgaggtgaaacttgtcctgctggatatgaaacctcataatactagagtaatttgaaaagtgtggcattggcacaagaaaagacagataaatcaaattagtctagaattgtggataagtaggaatatactttataatgaagatggctttgtttttctttctttctttctttttttttttgagacggagtcttgctctgttgccccggctggcgtgcaatggcgtgatctcggctcactgcaacctccgccttccaggctcaagcgattctcctgcctcagcctcccaagtagctgggattacagacgcatgtcaccgtgcccggctaatttttgtatttttagtagaaaagaagtttcaccatgttggccaggctggtctcgaacttctgacctcaagtgatccacctacctcagcctcccagagtgctgggattacaggagtagccaccgctcctggccttctttttctttatttgctatttcaggtccatagaagcatgcaaagagtaatataacaaatgtccatctacctaccatctgtgattacaaaacttagtattttatcatccttgcttcagaattatttaataaagacaatacttccctctgcacaaatgcttaccttaaaactactcttgaattcttttcgcaattgacttatcaactcccaaatttaaaaccatgtatttttgtctttatatttctcagacatttatagaaagatatttactgagcagttattatgtgccagatcttatgctgtttttatatactgtttttactttatataactaattatattatttgtcacatattaacctattttaagtataaaaagaaatgatgcattaatgttttcaaaccttggtaacttttattaagtaaatacttgagaggaagcttttactggtaattgtggttttatttatgtagctatagttataatttattagaagtacacttggtgttttagttcttactaattctgtttttttctcatcctgtttaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggtaaggaacagatagtatgcaaattgcacatgttttttgtgtttttctttacttttcctatttaatacacatgtgggacagaaaccaccaaatttatcttttttttttttaagttgcaagagctatttacaaagacaaggaaccaaagattgggaattaattatttctgtcttcttactgtggctttatgctgatttcaggagttgaacttgtctttgcttttcatgataggagttgatgataaatagaaaacttaccaattctctagaatttctggggtaagacctatatttatactcccaagttgtggctgagttttaagctggccagataacttggcatgtcttgggtgagggccaagataaagacctctctctttttaagaaattgatggtaggaagatttgtatagtaggtaggaaggaagggatggtagttaggaaggaagactttatcataggaagagtttgtaagagattgatttaccttgtgaaaaataaagtatgaggtgaaataatcatatcagagtagaccaaggttatgggtgtaagaggtttaaagaaaaataggaaaggatgggataaaacggtcctctcagagactaagaaagcagatttgtcatcagaatgtactacagggtcctcctgaggactcctttgaagtgcagtcatgattacagagttagaatggacattcttacgttgttcctgtgtagggaggcatttagtctttcaccattattacatgtaatgttagttgcacgtttttgttgatgccttttttggttgaagaggttgctttctgttcctagtttgagaatttctgtcatgattgggtgttgaattttgcttgtgttgtccccctaccccagtgttattcatccgattaccaattttctggattattgttgctgctggttttttaaaaaaatcaggccgggcgcggtggctcatgcctgtaatcccagcattttgggaggctgaggtgggtggatcacttgaggtcaggagtttgagaccagcctggccaacatggtgaaaccccatctctactaaaaatacgaaaaaagtagccaggcatcgtggcaggcatctgtaatcctagccactcgggaggctgaggctggagaatcgcttgaacctgggaggcagaggttgcagtgagccaaaattgcgccgttgcactccagcctgggcaacaagagtgaaaccccatcttaaaaaaaacaaaattaactttgcagtttagtttatatatatacacatatatctatattagaatgcactcattatatgtgtacattgtaacaaattttgacaaagtcataaactcatacaaccatcatgaaaatgaagatgaacaacatttctaacactctaggacgttctttggcaccccatcctccttggcacccacccgtgtcagtcctcctccccgacttcctactaacctcagctcctaggaaaccactgatctgctttctatcataatacattgtatacgttctgagcttcatgggaactattctgtctatggcctcttttgcttcccataatacttctgtgatctatccatgtctgacatgtcttagttcattcctttttattgttgagtatgggtataccacaatttgtttatccaatcacctattccagtttttgattattataagtaaaattacttagaaaacatatatctatatgtttgttgtatgtaaattattaaaggaagtattgcctcattttcttaacagcatcctttggagagcgtacattttttatttttatcaagtccgatatactttttttttgagatggagttttgctctgtcacccaggctggagtgctatggtgccatctgagctcactgcatcctctgcctcctgggttcaagcaattctcctgtctcagcctcccgagtagctggaattacaggcgtgtgccgccacacccaggtaatttttgtatttttagtagagatggcgtttcaccatgttggacaggctggtcttgaactcctgacctcaggtgatccaccctcctcggccttccaaagcgctgggattacaggcgtgagccactgtgcccggccccagctaattttttgtatttttagtagggacaagttttcgctatgttggccaggctggtctcgaactcctggcctcaagtgatctgcctgcctcggcgtcccaaagtgtggggctttcaggtgtgagccactgtgtctggtctcctctggttactttttaagagttttctctttatcattgattttcagcaatttgggtatgggttttttttttttttttaaacgaagatggtgccttgctatgttgcctaggctggagtgcagtggttttcataggtgcattcccactactggtcagcacaggagttgtgacctgctccattttttttgttttttttttgtaacctgggtgggttcatccctccttaggcaacctggtagtcctcctgcttctgggacgtcatcatataaatgctgaacttagtgtagacatctgattggcatagcccagagctgtagcctagaactattgggctcaagggatcctcttgcctcagcctcccaagtagatgggaatacaggtgtgagtcacgacgcctggctgttgtgctttttgaatgaatacattattgtccctggcattcaccaagcttcctgattctgtggatttacaattttcataaaatttgagcagtttggggccattgtttttttcaaatattttttcctgtctccttttcccctagtttctgtctgggactccaattactcatgttgcatgttattccacagttcactggacctctgttcactttttttccctgtttttattttattttttttttaaatccattagcttcattttgctatggtatcatagtcagtgatcctttcttctgtacttttcaacctgttgttaattttatccagtgacatttttattgcagatggatttcatttttgatgagaatatgaacattgtgagtttcatactttttttactgctggcctttgttatattcctgtaaagagagatgaagtccttctggtaggaaattaagttacttttgaggcttgtttttaaactgttagggcaggtctagagtggtctttattctaatttatcccccacttctaagcttgtctcctagggtttctgttgaatgtcccgtgtattcagtgggatttcctcactcttgctggaagaaatttgaatgagttcttgccctgagtgagctcagggaattgtttgctttatagttgcttctaattgttctatcatcagaaattatttttagcccagcctgtgatatttctccttattcatttacagactagaattcaggcataggcttaagggatcccaaattcagagtttaggaaatctttctctttgaaactaacttctggaagttcagttcctatggcttatccaaaccttgtacggttgcttcttcaacgactgtgattgtgggacatgatttaggttcccttcccatggctgcagtttggaaattgcctttaggcagagggcctagagtatggtaggtagggcttacctcatttgcttcatttctctcagcgatcaagccctgtgctgcctattattcagtttctgaaaatagtttctacatttctttgaattttttagctgttgactgtgggaaggtaattctgagcagtgttacctgcttatacctggaagctgcagtacactgttgttacttttatttcactccttactcttaatttttcttgctgggtacgtcctttagaaattctttcagggagtgttggctgggcgtggtagctcatgcctgtaatcccagcactttgggaggctgaggcgggcagatcatgaggtcaggagatcgagatcatcttggctaacacggtgaaactccgtctctactaaaaatacaaaaaaaaaaaaaatagctgggtgtggtgttgggcgcctgtagttccagctgcttgggaggctgaggcaggagaatggcgtgaacccgggaggcggagcttgcagtgagcctagatcgtgccgctgcactccagcctgggcaacagagcgagactcctcaaaaaaaaaaagaaattctttcagagagcgtctgtggttggtatattatttgagttcttaaattctcaaaagttagtagccttaaaacttcagtgatggtttattttttatttcattttatttttagagacaaggtttcactctatcacccaggctgaaatgcagtgacgcagtcatagctcactgtaaccttgagctcctgggctcaagtgatcctctcacctcagcctcatgagtagctgggactataggtttgaaccaccatgcccagctaatttttacattttttatagagatgggctctcactgtgttgcacaggctgatatcaaaaccctggcctcaagctgtcctgccttgccctcctaaagtgctgggattataggcatgaagcagcatgcccagccaaatgatgacttagttattcaatttgtagcttcaacgttattttcctctgaacttgaaatatgctattatttgctgtttgcttctattcagtgttgctaatgagaagcctgcttttattatgatccttctaactttgtaggaaacttttttatttcatcaaacttataataaagtttcactttattcttgtttttttaatattttcatgtgtccagtatggattaatttaaaaaatacatccagttttttccttaagcccttttaaatctgaagactatgttttttctaatttcagagaaatgctgttctattatttttcagaatcctgtctcttgcctgtggatatgggatgttggaactttttgctgtagctcccatttttaacttttttcctgtggtttctatgtctttgtgctttactgggtactgagagaattcctcagttctctcttagctttcatttacttttcacttctgtgtgttcaactattgtttaccttcagtgattcagtttttagtttctttgattctttaataaattttttttttattttttgagacagagtctcactctgttgcccaggctgaagtacagtggcacaatcttggctcattgcaacctccacctcctgggtgcaagcaattctcatgcctcagcctcctgagtagctgggaccacagacatgtgccaccacgcctggctaatttttgtaattttagtacacacggggtttcgccaagttggccaggtttgtgtgaagctcctggcctcaagcaaccctcccaaccttggcctcccaatgtgctaagattacaggtgtgagctaccatgcccggcctgctatttgattctgttgttatttttttttatttttatttttaacaaacccttgtgatgaggactgactatttttttttgtttttttgagacagagtcttgctctgtcacctaggctggagtgcagtggcttcgtctaggctcactgcaaactccgcctcccaggttcaagcgattctactgcctcagcctctggagtagctgggattacatgtgcctgccaccatgcctggctagtttttgtatttttagtagagatggggtttcaccatgttggccaggctggtctcgaaatcctgacctcaagggatccgcctgccttggcctcccaaagtgctgggattacaagtgtgagccatagcacctggcctatttgattctttttgaggctattattaatattttctaggtcctttttacttttatttactgttttacctatttccttggatgtaaattcctttttgttttggtgcctttgaaaaaaaaattttttttttttgagatggagtcttgcacttttgcttggactagagtgcaatggtacgatctcagctcactgcaccctccccctcctgggttcacgtgattctcctgcctcagcctcctgagtagctgggattacaggagcatgccaccacgcccagctaattttttgtgtttttagtggagatggggtttcactgtgttggccaggctgttctcaaactcctgaccttgtgatctgcccgccttggcctcccaaagtgctgggattacaggcatgagccactgtgccaggctgaaaaagttttttaaatggtttttttatgttttcaactttatatctgagatttcttcttagactatgagttattttttactcataacttatagagaagggctctcaatggcttatctaccctctgttttatcctggacagcataattttatctgtttatgatttttaaaactttttgttgacacagaattcatataacaaaatttaccattttaaagtatataatatagcagcttttaatatattcattatattgtgcagctatcaccactacctgatttcaggacatctccatcacctgcaacgaaaccccataactaatagcagtttcaattctcctcttctccccatcttttgacaaccaccaattcattttctgtttctatggatttgttgccttttcgtttttctttcttttttttttttttttaaagatggtgtcttgctctgtcacccaggctggagtgcagtggcacaatcagagctcactgcagcctctaactcttgggctcaagcaagcctcccaccttagcctacagagtagccgggacgtgccacaatgcccggctaatttttaaatttattttttgtagagatgaagtctcactatgttgcccagactagtcttgaatctgtggggtcaagcaatctgcccaccttggcctccccaaagtgttgggattacagatgtgagccatagcacccagcctggatttgcttattatagacattttatataaatggaatcataatatgtggccttttgtgcctgacctttttttttttttttaaacttagtataatgttttctatgtttgtctgtgttctagcatctctccttttttaaggctgaatgatattcagttgtatggttatactacattttgtttatttgttcattagttgatggacattttggttgtttttattttttggctgttgtgaataatgcacccatgaaaaattgtgtactaggttttgtgtgtggttttatatacttgtaattctttggggtatatacctaggactggagttcctagcttatttagtaattctgtgtttttctgtttatgattgagttagcacaatagatttgtttggaaaagaagtttttgccaaaaaaaaaaaaacaacaaccaacaaaggaaaggtacaaaaacaaacataaaaacactcacctagttttgatgggaaaaactactactcttaactagcaggttgattctctgtacttcagtttcttcattgtaagtgtggatggatttgattagacttccattacccttcttccagcttactcattatgaatttagtattggaatgctttttaggatttcatattgaacacatgagtttgagattttactgatgtgagtaatacagattgggagttattgtaatttgttattagaggaatgagtcaatatagattaaacttgaaatttcattttggatttttttaatgatatatagttaaaatgttgattattttaaggggaagaattagatcaatgaaggattgaaatagtcattgctctttctttccatacttagtggcccataactacctttatacttgctttgatttcatgatgttgttcagtttttggttaataattgatttatgattattttaatactaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggtaatgaggtttcttttatgtttctatctaggattataattgtgaagtatacaagtttgtcattattttatttttttactttttattaaccaagccatgactggtcatttatagtttgcattttgagttcttttttgttggttggttgcaatagttaacaagctcttaaaacttgtttccatagtttggcattaatattatttagtagaaaggcagtaaaccacctggtcacctgtgtgtccttggttatgttctatagacttgggctgcacattagaaccccttgggatgcccaagcctcatcacaaaacacttaaatcaatctctggagttgggcccaggctttattttatcgccgaagtttttccggtaattctgatttgcagctagggttgccagtcactgatctcaactcttcaagctttagttttccctcctataaaaatggagataatagtggcattgtcctcaactgatagtaaatattctgtcagataatgtaggtcctgtacatgcatggtgggttctctttttcctgagtgtccttaccatctctgctttcttttacttcattctcattctgaaagttttgtttgttttttcttgttttttggagacaggatctttctagctctgttgcccaggctggagtgcagtggcatgatcatggctcattgcagcctcaacctcctgggctcaagtgattctcccaccttagtctcccagtcctggctaattttttgtattttttgtagagataggatttcgccatgttgcccaggctagtcttgaactcctgagctcaagtgatccacccacccctacctcccaaaatagttaattcttttttttttttttttttttttttttgagaaagagtctcactcttgtcacccaggctggagtgcagtggcatgatctcagctcactgcaacctccgtctccagggttcaagtgattctcatgcctcagcctcctaaatagctgggattacaggcatacacaccacacccagctaacttttgtgtttttagtagagatggggttttgccgtgttgaccaggctggtcttgaattctgggcctcaagtgatctgcccgctttggcctctcaaagtgttgggatcataggcatgagccactgcacctcgccagaatttttttttttaaattgtgtgtatttaaggcatacaacatgatgttatgggatacgtatagataataaaaaggtcactatggtgaagcaaattagcatatccatcatctcacaaagttatttatttttgcttttgtttttatttttgcttttgtggctggaccgactaaaatctactcatttatcatgaatcccagatacagcactatattattatctgtagtcctcatgttgtacataagaaatctagactttttcattctatgtgtctgctactttacatcctctgactttcgtctccccattttctttccaccccctgcccctggtaaccactgttagcactgttttgttctctttgtatagttcctttttttttttttttttttttgtttaagattccacatataagcgaaatcatgcaatattttactttctgtgtcaggtttatttcacatagcataatgtccttcaggcttatccatgttgtggatggcaagatctcatttttttttagggttgaataatattccatagtgtatatataccacagtttctttatgattcattcattgacaaacacttagattgtttttatatcttggctattgtgaataattagctgcaataacatgggagtgcatttacctttacaagatggtgatttcatttcccttgggtatatatccagaagaaggattgtggggtcatgtggtagttctatttttaattgctttaggaactttcatactgttttccataatggttgtactaatttacgttaccaccagcagtgtacaagagttctcttttcttcatgccctcattaatatttgttatcttttgactttttttggtaataggcatcctaatgggtgtgagaatatctcatagtgcttttaatatacagttccctgatgactaatgatactgaacatcttttcatatacctgttggtgatttttacgttttcttttgagaaatgtctattcagatcttctgcccattttaaaatcaggttatttgtttttctgctattgagttttatgagttctttataaattctggatattaattccttagcagatgcatagtttacaaatatgttttctgtgtctacaggctgctgactcattttgttgttttcagaagctttttagtttgatgtagtcccatttatatatttgtgcttttgtggcctgacctcttgatatgcaaaaaatcattgccaaggtcggtgtcccggagcttttctccctacgttctcttgcaggacttttatagtttctgatcttatatttaagtattttatccattttgagttgatttttgtatatgctgtaaaacaagggtctaatttcattcctttgcatctggatatctagttttcccagcattattgaagagactaccctttccccactgtgttgctgtggttcccttgtcaaaagttaggcggccatatgtttagatttatttctgggctttctattcttttctactgatcagtgtgtctatttttatgccaataccatattgttttgattactgtaacttggtagtacaattttaaatcaggaagtgtgatgtctctttgtttttctttttcagaattgattttgctattgggggtcttttatacttccatgtgaattttagggttgttttttctatttctgtgaaaaaccccattgggattttaataagaattgtgttgaatctgtactgtatatttctttgggttgtgtggacatttttgcaacattcttttgatccatgagcacaggatatctcttcatttatttgtgtcttcagttttttaatcagtgttttatagttttcaatatacagatctttcacctccttggttaaatttatttaaccaagtaaatttatttaaatgtcttttagaactctgtcataaattgtttccttgatttctttttcagttaggttgttacttgtatataaaactgctgttgattttgtatcctgcaactttactggattcatttattctaacagtttttttttttaatgtgtagaatcttggggaacttttatacataggattgtgtcatctgcaaataaagatatttttactttttcctttctgactggatgccttttatttcttttcttttttttcttttctttttttttttttttgtttgattgctcttgctagtacttctagtactatgttgattagaagcgtttgccactgcttctaatcaacatagtactagatgggaaaaggatccgatccttacctttcatggtatcttagtggaaaatctttcagtatttccctattgattatgatgttagttgtggaattttcacaaatggcctttattatgttaaggaactttccttcttttcctaaactgttgagttttttaagtcaagaaaagattttggactttttgaatgctttttctgcatcagttaagatgacgtgttttgtttttgtttttacttctcttctttttaccagtaggaaactttatattgtcctttttttctccttgaatttttatttcttttcttctccagtaaaaattttttgctaatatgtttattcttaatagcattttactgatcactttcatatatttctactacaaatacatatagaaattttgggccgggcactgtggctcacacctgtaatcccagcactttgggaggccaaggtggacggatcacgaggtcaggagattgagaccatcctggctaacacggtgaaacctcatctactaaaaatacaaaacattagccgggcgtggtggtgggcacctatagtcccagctactctggaggctgaggcaggagaatggcatgaacccgggaggcggagcttgcagtgagccaagattgtgccactggactccatcctgggtgacagagcgagactccgtctcaaacaaaaaaaataaataagtaaaataaaataaatttatttaagttttctgtgattttaggccctgagtgtttaaaagttttactctggattaagttatgacaattagtagtagtagatcattgaacaaaaaagcataaatatatgtatacattttattacattattcttaaaagcaaaaagtaaaatcttactgaaaacataccttttaataagaaaggactggtttcccttcccccaattattgtaatttttgagtactaattactggaaacaggcaggcttctatgtgaatactattccaatttttattttttatagactatgaatattgttcatctaagcaggtagaaatggaataaattttgtagctgcaattttgcttaattctctgagtgccttccaatttctagaccaacaatcacagtgatctgatatctaaaattattttttttgatctttcagctaaaaaatagtttctcctttgatacaaaagtaaagaattagaaaccacttggtttggaaaaaaaaaagtttgttacccatacttttgccattctcttttttcagtattgacatgatcatttcaaattgttcttttgtagcactagaggtttagttttatttgtttgctgtttttcactttttttattatctaggacagaggttgccaaactaaggctagttggtactgaccatatcctgtctgtcctgtttttgtagagccctcaagttaagaatgatttttacatttacatattaaaataaattttattatgtatatttgaggtttacatggtgtgtgttatgggatacacatagtttagccagtgaacatatctgtcatctcacatactttgttttggtgacgaatagctaaaatctacccatttagcaaaaatccctaatataatacaattgtattaactttagtcctcatgttatacattagatctctagacttgttcatcccacacatctgctattttgtatcctttgacctccatctccttatttctctatccccaaccagtgaaccactgtttcattctctatccctgtgtatttgagtgctttttttttttttaatattccatatataggggagatcatgcaatatttttatttttgtgcctggcttatttcagcgtggtttcagcatggtccatccatgttatggtatgaaaggatttttttcttttttaaagttgaataatatttatacacacacacacacacacacacacacacacacacacacatacatacatacatacatatatatgtatacacacacacatcacattttctttctttcttttttttttagacagagtctcactctgtcacccaagctggagtgcaatggcacaaccttggttcactgcaacctccacctcctgggttcaagcagttctcctgcctcagcctctggagtagctgggactacaggcgtgtgccaccatgcccagctactttttgtatttttagtagagacagggtttcgccatgttggccaggctggtcttgaactccagacctcaagtaatccgcccacctcagcctcccaaagtgctgggattacaggagtgagccactgtgcctggcctgcacattttcttaatccattcatctgtcagtgggcatctaggttgtttctatatatgaactattgtgaatgatgctgccatgaatatgggagtgtaggtatctggttgttgttttattctttttttttgagatagggtcttgctctgccactcaggctggagtacagtggcatgatcatggctcactgcagcctggacctcccaggctcaaatgatcctcccactgcagcctcccgggtagctggcaccacaggtgcatgccactgtgcctggctgatttttgtattttttgtagagatagggtctcactatatccaggctggtctccaactcctggcctcaagcgatccttctgcctcagcctcccaaagtgctaggattataagcatgaaccactgagcccaccccagatatctttatgaggtggtgatttcattccttttgagtatacaaccagaagagggattgctgggtctatagtagttgtatttttaatttctttgggaccttccatactgttttccataatggctataacaatctacattcccaccaacaaaatactagggttcccttttctccataccctcgccaacatttgttgtcttttggagaatagccatccttacaggtgtgaggtgagatctcattgtagttttaatttgcatttccattgtgattagtgatattgagcaccatttcatatatctcttggccatttttatgttttctttggagaaatgtccgttcacttctcttaatatgatatatcccattgattgatttgtgtatgttaaaccagccttgcatgccagggatatgtcccacttgctagtggtttgtaatcttcgtgatgtgttgttgaattcagtttgttaatattttattgaggtttgttttttttttttttttttttttgagacagagtctcgctctgttgcccaggctggagtgcagtggcacgatcttggctcactgcaagctctgcctcccggcttcacgcccggctaatttttgtacttttagtagagacacggtttcactgtgttagccaggatggtctcgatctcctgacctcgtgatccgcccgcctgggcctcccaaagtgctgggattacaggcgtgagccaccacgcccggcctttattgaggatttttgcatcagtgttcattagagagattggcctctagttttgttttcttgtgatgtccttgacttagatatcaacttaaatgcctttgagttaagtttctctcatataatgtgttgggaaatagtccctctagctctattttttggaagagtttaggaggagttggtatatatttttctttgactattcagtagaattctgccatgaagccttcagatactggagttttctttgttgagaagtttttgattacttcttcagcctcttcatttgttgttcgtttgttcaggctttctacttctgcttaactcaatcttggtaggttgtgtttttctaggaatttatccatttcctctaggttatccaatttattgacatataatggttcatatagttccttatgatcctttttatttctgaggcatctgttgtaatttcttcgttttcatttttattttatttatatgaattctaagttattttgaaatataattacctttataaatttcctttctgatttcagcaattttataaggtacctgatttcccatttcaaaaatgtgctcactgtttaggttttaagttgatcaaagatttgaaatataatattattttgtttgaggtggagtctcactctgatgcacaggctggggtgcagtgacatgatcttgactcactgcaacctctgcctctcatgttcaaacgattcttctgcctcagcctccgattagctggaactgcaggcactacaaaaaaaaaataactttttttgtagttttagtagaagcagggtctcaccgtgttggccaacctggtctcaaactcctgacctcaggtgatccacctgcatcggcctcccaaagtgctaggattataggcgtgagccaccactcccagcctaaaattattatataatacatttcttggttaagtttggagagagaattcagcttacttgtcccctaatatctaaaaaatgaacaaaaacatatttttcaaacaggctaaaaatttacccttttataaataagaaaagacatacagctattgtcaaaaacttagaaaagtgggattcacagaaagaattacaagtatcttgaatgacttggcctcctattttctattgttaaagtagcattattgttttatgagtcaaggaacatgagtttttattttatttcattttattttattctattctttttttttttttttttttttttgagacggagtcttgctctgttgcccaggctggagtgcagtggcgtgatctcggctcactgcaacctctgcctcctgggttcaagcaattctcctgccttagcctcccgagtagctgggactacaggctcatgccaccatgcccggctgattctttgtatttttagcagaaatggggtttcactgtgttagtcaggatggtctcaatctcctgaccttgggatttgcctgcctcagcctcccaaagtgctgggattacaggcatgagccaccacaactggcctattttatttttttgagacagagttttgctctttttgcccaaactggagtgcagtggcgcaatcttggctcacctctgcctcccgggttgaagggattctcatgcctcagcctctagagtagctgggattacagatgcctgcctccatgactggctaattttatatttttggtagaggtggggtttcaccatgttggccaggctagtctcgaactcctgacctcaggtgatccgcccgcctcagcctcccaaaatgctgggattacaggcgtgagccactgtgcctggcggaacatgagttttttaaaaagaaaattaaaaaaaagcagtatcgaagaaagtaagttagtgaaatcctaggatttctcatgaatattctttgattggagaaaatttcaattggtggtggtgaatggtttgcttgagaattcccattatgccatcctggtttctcaacagctgcagaaaggacagttgggatgtgccattctgtaaagtgatgagccagaaccctctggagtggtctacatgtctggctggtagagggggccagagtccttagcagaggcagttacagccctaaccaagatttttcttcctttgccccacttacatgttccctcgggccatagaacagtatttagaaagccatacctattcttccatttgcagagaagatgactacatgccagaaaaagtgggaacaatcaaggagaacccacccagactatcccacgccaaagagaaaggctgccacaatgtacctgagcaggagggtggggaatggcacaaatgaggcgaatatattcctggaaaagaaaattaaagcaacatagtatgccaaaaataaaatcgccacgtgtaagaaacataaagagcatgcctcgtaagtgctatgcactataaaagaacttaataatataaataagttctatatttctatatttcttctataaaagaacttaaataatgaagtattcaaaaacaaaatgataagacagccagatgggctaaatgtagttcagacatttgagtgccctgaagatataaaattagaaagaaaaggaataaagtagatgtggcttaaggtaaaccttgtcttagaacaaagtcttgatataattagagtgagtgcagaagaaaaggacaaagattaagacaattagaaagaacttgtagggaggacaaataaagatcatccagtatactataagaacatgtttttgaggtggaaaacctggtaaaggaacagtaataatattcataatacagaaattccccataaagttaaggaagaattgatagattctacagattgataaaacatatcttgttccaggaaaatttatacagaaagaatgatccataccaagacagatcatggttgaggaattaaatttcaaggataagtaaaagaactaggaattcaggaaacaaaataaatgctccacaaggtggaagagtcaggctacaaacttctacatagcagaattgagtgacagaaaatagtgaagcagtagctacaaagttctgagtaaaagaaattgatattcaagaatattataccagacagtttaacaataaaaacaacaggcagattttcttagacatgaaagcactgagcaattatagcatctaaaactgaaagaggccgggcgtggtggctcacacctgcagtcccagcactttgggaggctgaggcatgcatatcacctgaggtcaggagttcgagaccagcctggccaacatggcgaaaccctgtctctactaaaaatataaaaattaactgggagtggtggcgcacgtctataatcccagctactctggagtctgaggcaggaggctctcttgaacccaggaggtggaggtggcagtgaggcgagatcgcaccactgtactctagcctgggagacagagtgacactctgtttcaaacaaaacaaagcaaaacaaaacaaaaaacctgaaagaatttcttttttttcttttttctttttttgagatggagttttgctcttgttgttcaggctggagtgcaatgatgcgatctcggctcactgcaacctccgcttcctgggttcaagtgattctcctacctcagcctcccaagtagctgggattacgggcatgtgcccccatacctggctaatttttttgtatttttagtagagatggggtttctccatgttggccaggctggtctcgaactcctgacctcaggtgatccacccaccttgacctcccaaagtgctgggattacaggtgtgaaccaccgcacctggcctaagaatttcttgatgaccgaatccagccaaacaaagaatggatgccatggtaagaggattggtagttagccataaacccatctttttttttttttttttaaaagagacaaagtctctaaactcctgggttcaagtgatcctcctgcctcagtcttctgagtagctcagattacaggcgcatggcattgtgcctgacaaattttttatttttgtagagacagagttgctatattgcctggactggtctcaaactcccagcatcaagcgatcctcctgccttggccccctaaagtgatgggaaacgtgtgagccactacatccggcaaccagggcacaggaaaattaagaaaaacattgagtatggaatattctcttttagcaagaaatcagactgctttaaaattctttaaaattcgaatgataaagtatagttatttaaatgtgttttgtaattttaatttgttttaaagatgtttaaagatggtgttacgagatgacaaaagtcagtaaaatggggaactttacaaagtctgcaagcctacagagtttttttttttttaaaagacaaatgagtctggctctgtcacccagactgttgtgttgtgcagtggcgtgatcttgactcactgcaacctctgcctgggttcaagcgattctcctgcctcagtttcccgagtagctgggactacatgcgcgcaccaccacgcccgcctaacatttgtatttttttgtagagacgggctttcaccttgttggtcaggctggtctcgaactcctgacctcaagtgatgcacttactcggcctcccaaagtcttgggattacaggcgtgagccacggcatcttgccctacaaagatttctttatgtgaaaatttgctgttaggtttttttttttttataccacagtttatttatctatttttatcagctgatgggtgtttggatcatttttactttttgacaattatgaataattctgctgtgaatattcgtgtacaagtttttgtttgtacgtatattttcctttctgttagttagatacctaggagtggaattgctgggtcatgtggtaactctattttatttaactatttgagaaactaccagatcgttttcaaagtataccattctactggtgttaattttaaaaggcaaatacattaatttaaattggagatttcatgcttagttctaccagaactcctaatattaaattgtacttagcaaagattttcgtagtttatttaaatttctgagattttatacattaaattatatatttatttatggctgagtagatttgttcttctaaaaaggattggcaggctgaaatgggaagtagtctgatttctagatagaaaaagagcattccatactcattgttttctgagttgtcctgttccttggtaccttagtttcttctccagtactgggtatggtatgcctcaccttctggctttgataaatctcagaggcagagttgctggaaatgaaatgtaatacttgaaaattatgcttttgtaggttatgttctagctgagggggcaactgagggcagaagtccagctaaggcattacttgggtagattacctctggccttagtggaggatgaatcttttgattataatagctttgtagtaagctttaaaaggtgaagtgtgagttttccaactttgttcttttccaagattgtttggctgtttgtaatcctttgagattccatatgaattttctgatgagtttttctatttctgcaaaaaagccaatggcatttgatagagattacattgaatccacaggttgctttgtgtagtattgtcatttaatgacattatcttccaacatatgaatttgagatttcttactatgtattaagtcttttatttcttcgagcaatgttttgtggttttcagtgtttaaagtcataagcctccttggtcatatttattcctagctatgttcttttgggtgctcttataaatgtattgctttttttttttgagatggagtttcgctcttgttgcccctgcaggagtataatggcatgatctcgggtcacctcaacgtctgcctcctgggttcaagcgattcttccgcctcagcctcccgagtagctgggatagcaggcgtgcaccaccatgtctgactaattttgtattttttagtagagatgggtttttctccatgttggtcaggctggtctcgaactcctgacctcagatgatccacacgccccggcctcccaaactgctgggatgacaggtgtgagccaccgcacccagcataaatgtattgttttttaagtttcatgtttggattgtttaatgctagtgtatagaatacaacttagttttgtgtgttgattttgtatcctccaacttcgatgtatttatttgttagctctaatagttttttttttgccaattctttagggtgccacatatggaatcatgttgtcttgaataaaaatgcttatttctttttaaatttggataccttttatttctttttctttcctagtgctctgaaagtaatttccaataccatattgaatataaatggtgaatgcagtcatctttgtcttgttcctgaagtttcccattcctgaagttttttgtgatgtcactctgaattttaagataatggaattctatgtgttgaatgagatttaaaattttgaagtataataattttacagaatttagcattcaggccaggtgcggtggctcacacctgtaatctcagcactttgggaggctgaggcaggtggattgcttagctcaggagttcgagaccagcctaggcaatatagcaagacctcatctctacaaaaattagcctggcatggtggctcgcgcctgtaatcccagctaccggggaggctgaggcaggagaatcacttgaatccgggaggtggaggttgcagtgagccgagatggggcactccagtctgggcctcaaaaaagaaataaacaaacaaaaaaagaatttagcattcatttcattgtctgtcctcaatatgaaacccagcaattctgttttcaatgaaatattgctttgcaaagcattagtttacaggttggccatgagatacaatatcacctctgtaaacacctggtagaaaatgaaaagtcaacttaatgagcactcacgagcaggactcaacaatacatcctgtaaagaaatgaaagattctgatcttcaagtcatgtatttagggaagctagacagaatacatgtttttggggccaggatgatgttttagaagcaatgttggatttctcctcaagagacttgtctttaagactgaatggtacctcataagtgaagtcatttctctttctatgtagcaatagctgggagatttttatttcttgcttgtttttattattggttgaaaaatggtggctcttctggtttatattatcccaaatttaattattatggcattttaacatttaaaaatattagtttatagatattcttcagcaactaaactttctgcaaatgttctgttttgtctttcacttctagattagtttttaatcctccccccaaaccttttttttttgttttaagacggagtctcacattgttgcccaggctggagtgcagtggcatgatctcagctcactgcaacctccacctcccaggttcaagcaattctcctgcctcagcctcccgagtagctgggattacaggcgcccactgccacgcccagctaattcaaaccttttttaaaaattagactagaagtttaatggtactatagtgaggtatatattctttgggggtgggaacagaaggggtacggattcactttgaatgtaagcatgactttttcatttgttatttcaaagtctaaccagggatgttaccagggagttgtacatcacttacaaattttcaagtgtttattttctttgtatgtattaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggtaaatatttgttctcttaccctgtagagttgtaggtttgtaatgtttatttagttatactcatgcatagcacctcaaagaaagtccagttacaccagtctctaaaggttagtggtatgggaaagtaaaaattttgttaaacaaaactagaaaccacagatgagtgctccagactgctaaagtgagcacttttgccttttcggtaagtgaaaacagtccaagaagactgctcccataaagaagaatttctattaaataatgctcaagcatttttttactggcttgctggctataaaatgtggtcagaggtactcaagactactagttttgttaaatcttaattaaattttaaacaagtcccttaaatttagtagcagtttattaactgctatatgggagaaaacacatccaggtaaggttgaattgtgcatataagttctatacaaaagaaaattgttcctaatttatgtaagtaatacatacttatagaaaactgggaaaataaagaggaaaaaagttacctgtaatcctgtaacttggagataacgaccctcccccagttttattgtggaataaaaattgtgtatatttatggtgatatttatatttatgatgatatttatacagtgtgatattttgatgtatgtatacattgggaaacacatcaagctaattaacatattcatcacctcacatagtttttttttggtggtaagaacatttaaaatccactcgtagcaatttttaaatatataatacatattattagctatagttgccatgctgtacaaagataagttttaatatttagctatattttgtgacatttcaaacaatgcgagttctattaagaactttccccatgcacttatttttatttacccatcttttgtgaaatgtttgctcatgtagtatgtccttgttttattgctatgtttacctttttctttttttttttttttgagatggagtctcgctctgtaccccaggctggagtgcagtggcgcgatcttggctcactgcaatctccgcctcccgggtcctggttcaagcaattttcctgcttcagcctcccgagtagctgggattacagggacgcaccaccatgcccagctaatttttgtatttttagtagagacagggtttcaccgtgttggccaggctggtctcttgaactcctgacctcgtgatctgcccacctcggcctcccaaagtgctgggattacaggcatgagccactgtgcccggcctatgtttacctttttcaactctgctttgcttattattaattctgcagattaggaagtgcctgacacttagtagatacagaataaatatttgtcatagaaagaataaattaattttaaaaactcttaacagtaaagtgttaacctttttaccaacatacgctaatatttttcccagtgtctttttgtttcagtttttctttttttaaagcatactgaagtttaaaatgtttttactgccatcaaatcttttttctgtgtttattaacctttatgcctaattgccctttcttccctgataccagataaataagtacccacacattttctttgagttttatgcaatgaagagtaatttaaaagatagtaaatgtatctacaatttattttcaaatagttcagccaaaatgaagttatacacacacacacacacacacacacacacacacacacagaaagcaaatatgttaaaatgttaactactggtgaatctagatgaaggataaatgagtgtccattatattgttccttcaacttttaagtaaatttgaaatttttcaaaatagtaagttggatggggaaaaattctttgccgtaagctagaaattagctaagcttctaggtgttttgtgacccaccttatcatgtgaatcatctttatcatacagtagtctgtggggtttataagaaatgttctgctgcattaaaaaaaagaaatttaaaaatatagtgaataaaggtcatcttccatggctgaatacattaccacaaatgtaatttgtaactatagaattttgttttttagcagaaaagtgtcttaaaaactcattcattaaaatgggacgtgttgtgttgtagtgtgacccatttccatgttatagttgagaaactgggtgttcagaaaaattaagtgacctaggttagtaactcctgagttgaaattaacccaggaccccgactctagtcctgctttttttcccctaaagtgtaaaccatgactacttctactaactaatacttctccttccatctccctctccccattctctcccaactgcccacctccagaagtaaggatttaaaaagaactaacatttgttagattttttgttaaatgttaagcctaggtatatcatttatagaagagttaaataagcttgaaagaaaaaattacctacagtttaccatttaaaagttattaacattttcatgttgattcttccctatttgtatgtgtattattttaattttaattttatttaattttatgggttttttgttgttgttgttgtttttttgctgctccttgtggaacagggctaacccataaggcagtgtgtccagagtcagcccgtatgaatattttaatgtgccccctttgtacattctgtttaacttacttttgcttaaatacgtgcttagcttctttttgtgccaataggtttacaactgtattgttagtggctacttagtattccacatatgcataaataaagttcattgattaaataaaattatttaatcaattgtcatacatttaggttacctgtttgttcagaagtacggtgttgtgacatgcattgtttttttttttttttgagacggagtctcactttgttgcccaggctggagtgcagtggtgtgatcttggctcactgcaacctatacctcccagcaattctcctgcctcagcctcccgagtagctgggactacaggcgcacgccaccaagttcagctaatttttgtatttttagtggagacgaggtttcaccatgttggccaggctggtctcgaactcctgacctcaggtgatctgcccgctttggcctcccaatatgctgggattataggcgtgagccactgcagctggcccatacattatttaggttgatttttttgtatacattcttacttatttccttaaggtagatttcttttagtataattaattgtagaccaggttgatttttaaggtacggtgggtatttccagattgtcctgcaaaagagtagggccagttcttaactcctgacagcagtgtataaaggtacccacttcttggctgggcgcggtggctcacgcctgtaatcccagcactttgggaggccgaggcgggcggatcaccagaggtcaggagttcgagaccaacctgcccagcatggtgaaaccccatctctactaaaaatacaaaaattatctggacgtggtggcaggcgcctgtaatcccagctactcgggaggctgaggcaagagaatcgcttgaacctgggaggcggtggttgcagtgagctgagattgtgccattgcactccagcctgggggacaagagtgagacttcatctcaaaaaataaaaataaataaaggtatccacttcttttttatccttgctgacaccacatgtctattgtttaacaaaaagattgttaatttgatgaatgattgtttttaacttacacttattatttgttagtaaaacttaactttttttatttgtttattggttatttttcctgttttgtaaattgttttttcgtatatgttgtccatttttctgttggtttattttacattgagttgttagagtgcatgttttgcaaatggttttcctatttaatcgtttgcctttttaatttgttattactgttttgataagcagaagattgtgtttttgtgtgtgtggttttttttttttttttttttgagatggagtcttcttctatcacccaggttggagtgcagtggtgccatctatgctcactgcaacctccgcctcccgggttcaagccattctcctgcctcagcctcccaagtagctgggattacaggctcgcaccaccacacctggctgatttttgtagttttagtagagatggggttttaccatgttggccaggctggtctcgaactcctgacctctagtgatctgcccgcctcggcctcccaaagtgctgggattacaggtgtgagccatcgtgcccagtggaagatagttttttattttatccatcaatctttcttttttaaaaactaatgtcttttatatcttttgcttttggccttcctgaacccaagataatgtgaatcctttattattatttttttttaacttgaggctttttgtgatttgctaataagcctcttataaatgtttgctattacttggcttttttttttgatgtaagatatgaggtaagaatctaattctttttcttcaggattggtatctggctgtttcaagccaagattgtaaggttcatgaaggcagatatcttgtctgttttgatcttattcctgttatgtaagtaggcacttgaggatgtggtttcttgttaaatatttaatatttagaaaggaagtcagtggaaaatattcatttgtaatattaattctttgggcatgcatcagaatcacctgaggagcacttttgaagtctgctgaatcaaaatataatctcttttgctattatatatgtttctgtaacacaaatttgctcatatgcatatagtgggagaatgatattaatgtatcatgaaagtcctggtggttcaccaaagatctttctttatgcgttaacatttctaagttctcaggagtacgctgtctcataatgaaagagaaaggcttcacaacacatgaagacttaaaaatatgtaaacattctgcatttagttttcatttagtgcgagtagtagctggtttagtgaatttaagaactgttgtgcttttcacagtgttagtgaagattcgagcattgaaaagacaatgtgaagacaaattttcttgtatttttttttttaatgttgataaaggagggagggggagaaaaaaaggttgataaagatggttatacaccaaatctgatttttttttctttttttttgagatggagtcttgctctgtcacccatgctggaatgcagtagtgcaatctcagctcactgcaacctctgcctcctgggttcaagccattttcctgcctcagcctcccgagtaactgggactacaggtgcccgccaccacgcccagctaatttttgtattttttagtagagacggggtttcaccatgttggttaggctggtctggaactcctgaccttgtgatctgcctgcgtcagcatcccaaagtactgggattacaggcatgagccactgtgcctggccactgatattttatttagatgaaacatactggtttattttggaagccaatgacctcaaggatttacatcttaagagaggaatcataaactctagggcttaaagctgccaaagattgactgtatgccagatgcaaaggatactggagctttaattctattaagtctattagagttgttattgcttttattggtgttttccttacagaattgtacaggttttagggtatagccataatcttattttcccagaaggcctcttagattcagcgcatactattagagaatatgaggcttttcatcaatgtatattagctgaaatatctgtactaaggtgttttgaagcaactgtccagttatctcctgtatgcattcttggctcagaactattgacttttcacagttccttaatcattatttaatacattttagggttctgtaatcctgtgaactaccctcattgtaggtttctcatagtctaagtaaaattagtactctaaaatttatctgttttataatattgcttatatctttacagcagactggaaattaatagggtgtgtgtggatgtgtgttggagggtagtggattttgggtgaaggggctttcattctgctacagctctgctgatttggaggcgcaatgggatgtttttggctaaggaaatgttatgtatgctgtagtgtgggctttatgaaagtaggcctagagatagtagcaactgaagttcctaggtcacttctctgactcgtgtacctcagttttggtttggaaagcctgaaaacttttgataggaacacttggccatgttatagttgttaagttgggtggacacacaggttttacctggaataatactatttcccagccagttgttcagaccatttgaagagccgttgcaaggaaatggctgagaagttggtatcttcctttgtcatgattgcattatttacctataaattctctataatttcagtattgttatactagaggctgatcaacactaactcacctcactttgtatagcttttagggtcttcaaaatagtacatggtatatctaaactataaaagtgaggtgagaatttgcatgtatgtgaatatgaaagttactactaaaagtttcattagacaaatagtacacatggctctgctgtggtttaaaactgactttttcatttaaggcaatctggactctattagtgagaaataaattgtttttcttggttttattctctaaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaagtaaaagtctttgcctaatatattctaagaatgtatgtttgtctccctacagaagatatttttgagttttccatattttgaaactttacataaaaggaatcatgccttatatattctgacttgctgtttttttgctactgttgtggttttcttacattcattcattttccttgctgcactgtctgattatatgattgtagagagtgaaatttgtttgtccattctatttttgatttttttttttataatccatacaagtggtgctggtttttggttcacatgtagagattttctagggcatgtgcccaggaatggcagtgcttggcccaagattatgtacagtgaactatttaatagatgatactaaatttgctaagaagtaacaccattttacattcctactggcagcttatgtgagtaccggtttgtgcacatttttgcctttgcttgatatcgttttttcagttggatatgaaatagtcttctctgtggtttggaaggaggctgagcttattttcatttgtttatgggttatttgggttccttatgtgcattgttcaagcgttttgtctatagtctcctattttgtcattgaaatttttaggatttcctgaagtcccttgtcagatatgtgtatagaagatttgcctagtttttggcctgtcacttcacttttagcccagtattcactctaagtgtagactaagtgcattttagtgcattttttttttttttttccagatttggagtctcactctgtcaccgaggctggagtgcagtggtgcgatcttggctcactgcaacctctgtctcccaggttcaagtgattctcctgcaacagcctcccgagtagctgggactataggcactttaagtgcttttaatgtattcataaagttgtacagctatcaccactctctaattctagaacatttttatcatttcaaaaagaaactccatacctactagcagttactccccatttccccttttccccaacccctggcagccactagtctattctctgtctctatggactagcatgtgccaaatatcagaaaaaacagaatcatatgtgaccttttgtgtttggcttcatttatttagcatgttgtcctgattcatccatgtcgtatcttgtgtcagcacttcattactttatatgcctgaatcccattgcgtgagtatactatgttttgtttatccattcattagttgatggatatttgagttgtgttcattttttgactatgattaataatgtactgtgatgagattcatgtactcgtttttgtgtggacgtatttttacaattttctttatatatctaggagtgggcatatggtaaatctatgtttaaatttttgaaaaacttcaaaactgttttccaaagtctctgtaccattttatattcttaccagcagtgtatggaggttccattttttcctacctccttgccaacatctgttattttccttttttaaaaaaatatagccatccttgtagatgtgaagtggtatctagttgtagttttcatttgcatatccttaatgactaatgatgttgagcatcttttcatgtgctgattggccatttgtatatctttttagagaaatgttcatttagattgtttgctcatttaattgggttgtctttttgttattctaagaattctttatatattctggacattagttcctcatcagatgtatgacttaatagatattttctctcattctgtgggttcttttcactttcctgatagtatcctttgatgtacaaaagttttgaattttgttgaagtccagtttgttttttccttttgtcactcttgcatttggtgttgtatctaagacccattgcctaattcacggtcacagatttatacctatgttttcttctacaaattttatagttttaccccttatatttgagtctttgatcctgatagtattttttttggtgaacagaatttgtttaggttttatatgaaaaccccctggggtttattaaggtagttttactatattattttttagaagttttatagttttgcttctcatcttattcttaatccactggaaactacatattgtatagtcagtgttcatttatatttacccagatatttgtcttcttaagtgctcaccatttcttctcacaactcaagtcttccatcgaagggaacacccttctactgaagaacatctcttagaatttcctttagtgaaggtctcttagttggcaaattcagtatttgtttggtttttatgacttaaatattgtcttatatttggcctgtttattaaaagatatatttattaatttggtatgtgattattttttcttagtacattgtcttcttgcttccatttttaagacattagctcttggtctaaatccgtattctttcatggatagtgtgaattttctctcaggttgttttcagtatattcttttcttcggggttctgttatttttatgatgatacatttaggtgttttttttttttccttttaaatctgtccaacctgatattcctgaatatgaagggtggagtttttcatcactttgggaaaattccaagccattatcttttttagaaaacctttctaacagtttcttgttctacttatgaaattcctgttagttgtaacatcttatcactcttgtcttccgtgtctcttgtttctctttcttatttttaacttctttgggcttcattctgagcaatttcttcagcctgtcttccagtttacattttccttttcaattatatgtaatctgctgtcaaatctgtcttcaatttcaacaattatgtttttattgctggaatttctgtttggctccttctcaaatctgcctggtcattaaaaaaaattttttttttgctttcattgagttgtattaaatttttattatatgcccaacaattctaattaagtctttactggtttgatttcgctgagtctcttttcttttctttcttttgtcttttattttctttacttgtacaatggtaataatctagtaataacaccaactaaatcacatgattgttttatgaattgagataatgaatatattgcataatatctggtacatagtaaatgtacatgcaatccactataataattagaaataatgaaatataatgtatgattattatgaaatgtaccagagccacacattttattgagagatataaaagacaactagagaaaacaaagaaatatgccatagctggatggaaacagtgataataatgttctgtgttcatcttggactaaatcatgtctcacacaatttcaataaaatttcaattaaatttatttttaaaacatggcaaatacattgtaaagttaatgtaaaagaacaaacagggccaggctcggtggctcaacctgtaatcccagcactttgggaggccgaggcaggccagatcacctgaggtcaggagttccagaccagcctggccaacatggcaaaaccccacctctactaaaaatacaaaaaattagctgagtgtggtggcgggtgcctgtaatcccagctactctacttgggagactgaggcaggagaatcacctgaacccgggaggcagaggttgcagtgagctgagattgtgccactgcactccagcctgggcaaaaagagtgagactccatctcaaaaacaaaaacaaaaacaaaaacaggtgagggagtgtgtgtgtgtgtgtgtgtgtgtgtgtgtgtctgtgtgtgtttgcttttagcctttgaattataatggttttgtcccagggctatttgggtactaagaacaaagtgtgatttgtttattccttaacaaggattctaaaagaaggccctctaagcaggaaagaaagggaatcattgaagaaccctttaccataaaaatgatctcagaatttcaaatatctttcttttgcttgtacagataacagactgcaagagtacttataattccaaagtggaagtgttccttacagtttagactctcctggtggctatttattattatttttttaaatttttttcgaattgggcagcctcctgagccagaataggttcagaaactccctcttggtagatttttatgctttcatttgggcatggtctgatttacagtactgggagctttgactgtcactcttatttatttagtttttttgagatggagtctccccctgtcgcccaggctggagtgcaatggtgcgatcttggctcactgcaacctccacctcctgggttcaagcgattcttctgcctcggcctcctgagtagctggggttacaggcttgcgccactacaccgagctaattttttgtatctttaataaagcaggaatttcaccatgttggctaggctggtcttgaactcctgggctcaagtgatctaccgtcttggcctcccaaagtgctgggattacaggtgtgagccattgcacccggcctatcagtcttatttagtagtatagataatttttgcctatagactatactagacttaaccttaatttgtctttacctaatttttcttttatcatcttaggtagtggacttatgctaaatttattcgtgtggatatttttaaagcattaactaggtgtcaggcactggtttaggtgttgaaaaaaagcagcggacaaagcagacaagtccctgcttgcttcactagtaatactcggtaatatttacaatttataattgtaatatgctttatatatacgttaagtcatttagtcctttcaaaaagctgtatgataggtagtattattatccctaccttatttatgagtagtttaggtgtttgcttaatattgagttaagggagccaggcgtggtggctcacagcggtaatcccggcactttgagaggccaaggcaggtggatcacctgaggtcaggagttcgagaccagcctgaccaacatggtgaatccctgtctctactaaaaaaatacagaaattagccgggcatggtggtggccgcctgtaatcccagctactcaggaggctgaggcaggagaatcgcttgaaccctggaagcggaggttgcagtgagcgccattgcactccagccttggtgacagagcaagactccatctcaaaaaaaaaaaaaaagattgacctaaggacccagaaaggttcctaggatcacaccacctgtaaagggtgaccctgaggctcaaacccaggcacggtaatacagttagctttttctttatacttgcacacaccaatagtctatatttttgtaattttgttgattgccctttgaccggagcactgtaacacatgaagattgggtgttgagggtggcatggtgccatgctgagttaagggttaacccttgatctcctttctaccatattctgcccagcaaatattaatgtatactgtgtatctataacatataagagtgttttttcagtgctgtcaaaggtcattgtgatagaggtatgtagagtaccttcattaaatttaacttctcttattattttgctttaagtttgtcagaattaaaatctttttttttttttttttttttgagatagagttttgctcttgttgcccaggctggagtgcagtggcgttatctcgactcactgcaacctccacctcccgggttcaagtgattctcctgcctcagccttcttagtagctgggattacaggcatgcgccaccatgcccagctaattttgtatttttagtagagatggggtttctccatgttagtcaggctggtctcgaactcccgacctcaggtgatccacctgcctaggcctcccaaagtgctgggattacaggcatgagccactgcacccggcccagaattaaaatcttaaaggatgcttcctcttagtttttttttttaaactctatctaatgaaaatttgtgttgtttggttatgaaataaatctgattaattctctttgagctcttggtccatgagaccttcatggattaattggttaccctacagaatctgcaagcaaagcttagtagcctgtgttatctccagtggttaatcactgctgggtgtggtgtgcagcacatgcttgactctttctttctggatctcttagcaacagcttgaagaagaggcagctaaacctcctgagcctgagaagcccgtgtcccctcctcctgtggagcagaaacaccgcagtattgtccaaattatttatgatgagaatcgggtaagctcataccatctctggcagcacaggcctttaaccccacttgacgatgcccttttcagttttgaatgtatcctggtataattttaactttattaaaacctgatttctcttacaattttgaatgttcataaactttggctgactgaagcttggtgtttttttccttatcaattgaaagaaagtttacagttgtgccttaaattatgtaatatttcattttacattatgtattttataaatatttaatcagtgaaattttgtcagctgagtctcctattatatgaattctggcaaggaagcttggtagcatataatacaaaacaaccatcctgcagtttttcacttaataaatgatgtttaatgctgactactgataacatttcagtaaagataggtcattgcatgtggaaatgaactttcttatcagcattagttcacagtcgatagttgggctatggtttgaacttcagttaaaaagttcaaggcggggcatggtggctcatgcccataatcccagtactttgggaggccgaggcgggtagatcacttgaggtcaggagttcgagaccagcctggccaacatggagaaaccctgtctctactaaaaatgcaaaaattagccaggcgtggtggcgcatgcctgtagtcccagctactcgagaggctgaggcaggagaatcggttgaacctgggaggtagaggttgtagtgagccgagattgagccacttcagtccagtctagacaacagaccaaaactcaagtctcaaaaaaaaaaaaaatcaaagttcaaggtagattttgacctttaggtagactttgcttttttaggtttactctcatactcttaattaaaaatattcatggattcagaaacaccaggcatgaattctatgaatcatttttgtagtatcaaagttagttttggccagaatatggcccaggaactagcagttagagggaaactgattttacctcaacatgaagaaagtgtctgtttaacagtgggcttccagaagtccacagtgcaaaaaatgataatatgctttatactgtgggatagaatagggtttttagctaaaggcatgatcatcaggtaaaatttgggattgttgttttgattgatttgatttgtagtgagtggattcatctgtcagtctatcttacacatacagtctgtaactttatagtagtccacagccgaaaggaaattgaccttaaataaagcaattgtgaattaataaatatttatgcacatgtactcctgaatttaaaagttgaataaataaataaataaatacacatttataggaatgatcttggatttagatatacatgtatcaagtagataactgagagtcatcagaaatatacttacggtaatggtaagtgttatgggcaggtaaaaatatgggcaattaatattattttcttggctgggttcaatattagtccaatttattgtatggccacagcagtctacatgaagataaatccagtaaaggaagggaaggaggtgaccatgcctaagatgggggctgtgttccaggatatacagttgctcccttgtttaagaaaagcccaaaataatggggttttatgtgaaatctctgatttgtttttttaaaaaaaaaaagtcctctgcatagctgcaaaacacttttgtgggctcatgggctccatggccagtttgtgactgtgacctcagggataaaataaataggaattagtggtgatacaaatggagatttgatagtttttttttttaagttttataaaatgtttcttttttagtatgaattatttttcaaataaattggatttggtaataattattaatggatttattaatgagccttgtcttacaatattagtgaattctgtggttgcctcactgggatttgaggactgaatactattgaacaagatctgatctaatagagaatttaattggtgtttaatttttatatatagatgtttttattaattagtatagtgtttcttggtgcacattagcaaaacttgaaaactccttttgcacctcttctttctgtttgaacatttccatatttggtttgttgtttattttatgaagaaaaccaaatctgaaacctgtttcagtgttaaacttgccttcctacactgaagattgtttctaacccacaacaactatagaagtcatctttcttttccttttttcttttttctttcatttttcttctccaccctctcctttcttttctccccctcctcctccctctcctttccttcttttcttttcttttttttttcgctttccttcttttcttttcttttttttttcgagacagagttttgcttcgtccccgaggttggagtgctgtggcgcaatctcagctcactgcaacctccacctcccaggttcaagcaattctcctgcctcagcctcccaagtaactgggattacaggtgtgagccaccacagtcagctaatttttgtatttttagtagagatggggttttaccgtgttggccaggctggtcttgaactcctgggctcaagtcatctacccatcttggcctcccaaagtgttgggattacaggcgtcagccactgcaccaggcctcttttcttttattccttcttttctttctaacagacagtgtctcattatgttgcccaggtcttgaactgctggcttcaggcgatcctcctgcctcagtctcccaaagtattgagattacacgtgtgagcccccatgcctggcctcatcttttctttcttatgtatgttttatacatgtacctgtgcagtttcagaattgtaacagggagctcccggaggggaggaggagagcacaatgggcctagaacccaggctttctgatatgtactccccaaggctttttctgccccagtatgctgccttttgaaaggccctccctgcctcttttaacattttttaatgaatgagcttatctgtttcagcaccataggcaaggaggaatggggtaattacagaagtacacctccctcttatttcttgggtggcagcagttacactagttggaattaagccaagtgtggcttaagagatcgagggaccatttcttttatttagaaaggtagtgggaggaaaaaaactgccccaacgtgttaattttaaagttgacttcctgagaaaagttgacttgcatcatagttaaatttcagtctaagtttgtttagtctctaaacagactatttttaacagttcaatttgattttaccctatcagttgtaagttccaaaaatatttgtaaatattctaatttcagaagaataatacgtatagaaaagtgattattgttgggctctactagagaaatttgcagaatatctttgtgggtgtgtgtgtgtgtgtgtgtgtattttttttttttttttttgagacacagtcttgttctgttgcccaggctggagtgcagtggcacgatcttggctcactgcaacctccacctcccgggttcaagtgattctcccgcctcagcctcccaagtagctgggattataggcacatgccaccatgcctggctaatttttgcatttttagtagagatggggtttcaccatgttagcaggctggtcttgaactcctggactcaagtgatccacctacctaggcctcccaaagtgttgatattacaggcgtgagccaccatgacctgccttgtttatattttgacgggttgatttgcaagagaatgtgacttcagaagaaagaaaagggtgatggtaggaagtatattctgtgccagcacctctggtcatctaggccagcatcctaggaattatccagttctctctctttgccacttcatgtatgttgaggtaatcagtgaagagcgttagtcccacctcctaaatattggtctggtcttacgcttctttcctctacctttatcattagcttaatttgagccttcatctcccacatagttattgagtctcacgcttcagtcctttctttctaacccatctttcatattttcgtcccatttaatgattctccaaatagaacctttttatgatttcccactttatacagaatagccgaagcctttattgatgtttacatgcttacccgcctggcccttgccccatactcttttcttagtaacatcccaccagaagaggttttggatgttcccttgttagcaatatctttaccccgctatgttgcccctgctgtcaggtggccccgtgttttgtcttttctgccaagcacactgttacctcaagccccagttcaagtatcattttctctaggaagactttcaagacccctcatcttcctgtggtgggaaggcttatcttattcattattttcttagtgtctagtgagtgcttggcacatagaacataccgaacatatgttgaagaattatttacttctatctgtagacttagaatacaaattgtattacgaacatatgagggtcttaagttaaaatttttgttgccaaaatattgatagattaatcttagcaagggaagatttttgctaggtaacactttggtctggattattttacttttgaaaatagcaactgggtgctgtgggtcacacctgtaatcccagagctttgggagactgagatgggggcattatttgagtccaggaagttgaggctgcagtgagctatgatcgtgccattgtgtcccagcctgggcgacagagtgagaccctgtctcaaataaaaaaaaaaaaaaaaaaaaaaaaaggaaatagcatattacaaatacatataattcagcattttttaactactgagcactttgaataattcaaattagcggttttctttgttgttcagctattactaaggattccttgtaactagaaaattagctcattaacagcttttcttcaaagagatcaatgttgctcaccatagtaaagagtggccattttatggtattttattgctttaagtttctattaaagatgatatgagttaaagtatgtagaatgtttgggggatttatttctaatagtgaattttcattccctctctccagttttttaatataattgtttgcttttttaaaacttacctattattcaggcattgctttcaatacaaatgttaagttttgactgaatttggtgaggaaagctatgacaatacaatttcagagttttctatcattgtaactacaaattaagaaaaaataaaaaataactggagcatatttcagcctgtcatatagaagaaggatatttggaaataaggataagttcatctatagattagtcttagataaatatttctaaataattattttgcacttagataatgtaatttttaattatatgatacaacaatgtctttatctctagaaaaaagcagaagaagctcataaaatttttgaaggtcttggcccaaaagttgaactggtaagtaaattttttcatttccagtgatttttttttttaatttttggtggtagtttttcttgggataagatggaatatgatccatttattttgggataagagagatgtagctgagcagagatgtagcttgagatgaagtttaaagtaatgatgagtgaacttggttacctttgcagacctttgcagaaacatcaccctgagcttgtttttacttgagcagctatttaatccttccaggcagaatgagaattaagaacagaattagaaagctctttgaatgttactgttaaaatagtgacaatggttaatactccctagtattagggagtattaatactttgaaattaaaaatctgtgcataaatatacttatgggaaacaatggatttataaactgtattatgggagtgacaggagatgggattaacagttactcagggaatctaaaagttaggaggttttgccacaatgagataccatctcataccagttagaatggcaatcattaaaaagtcaggaaacaacaggtgctggagaggatgtggagaaataggaatgcttttacactgttggtgggagtgtaaactagttcaaccattgtggaagacagtgtggcaattcctcaaggatctagaactagaaataccatttgacccagcgatcccattactggatatatacccaaatgattataaatcatgctactgtaaagacacatgcacacgtatgtttgttgcggcactattcacaatagcaaagactgggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactgtcgcaaggacagaaaaccaaacactgcatgttcccactcatagatgggaattgaacaatgagaacacttggacacagggcggggaacatcacacaccggggcctgtcagggggtggggcatgggggagggatagcattaggagaaatacgtaatgtaagtgatgagttaattggtgcagcaaaccaacacagcacatgtatacatatgtaacaaacctgcacgttgtgcacgtgtaccctagaacttaaagtataatttaaaaaaataagtaaataaaaaaataaaagtttggaggttttggtagggcatgttattgtgtagatccattagtactttacctgtgcttacattaaaattatgtttctttgtctcttcatagacatatgtacaacattttatacataaatatttgatttcttttatagccactgtataaccagccatcagataccaaggtgtaccatgagaacatcaagacgtaagtattgatcatctttggagttcttcaattaaagaccgtatattctataaagagatcatttttgttatctgctgacattattataatatattgtaggtatgttttagatttgtgtaatttgctgtcgttttattatatgttatcttcctctggcttcttgggggttggggtaacagctttgagtttccgaggccaaaaaatgaaataaattattgcataaaactagctggttttataatctgctagtaaaaaaggtggatacttaacattgaaatggcttaccttgaggcttgaattttttgcctcctgttttgtctttttttcagtggagtacctgcaaggcgcatgatgaagtaagataatgaagctttttcatttaagactagtgatgacaccgtcccccaccaagccacatctgccattgcaaagtagaagtgccacggatcattttatcattattcaaaatcctattctagggaaatcccttccatgactcttgctaatgacggtatttgtagacccttctgccatttaatgtcctggtgccttggaagcgctcagtcaccttgtgggtgacgaggctgctccagaatgtagtttgcttagccttgctcatcctagtaccaggcctttatggatgcagattttggaataagaaaataagtgaaaagaaaatctaatttcttgatctgattgaagtaagagaggaagctagatagatatcttttttttttaaaaaaaaattatactttaagagaattttaggtgcattattcttagtttgtgacaaaaatgtgatatttctactttatatgttttattaagtataagcagaacataattatttactagtatggttactaatgagcacattgctatttattttatatatatatatttatttttttctttttaaaaatttcttaactgagagtatgtgcaattattgactactttgcagaactggtggcaaatataatttgcatggtagtatgcatgaaaacaattgaatttgaataattttaacttttgttaagtaagtggttcataataaaagttatgtatttgtcaatttttctgtgagatgctactatgatcttgagaacccttagaagtaagttagtcaaaactcacatataatataccttgctttggaactgcttagctgttttaacatttttaaagagtagaagagcagataagatctagttggctacttaatgacttttttttttttttcccacaaagcctcagtgttatgtttgtgttgtgtcctgtttctcctgatacagtctggagagcagctctgtccgatttatttcatgtcatctacattgcctatttagtgctcagcacactatcctagatggactactgactggctgacttcatttaaattcctaggaaacatttaagattgtatttgttgattgtcatttgcttttgagtaacgtatacttaaaattatagcaaactgagtatatggtaatgcttccctgtacgacaccttttggaatatttcctcagctgcatgcatctgtatgagtcattcagtagctattctttcatcaccgtcatttgctttgtatgaaatagcaaatgtacattttaataattcttttcatctcttggctactttttcatatagccagctcctgcttgtccatacttatttgagtggagccagtgtcactgttagtcctgagtggcagataatccaaaaaattacttctacttgccttggctttgtatttatatttgaataatcagcttgaaatcctttctggaagtaggtggggtataaatatttatacttgaacctgcatgtcattgtttttgaaggtcacaatgcttccaatttaaaaagcgattaagatatattagaaatcttcctgttttgacacattgccctccattacttcttagagtggattgtgtcattctgtgactgaagaaaatcttctgtttaaagcagaagtcacctatctctacatatgttggtatacattttcctcgtagaagggaggttagcacctgatgtagggaggtaactgtaaaaatgtttccttctcttctacctcccttctccaaagagtaagatgtttatgtcaccagagttgttaagaaggataagtaactgtaattttaatttgaaaatatttgccttataattggatgtgctaattgaaagttaactattttgtattaagtcttactgtagaatgggaggaactttagtcagttctaatttttgcaaaagttataaaatcttattttgcagggtaaaaaaattaggattaactttgtttacatcataaattcttaagtgatctttgcctattttccagtgtctctggaaaaaaagtgaatgcattattaaattgtgctttttcttaatgtcatgcaaccatatttttctcttctagaaaccaggtgatgaggaaaaaactcattttattttttaaaagaagaaatcatgcaagaaaacaaagggtgaggtcctatccttgttaactgaaatttatacagctttcccattcatgctcatttaggcattcactttcctactgttaatgagagtggtccttgactccatttgaggataagtgctgatttagaaagtaaccatatatatatatatatatatatatgacttaaatctaattctagtaacattttgataccataccttacatttaatattatcaaattaatttcattggtcatctttctagaacattttcatttagtcaaaataaaacggtgagtagtttaaaagaatatgaaagataatttagtttcttaagcctcaaacagttgtaggtaagttgcagtcatgctgatgagacattactattctttcttttattagaaacggggtcagctagggttcagctttttcaaattcaaatggttttccatatttttttatgacttgcagtccaaaagttttgtggttatataattttcatgggaattaaattatagaaaatataatgccagtgattttattttcataatatgtttatactaattttacagatacactgttaatacatttaaactgaagtgtctgctaaataaatgctactctttaaatcgacatcaaaaatgaactttgtgcctaaagttaatgacctgacagtttgagttgtaaagctcaagagtcagcagctttatttggtggaaaacgtctaatgttctaatttgccagtctgatcagatactgtcttaaattactggtcttgagttggtttttttttttttttttttttttttttgccaagaacatataaatatcaagtaagaaattagctcatgtatttttttttcctttccaagtaattttgttgtaattctggtactcactaaataagttcactggtgatgcaaacactgtaaggtttgtattttcaccgatttgcttaaatatcacttggctgtgtactctgtcccatatattattctgcaaaggtgagcaagatagccatatggttttagtaattagggggagcctaaggtgatggaagtcagacaggtcagtcctagtattggatcacaccgtggtcatggactacggatgactgaggaggacacctaaggcagataggaattatgaggggacatttcaggggaaaaccaattctctgcaaacttgtatacgcagagggagtggcttaagtgaaggtctgggagccagagggagtgtagactgagctggcagtgtggtgagaaatgaggctgctgagggaagccagagccaggttgtatactgtcctggaggttgcataatgtttgggtttgcattttaagagtttgcatttagcggggcaggtgcaatggctcacgcctgtaatcccagcactttggaaggccaaggagggcagatcacttgaggtcgggagtttgagacccgcctgaccaacatggagaaactccgtctctgctaaaaatacaaaattagccaggcgtggtggcgcatgcttgtaaactcagctactcaggaggctgaggcaggagaataacttgaacccgggaggcggaggttgcagtgagcgagatcgcgccactgcactccagcctgggcaacaagagtgaaacttggttccaaaaaaaaaagaatttgcatttagctacaacattaagaatgcatgggagctattgttttgatctaggtgagggatggtgttggcctggattataagggtagcagtagaaaggagaaaagatgaaggacacagaagacatataggagtaattgagaagtgggagtggggtgtggtgtggaatgtgagaaagataatattctgttctccaatgccactttcttaagatgaccatgttagcagtttttcatgaacccttcctcactttcctctgtccatgtgtcatcagatatgttgacagttctttgtccataatggagggttcgtctgtcttttcttctctatttagaaaatggtatcataattcacttacttctctaaaagcattaattctcaatttcacgtagttcactggatttctgtttttttgttttgttttgtttttgtctgttgcccaggttggagtgcagtggtgcgatctcggctcactgcaacctccacctcctgggttcaagcgattctcccgcctcagcctcccaagtagctgggactacaggtgcccaccaccacgcctggctaatttttgtatttttaatagagacggggtttcaccatattggccaggctggtctcaaactcctgaccttgtgatccacctgccttggcctcccaaagtgctgggattacaagtgtgagtcactgcgcccagcctggatttctttttatgataaagcacaaccaaccattttctgcctttttcatactgtcaaaatgtttgttatatagcattatttattatagcaaaaaatggcaatcaaccagaacctccaataatagatcggttaaagcgtgtgtgttttgtttcgcagattggaaggataacaacaaaatgttcatatggttgcctttgggtaattggtcagattatgaactatttacatgtttgtatttttaattttccatttttttgggacaacaatgacataatgttttaagcaaaataaaagtaactggtcagctactactagtagtaggtgtcaagtagtttataaatatgcatagtcttaatgttaactaaaaaatccagccaacctgtgctctatgtgttgatcttagtaggaaacagagctacctttcctctctcctctttgtgcttttcgttcacagttgagtcataagccaaatgtacttctgacttaaccttaagaagtagcatttattttaaagtattaggtttgtcagaatcagagtttagtttaattattattaatttgctacggatatttaataggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcggtgagtagtttgatgtttaatgactgtgatatttttcttcaaatatttattgtttcttttttttaaaaatttttttagtatgtattgatcattcttgggtgtttctcggagagggggatttggcagggtcataggacaatagtggagggaaggtcagcagataaacatgtgaacaaaggtctctggttttcctaggcagaggaccctgcggccttctgcagtgtttgtgtccctgggtacttgagattagggagtggtgatgactcttaacgagcatgctgccttcaagcatctgtttaagaaagcacatcttgcactgcccttaatccatttaacccttaatggacccagcacatgtttcagagagcacggggttgggggtaaggttatagattaacagcatcccaaggcagaagaatttttcttagtacagaacaaaatggagtctcccatgtccacctccctccacacggacacagtaacaatctgatctccctctactctcgccacatttccccccctctctagtcgacaaaaccgccatcgtcatcctggccggctctcaatgagctgttgggcacacctcccagacggggcagcggccaggtggaggcgccccaccccccggatggggcggctgactgggcaggggctgccccccacctcccggactgggcggctggctgggcgggggctgccccccacctcccggaaggggcggagacgctcctcacttcccagacggggcggctgccgggcagaggggctcctcacgtctcagactgggcagccgggcagagacgctcatcacctcccagacagggtggcggcggggcagagacgctcctcagttcccagacggggtcgtggccgggcagaggcgctcctcacatcccagacggggcggtggggccgaggcactccccacatcccagacgatgggcggccgggcagagacgctcctcacttcccagactgggcggccaggcagaggcactccccacatcccagacgatgggcgtccaggcagagacgctcctcacttcccagatggggtggtggccgggcagaggctgcaatctcggcactttgggaggccaaggcaggcggctgggaggtggaggttgtagcaagcctagatcacgccactgcactgcagcctgggcaacattgagcactgagtgagcgagactccgtctgcaatcctggcactttgggaggccaaggtgggcagatcactcgcggtcaggagctggagaccagcccgtccaacacggcgaaaccccgtctccaccaaaaaatacaaaaaccagtcaggcgtggtggcgtgcacctgcaatcccaggcacgaggcaggagaatcaggcagggaggttgcagcaagcggagatcatggcagtacagtccagcttccgcaacagagggagacggtggaaagcgggagaaggagagagggagagggagaggggagaccgtggaaagcgggagaaggggagagggaggagatcatggtggtacagtccagcttcggcaacagagggagaccgtggaaagcgggagaaggagagaggtagaggggagaccgtggaaagcgggaggagagggagagggagatcgtggaaagcgggagaagcggagagggagaggagagagagggagagggagagctattgtttcttgaaactgatcatgaagaaagtttataaagaatttttatgttgtggacacatagggggaacaacacatactggggcctattagaaggtggagggtggaggatggaaggagggagagggttcaggaaaaatagctagtgggtactaggtttaatagcagagtgatgaaataatctgtacgacaaatccccatgacacaggtttacctatataacaaacttgcacatgtacccactaacttaaaagttaaaagaacttttatgttgaaaagaaaactttattatcaaccagtaaacattatgtcttagtaaatttaatttttatattatcctgttgaatctaaatgtaagtgattattttgaaattaattctgaagttcctaaaagtattacatcctttggacatgacagtgagtaagaacagacctaaatatcctttagtccttcgttaccaacatattcaaactatattcagctgatggccaattaagaaattctttgatagattctgatttgttttacttttagcaaacagatattttacaaagattttaaaagctttaattttcttttttattgtctcatgtaagagtcatgtaagccccttaactcacaattaaatttttgtaagggatgttggttgagttttttctctccttttaaaaatgtttcatgtatttttctaagtctactacagggcatacaaagaatgccatttgaaatggaattggcatcaataattatgactttctagaagttttccctaactagttccaccatttgaacatgaacatgtaaccttcaaatctcaatcgtaacatttaaattgttattaataggtgacacagcatattacttaaaagtatatactcaatagtattttatgtttcttctcttaacttggttaaaaagttccattcagaaaagtaatctatagttaatttaattgatatgtctttatataaggtctttaaatatatttttaatttctccctcatgtttagagttgggcagaggggagctggtctttcagccaccattgctaggagtgagcatgagatttctgaaattattgatgggctctctgagcaggaggtaagaaaataaatttaattcaagttaattcgttaattattaaagcattttaactctgtaggagctaagggtttttttgtatgtaaatgtgggaacttaattgagtgctagagtttagactgtcaaagatttgagtgtctgttaaagggtttttaaacgaggcagtcacacgatcatactggaattttacaaagatggctttggcagcaaggagacctggagagaggtgaggaggctgttaggataaaaataaggttctgaatcagggcaacagtggtagggatgtataggcgagtgtaatagaaaggtagaatggacaggccaagatggatgggatgtgggagatgagaaagaggaagaatagaatgtgactcccttgtttctaggttagaggagtaagctggtggtgccgtttcctaaagtagcaaaggagcatgtattttacaaatggcagtatgttcttcaaagggtgttgtctagcaagtgaacctgggagagagttgaactggggatggttagatatcagagtcatctgtctgcaggtgatatagtcccaggtaagtatggtaacatgaagtgaaaggggcaggtgaatgagaatatagagattaagtttatatatggaggagattcatctatgaacaagaacgccatttcactaatttttaaggtgaagatactgtgttgtagcaagtggcattactttgtttttcaggcatttcctgcctgtataaagagcagaattaataaaattatgaaacaggtagtagagaccaaggtatatgtttgacaaatatatcttcagacccaaaagcagtatttcctcccttgtgaagcttcctcactcactttcccaaaacagaactcaatgtctagtctcagtttacatttatttctattgtgcttctctttctgtttaataaatatttatgatcagctaaagtgtcatcttcatgagtgcggttattttaaacctttgggtcaggctatctttgagttcctgttgcctagtgtttaattggatattaataaataaatgcagaataagaataaatttccatttctaacattgaatctttttagccctgttcaaactctcaagattgttccaaaagccatctagtattgactgagttttgctagttttgattttattatatgccttttcttaaacctcatctcaaaattctgagagtcttgtttatttgaaatagtggccttaagtaatgatcaaagatattttttaccatgctgtatacttcaaaataaatgttaagtagacttaaatatacagttaatactcgatttgcaaaattaggtgaagtggatttaatctaaaatgttcaatgatttagaaataatttagataagtaaaattcctgttttcatactacttagcacatttagaagtaaaaagcagtgttatgacttcctctgctctaccctttactactagttaacctagccagtactttttctcctttttctatgggtattgttggtttaggttatggtggactaactacatctttggtttttgaggagggggagtttgaggggtagttactacttaaaattgccaattgtgataagcacctcatatgtattatttaaactgtgaaaattctgtgaaatggaggctataattaatggctgttttgcaagttaagaaactaaagcccagctgcaggttaaataattcacccaaggttacaaattaataaatagtggagccagatactcaacccaggcagtctgactctggaactgtgtgttcttttccatatctatattcaatcaagtctattctttcaacaaatatttatagcctattatgtgccaaactttcctttaagcattgggaatacaatggtaaattaaaccatcaagttgcttgatctcatgaaaaattacttgtgagacagttgcagtaagtttttctccaggatgaaaaaatagcctctttgtacagagtttgtctttgtgttgatatatgttgtaggattctatcagtatttaattatgataccctgttttgcattcataactaaataaaagtatatagtatgctcttataaaagtatatagtatgctcttataagttactgtgtttcagaattctagttaaactagccctggaggaggtatagaactatataaactatatctcagagttccttaaaccattttacttctcagattgttcttatactgatcaaaatagacttctacaggtggtttttctttcctttcttatttctgatattctcctttcccaaagagaggattccaaggtgatttttggtgcattgaaatacataactctttagggacaattacaatatttagtcagaggtatatcccacactcaagcttttcagtgcattgttatatgatttcaggatcttagccatttctagagacacctttgagttatcagtgttccagagcataccagcttcactgtgcccagattcccggagatgtacttcttttggaatacatttatgatgttatcattgctaaattttatctcaagccctaaatacatattgcacatactattgcataatatcaggacaagtgaattttccttttttttttttttgagataggagatagggtcttactctgtcacccaggctggagtgcaatggtgtgaccttggcttgctgcatccttcacctcccgggctcaagtgatcctcccacctcagtctcctgaatagctgggactactggtacaccactacgcccggctaactttttgtttgtttgtttgtttgtttgtttgagatggcgtctcgctctgtcagccagactggaatgcagtggcacgatcttggctcactgcaacctccgcgtcccaggttcaagcgattctactccctcagcctcccgagtagcagggactacaggcacatgccagcacacccagctaatttttgtatatttagtagaaacagggttttgccatgttggccaagctggtctcaaactcctgacctcaggtgatccacctgccttggcctcccaaagtgctgggattacaggtgtgagccaccccacccagcctctcacttagctaatttaaaaaaattattttgtagagatggggtctcactatactgcccagattagacttggactcctgggctcaagcagtccttctgccttggcctccaaaagtgctgggattacaagcgtgagccactgtgcccagcaatttttcatttcttttgtagcagtataatcaagagctttaaaacataaccacttactctatattgcttttaaaattacctctaaagtacatgattgaaatgacattcagcccttggaatatgtagccattatttctacaatgacgagtaaatctctgttaaatttatttgctctttgactgattccatgaggaaacatctgtaagtacatgattgaaatgacattcagcccttggaatatgtagccattatttctacaatgatgagtaaatctctgttaaatttctttatttgctctttgactgattccatgaggaaacatttgtaagcatctaaaattagtttatgtattgaggtaatttcaatctaatgtgtaatttcagtctaaacactatagtgttcaaactgattgagagtgtcccaggaaattagagactttgtaaggacttgactattaggcagtatccacttttatgaggaaaatttttagggaaataccttttcttatatttgggtaaatacttgtaatttgggtaaaagcttttaaatagaagtttgtacttaaaaatttcctcagttaaactttgggaaaaataagttctgcacgtgtaacaaagttttagttgaaacaagcttcatttctaagaataacaaccttaaattttcaatggaaagatgatgtaaaattagcaagaagcgtttaatagtaaagtgagtttaatttaaaatcgctgacttaaattttgatgcctgtttgcttatttttctatttattgttctgtaatatgacggtaaaagttgttctataaaatgatgttgagactttaaaaaatgagactaatatgataattaaatgctccataaggtcaccacttcagtgaacttgacattactttttatcttccaggtctaaaattttattatgttaagtatcagcttagtttaagaaaagaattcttctcaaaggagtagattatttaaaaaacgatatggatattctctgcctctgtaattcatacagtgaatatttattagatatatgagtaattattgtatgttagatgctgtggtatacactgctattgttattaaactgcatacatggttttttagtgcacattaagagcattggtccatggccctccttaaatttctagtttatgttttattctaagtaaattgtattttttttccagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtaatttatattttaaattattctctaatagacatctacataagttagtaaaaagtatttggcatttacttgtaaattgaactgttttcacaaaaacttggtcccattttggtgtttgaatcaatactgtgaaaagtagagaatattgatcttcctgtaagtttataggtgggaaaagaggtaacagataagaactggggttatggagtcatgttaagagtggttcccaaacttgggtgctggctgaacttttggggagcttttataaagtacagatttctatgtattaccgtagactaatcatttcctggtgtatggtgcccagaaatctgtgccctttaaaagtctccagtgattctacaattgttcctcagattggcagttagaaagccctatacatagtatttctcttctgttttttttgagacggagtctcgctctgtcgcttaagctggagtccagtgttgtgatctcggctcactgcaacctctgcctcctgggttcaagcgattctcctgcctcagcttcctgagtaggtgggactgcaggcatgtgccaccatccccagctaatttttgtatttttagtagagatggggttctgccatattggtcaggctggtcttgaactcctgacctcaagtgatccaccttcttcggcctcccaaagtgctgggattacaggcatgagccaccacgcccagcctatacatagtctttcttttcccaagtttttttttttttagttgttgaaatatttgtacgcaagtgtgtttttgttttcgttttcactcaggtttatccagcatccaaaaaactttggactaattgcatcatacttggagaggaaggtaagacatggtttgcattgggagtgtttgtaggtttgtgatggttgttactttgaaattcttgtgctctgacacatataagtagttaactagaaccgattttaaaaagactgcgaagagtctcatgtgattaatgtaatgataattacaattattagagaaatcgtaacacagaacacagaactaaatggttaatgaaagatgacctgatgtttatttccctaaaacacatagattacaatgcttttggagcctcattaaatttctaattaaaatatcagtctcgtgctcgcttcagcagcacataatactaaaattggaacgatgcagagattagcatggcctctgcgcaaggatgacaagcaaatttgtgaatcattccatatttaatataaagttgattttaatgtttttgaacaaaatatttaaagacattttaaaaatttgcatgtatgtaatcagaaagggaatttacttgttaataagaaaatatttgaatgtttctgatagttcctggcatctttcacataatttggattaacaactgtaactgtctattaaaatagtacctataatgtaaataattttagagcctagatatgccttaaaatgctagcaatgtatgttgttctttttctttaattttactttcagaataccagagattttccttggaagtaatatttaattaaaaaatttctttatttcattggatcctcaaaaataattgttttatttcttacagagtgttcctgattgtgttttgtattactatttaaccaagaaaaatgagaattataaagccctcgtcagaaggaattatgggaaacgcagaggcagaaaccaggtgtgttttcttacttgtatggaagatatttcaggattgggggaaataggcaagcaaaaagtgttaaaacagaagtcctgcccttagtgtgtagtttaaacattgatgtttctgttaaattagtgaggatgttataattattttgaagttatatttatatatttaatgtattaaatcttgtatttcaaatatattttaagtttctactatgataaaattaattagaaaagttttataccattctgtcatctgagtcatgcatttcagtgtcagcaataatcatgtaattaaatatgaagccattaatacttttaatacactatctttagccagtctgtttatctgaggaggggtcaggtagagtaagggagagaaatacaacatggtaccttgattagagattctttacaaaaacctggaacctgattttgtttcatattaacttcatttgtggagttcagatagtttaatttctttctttcttttttttttttttttttttttgaaacagagtctcgctctgtcgcccaggctggagtgcagtggtgctatcttggctcactgcaacctccgcctcctgggttcaatcgattctcctgcctcagcctcctgagtagctgggactacaggcgcctgccaccacgcccggctaagtttttgtatttttagtagagatggggtttcaccatgttggccaggatggtctcaatctcctgacttccatgatccacctgccttggcctcccaaggtgctgggattacaggcatgagccaccgcgcccagcctagataatttaatttctaaaaagcactttttctgtctgggtgtagtggctcacacctgtaatccccgtactttgggaggctggggccagagcatcgcctgagcccaggagttcaagaccagcctaggcaacatagcgagacccatcctgtctttacaaaataatagaaaaaattagccgggcatgatggtgcatgcctgtagtcctagatacatgggaggctgaggtgggaggatggcttgagcctggaaagtcgaggctgcagtgagccatgattgtgccattgcactccagcctgagtgacagagcaagacctctgtctccaaaaaataaaaaaggcacttttactaaaggtagttttccagaagtataaaactgaaaaaggttagttttcacagttgcaattcagtaatttcaaaatgattttccccaaataactgatcagcagctgccatagctcacaggtgcttaccagagagactgctgcgctactgccaccaccacagttaatatggaggcttttgctgtctacacccggatagatattacaataaggacttgcatgcatgagctccgacactgcaacgattcattagcattattaaatctcttctggttttcccactcagccacccttttgttggggtggggtcttactccctttcttcgtttgatagcccctggttaccagatataggttattgacccagttctctcagtattcacagctataacctttttatgttttctgggtcattatttcccacagaacaccaccaccccacatgatgtgattacatgctctttggaaacagtatttcttgtttaaaaaagtatagcgagtgtttcatgagtcaactgtgtaaaatgctgttagaggttgagtaagccaaggtgccttagacgtggattttcagtgaattagtgagggggcagaaacacggttacacagagttgaagaagatacagaaggtgaggaagtggcattagtacaagtgcaaccttgtttttaaaatttttttataaagtggaatagtgaaatgggtcggtagggctaatgaggatcagagaagggaggataaagggcatacttgtacactgatgggtgcagtaccgtaagacaaaggatgggtgcttgccaagcttcataaagatgtactgacagaaaaggaataaattgagtgttgacagtgaaataggaagcactattccaccagagagaagaatattgccagggcttttcttcctgcttcccctaaagaatgtggaatcaaggtcctgtaatacccttttagctagagatcatagggaccatctatgttttaaacaagtttcagctacagttttttttttttttttttttttttgagatggagtctcgctctgtcgcccaggctggagtgcagtggtgcgatcttggctcactgcaagctccacctcccgggttcatgccattctgctgccccagcctcctgagtagctgggactaccggcacccgccaccacatctggttcattttttgtatatttagtagagacggggtttcaccgtgttagtcaggatggtctcgatctcctgacctcgtgatctgcccgcctcggcctcccaaagtgctgggattacaggcatgagccacggcgcccggcctcagctgcaaatttctaacagttttgttcctaattgccaaatagtatttataactttatctttagaaattatatatgttactgtttaaaatgttcagtcctacattaacgtaagagataaggtgatacttatacagtgtaccttaacctttgccagattagcagccagttgcccatgatgatagaggagagagctctagcaggaagttctatggggcacggatgtttgttattctgaaacagtcgtttctttcctaaagttgtctgggacacagtttcactcctctctgtggcacaccgatccttgttaagatccagccatgttggtgttctcttctgtacattcttgttgcatgtttcaaagtacctgtctcagaatgtatttgcagatgtgagaattgccatgtataccctcaccttgacctgagccttaggttgcttacccccaggtaggctcagttttgggttggtcagcacttctggtaggctagctctgccctcattagcttttaagttattgctttgaagatttttcctccaattttacatttctctggttgtttcacggggaatttgggagaggtgtgagttaaatgaatttagaccatcatctcatgccaccagatttaccattgtttcttaattgtttgtatacttattccatttatttgtgtcaaaatagaggggcagcttttcagaaattaggtggtgttagtttaagggctctctgtgtaaaactgaaggccttttgagctgataccaggtgagagaagaagccactggggttttgagcaaaagagggctgccagatttcagttgtgacatgattactctggttgctctgttgagaatagtttgtaaggagacaagagaagaagcagagaaaccagttaggaggttgttttaataatcccattgacttggactaggctacagtgaggaggcggggagaacggattagtttctggatgtacttttgaaggtaaaaccacgagattttgctgatggattgattgtggggatgaggaaaggacaataatcaaggaaaacaagttttgacctgtggagttgccatttgctgtgacaggcatgactgaaggaggagcaggttttgaggggaaaatcaggacatggctgaatatgaaatacctattaggtgtctaagcagagatccaaatgaggtccaagtaaagtggatagttagacatataagtctggagtgtaggaaaaagatctgggttaaagatatagaatttgctatatagaaaaaaggttagaatacttctttttaaaaacagaattgaattgcaaggttaagattttcaaaatctatgtatcaactcccttgattttaccctggtggatacagagatccaactaatttgaaaatcactttacttctctgctatgtaaccaagctctagtcaggagggtttagctcaggtgatctcacagccattatggcatgtttacttaaagattctttaaagttctgctgaagtttatgcttgatcctgtcaatatgagtttgattactctccctatcctctactcccagcctcctttttgtaggaagtaatttttattcagcagataaatgtatagtgtgtggctgggtgcgatggctcacgcttgtgatctcaacactttgggagtccagggcgggtggatcacttgaggtcaggaattcgagaccagcctgggcaacatgctgaaaccctgtctctattgaaaatgcaaaaattagcctggagtggtggtgcacacctataatctcagctattctggaggctgaggtagaaaaatcgcttgaacctgggaagcagaggttgcagcgagcctagatcatgccactgcactcccacctgggtgacagagcaagaccccgtctggaaaaaaaagaaagaagagagaaagagaaaaggaaggaagggagggagggaaaaaagaagaagaagaaggaagggagggagggaaggaaggagggaaaggaaggaaggaaagcaagaaaagccagactggacgtggtggctcatgcctagaatcccagagcaagactccatctcaggaaaaaaaaaaaaaaaaaaagtgtagtttgctattgatagattctaagtttgcaaagtttgattttttaaaacctgttgctatagggaagcttagtagtgtttactctgaaaatgagttttaatcttagactcataggaaaatgagacagatgtttatatttttgttaaaattgtgttcagaggttattcttggcaggaattttaactcttctctccaaattctgatagagactaccccaacccatttttatagttcagcttgttaccattccatggagagtgagtgtggttctctatatgtttttgttgaagtaatgaatacatattggagattggaagccaaaaaccactgttgaatgttattatttaggatctaggattatgccctacgtaatagtttgattctatgtacattgttcttgctagcagtaagagtttcttcccctagtaaatgctgcatttttccaacataaactgccatctggtaagtctgtcactgtgcaggtagaattactgtggtacttgctagttacctgcagtaaagcaagtcatgttagaaaccatattcttcatttccaaatgcttgattactttccacaggaattcatgcccttcttttatgctaacaccattttcccctttatgccagtgtgtttttattccctaaaggtattcagaagcatatacttaggtaaatatagcaattttgaaattggaggaattttctgactaaactgttagctagtcactagatagaaagattattttagacaagttaagaagtttattatatcagcaagaactctagccccagagtgctctgcccaattgtacctatgtgactctaggtgggtcctttcacttggtgagccttggtttccacattcatgagagtggggtcagtgatacttaggttgcatggttaataagaactgggtatgtgtgtaaagtccctggagtgcagagtcaggcacagagagtgcccaataaatggtagccactgttatctttattgccattgccacagtgtgttttttggtgattgacagctttcactcttcaggaagttagtctgaaattcagttggcttaggagcactaattgttaataaattttgataagataggcttaagatattgtctgtttatttcccgaagtatatttttaaagaaaatattgtccagtagtgaaacggtatttcattttcttcctcgtgtaaatttttatttacaattgctgcttgttattaaatttagtaatttcgttttttggcaacttattttctgttgagtgggaacttgtctgtttctcttttctaaaaaaggtgaacatttaaaacaaatataattagcacatatatatagttagatattcatttatatatagtagtaatgaatcttagcataaactattatttgatcttgccaaaggggacccatatgaaactgaatcctgttcttaaattatgttgaaatacacttaccaggtcaagcattgtggcttacactagtaatcccagcactttgggaggctgagggaggaggattgcttgagcctgggaggtttgagaccagcctggacaaaaactttaaaaatttatacaaaaagttaaaaaactgaaaaatttgattttctacaaaaaaattaaaaaattagcctggcacagtggcgtgcactgtagtgtaatcccagctattcaggaggctgaggtgggagcatcgcttgagcctgggagttgaggctgtagtgatccgtgatcacgccactgcactccagcctgggcgacagaaggagatccagtcttaaaaaaaaaaaaaaaaaattccaggtgcggtggcttatgcctaaagtcccagcactttgggaggctgaggtgggcaaatcacttgagcctaggaatttgagaccagcctgggcaacatggtgaaacctcatctctacaaaaaatacaaaaaaaaaattagccaggtgtggtgatgtgtgctggtagtccaagctactcaggaggctgaggtgggaggatcgcttgagcctgggaggcataggttgcagtgagccaagattgcgccgctgtactccagcctgggtgacatagtaagaccctgtctcacaatgaaaataaaaataaaaataaaaagaaatacacttaacttttacttttttctttgaattttcattttgttttatatgtgttctagaatattcattcatagtgaatagcttgttatttgacagaaatgtttcatgttatattaactccctgacagaattaaacttgttttattggctctcaagtattgagtttaaagaaggggagaaaaggaaaaacctggacaacgagccattgcgaatatttgtgtctgtgtagggaacttttagaagggtttcttttgaaggggtggacctcttttgctccagccaccctgtggagttgagggatgtaacttgtaaccttcatcctagaccatgtggattgactggcacttctctttacagatttgcctgaaacaaaagtagttccaagcatctcttgtttaaattagaggtaattccttactctcttgaatgtcagtggcagttgttatgataggtctttatgcatattgcacaaaggtgaggtcctccagttgctgctgactgcacttcctctccgctcaccactgcctggtcagtatacagaggggtgagaggttctgctggacaggtaccaaacacttctctagactctaatgcagcaactctgtccatttctttggatcatttccacactatgcagagccaggagctgtttccttctttacactgattggtttaagcaggtgctgcagttgtttcttattccctagcaccagggaaaggggagtgaagttatctgttggttggattttagacagcagggaatgcgtgggattactttgaagctctgattggcattagaagcagaaaagtattggggaaataagattagcatgtgttacccaactctaaggggatactgaatttctttccttacgttctgctgagttgacatgtccccgtcgtatctttaggccataaaccgttttctgggttacacagctcacttgctaggcaaagggcatgatttgtccttactatgccatcttactggttcagagtgacacatggatgctacattggttacagggttaggttattagcatttaaacaggtcttgtgaccactgtagtgtcccagggagtcagagctgagtaaaacttgcccaattataaagcagacctactcatggtttgaaagtttaaattttaaaatctccctagtttatcagttttctctagcaataaatatccagaagaaagaggaactggcagttagccagggtgagaagttaggaaggtcagataaagcaagtgaaggaatcatggtattgaaatgctttagcaagtagaatagtaggtacagttctcactggactgtgaaaatttgatagaataagggttcaaaggtcacaatgaggacaaagcaggatcagacacaatgaaggtgtgcgatgggtggttgtagttggagagaagactttctgattttaggatctaggaggcaaagcagtgcccactgctaatgaggaggcaattgtgattttgcatgtggggagtttaatggccatgacctaaaagtattttaactgtgagatgttatgttgattgagtggcgagtgttagaaaagccattgacatgcattttgaaatctgaaaaataatgtcaaggcataatgagccatgtgatgcaatcacttatatgttctagggaatatttaagaagtcattccataacaccaaaagagaatgttgatctagggagattttatgaaacgtgaaaaaggaattatttttaaaatatcacagttcagcaatgttctggaagtggaccaagaaggattcattttcttctttccttgccccttggattagaaggaggcataatgtggatgggacttcttttggggaggtgaataaggccttcattatcttaaggaaaaagctaagtgttggttttgatgaataggtaaaagactttggagcgctattaagaagggaaatttttcttaaaattaattagttacttccatattgtctggtaaaaacaagtaagaggacaggtagagttgctatgaggcaagattgacattagcctggatcagaatgaacagtcgagattggagggtaaaaacttttcagataactggaataaaggaatttgatttttgttttatccaacatatgcatacacctatcatcatggtccagacactctcctgggagctggggatgcttagagaagtaagattggattcttgttcttgatgagatgataacacagagagccagatggatgctgataagcaggcactaagccacctagtgacagtgctacaagcaggtgtggtctgtggtggagagggaaggacatggccccagagttcctctgtggaaatcaagagaggcttcacaggagatgtagcattttgacctgaattgtagagactatgtgggactttatcaggaaagggaagggtagaaagctatgcaagtgctgggcatgtttaggtgagtccagaacagcgaagatgatgtggcaggatggtgattggagggaggtgtgcaagggccagcctgctgtgctggaaagatgtgttggagttctgttttaatttggttatacagttttgatttctgaattaaataaaaatgcaggccagtcacaatggctcgtgcatgtaatcccagcattcgggagactgaggtgggagaatcacttgaggtcaggagtttgagacctgtagccccagctacctgagagactgaggtgggaggattgcatgagcctgggagtttgaggctgcagtaagctatgatcatgccactgtactgtagcctgggtgacagagtgagatgttgtctcttaaaagcaaaataaagcagttcccccttattcacaggggatatgttccaacactcccagtggatgcttgaaaccacagatagtaccgaaccctaatatactatgagagatatatatatatatctccacacatatatacacatatatgtatatatacacacacatatatacatatatgtatatatacacatacacatatatacatatatgtatatatacacatacacatatatacatatatgtatatatacacatacacatatgtatgtatacatacatatatacacatatgtatatatacatacatatatacacatgtgtatatatacatgcagatatatacacgtgtgtatatacacatatgtatatacatgcacatatacacacgtgtatatatacacatacacgtatatatacatatacacatatatacatacacatatacacatgtatatatacatacacatatacacatgtatatatacatacatatatacatacatgtatatatacatacatatatacatacatgtatatatacatacatatatacatacatgtatatatacatacatacatatatacacgtatatatacatacatatatacacacacatatatacatacatatatgcatacatgtatatatacatacagatatatacatacatgtatatatacatacagatatatacatacatgtatatatacatacagatatatacatacatgtatatatacatacagatatatacatatacacacacacacctatgataaactttgatttgtatattaggcacagtaaggaattaacagtaacaaataataaaatagagttatagcaatatactgtaatagaagttacatgagtgtggtcttttttcaaatatcatactgtacgctactacacttacccattttcatactgcagttgactccaggtaactgaaaccacagaaagagaaactcctgatatggtgggggctactgtagtagcattcattgcacacttagtttcacttttttcttttagagtcacaggttttgcaaatgagacatcagagataaaaggattcctagtgtgactgcttagcttagaaatatttaagcattttacttcttttcaccttattatagctttagtatttttccaaattacttcagtcttagtaacgaccatagctgtttacatattccattaagtagactttcgctcaaaagtataaatgcatgaagatgtttcttatagcattatagatagtgatgaaaaaattggaaacatattaagtatctaaaacatgataaattatgtatgggttatcaaattttaaggtagaattggaatgcttgagtgacagattaaatgtggaggttgccaaaaaagggaaccaaccccagatttccgagtagaatcttaacattttcactttctcgtgggtccaaatgctatgagcatttgtgtctgcgtgtaggacccttcaagcagtacatatagaatacattaaaaacctctagactggtttttaacacacgatcaccagttacattgtaaatgactaacaatcatttaaaatttttttagatagacataatttatcacactataaggagctatttctgtttgcctttgaattttacaaatgatggttcattctagcagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaagtgagttaaataattagttatataataagttaaatgtttatttttattttatttttatttttgtagatatagggagtacagttgtcacatggatatattgcatagtagtgaagtctgtgcttttagtgtaccatcgcccaaatagtgtacattatacccattatacctcacccaccccctcgcaccctctcacctgtttgaatctctagtgtctcttattccactctctatatccatgtgtccacattatttagctcccacttataagtgagaacatgtgatagttgaccttctgtttctgagttatttcacttaagatgatagccgttagtttgatccatgttgctgcaaaagtatagtttttttttttttttttttttgtgatggcgtctcgctctgttgcccaggctggagtgcagtggcatgatctcggctcactgcaagctccacttcccaggttcacgccattctcctgcctcagcctcccgagtagctgggcctacaggcatctgccaccatgcccagctaattttttgtatttttagtagagatggggtttcactgttagccaggatggtctccatctcctgacctcgtgatccatctgccttggcctcccaaagtgctgggattatagacgtgagccactgcgcccagcctagtaatttttaaataatgaaatttaatctgctgaaattttattttatttatttattttcgagacagagcctcagtctgttgcccaggctggagtgcagtggcgcaatcttggctcactgcaacctctgcctcccaagttcaagtgattcttgtgcctcggcctcccaagtaggtaggattacaggcacgcgtcaccacgcccggctaattttgtgtttttagtagagatggggtttcaccatgttgcccaggctgatcttgaactcctgacctcaggtggtccagctgcctcagcctcccaaagtgttgggattacaggcgtgagccaccacgcctggccgaaattttagaaacatctaatagttacatgattaagttgatgtgattaaggaatagaatattacagtaaatgtaatttttgacttaatgaacttatttgcaagtcatgagttattattacttttcagaagggatgggttatagtaatatatactttcctccaggatatattgaatgtaatttaatttttgatttggaagattcctcaggttctgtttttgagcctcaggtagtatatattagtataaaaatgctaagacaggaagagttcatttttatattttagattccagctttattgacttcgtcatataaaatggagttttgggtttgtttgttgttactgctgttttcttagttataaaattatattatagaaaaacaggaaaagaaaaatatagtgaaaattaacctatgattctgccactcagggagttattgttgatgcttttgtggacatacaggggtgtggtaggagtgggggcatgacagttggtttggttgtttttttccccaagaactagctttgtaaattacatggaacaaaattcaccagtttgaaatgtgtacattgatgtgttttgacaagcatatgcacttgtgtaactattatcacaattgtgatgtagaatgtttccatcaccccaaacggttcccatatgctcctttgcagtcagtttctctttcctcatttccagcctctggccgtcatgtatcttttttgctttctctagaattacataaaaattgaaatcatacagtatgtatggcttcttttacttagcatgaatgcctttgagattcacttaggttgttgaatgtatcagtagtttgttcctttttaatatttattatgttatatctatagtccttgtggaactgtttaagatttacctagttttgtggaagctaaagtagctagtcacttgccatgttttaaaagagacagatattcttctcattgtaattttatacctgaggaagatacctctaagggaatatatttttttcttttagtttgggttaaacatttttcgggccatgtagccagtggttcttctcacatggaactctgtcataacttgattttatttttttgttaaaatttctaaactatttaacaagcttttatttattatctatgtgagctaggtcttagggagaatgtgaaaatacgtaagatgtatactattcccaggtagttcatgatttagtaggggaaaagtaggtaaagtacaagtattactttaagaaataaaagcctggcagtaagaagtcaacagacgaccagttaagtgctttggcagattaagaagaggtcgaggctacttctctgtggataatttggaggacattagcagatgctagtggttaatgtgggtagggtagagggaatcacatgaatagctagtggaagataatgatttcattagacttaacatagtgtgcatcaagaagagaagtggaaggtggattggaattaaattatgtagagctttaatgaaagccaaaaatggtagacttcattcaggaggctgtgctgtgtgtctgtctgggaatagttagaaagggattagaatggatggagtggtttattgccaaagctatcctgctagaatgttgattcattggcaagataaaatgaatagactagagatatgaatcagggaggccagtatgaaaggccaggattggggtactaaggtgttgagtaagtgtagtggtagtagaaatagagatggtaaaattagtgagagaggcatttctgagatgaaataaccaaaacttggcattagatcacatgtaggaagtatgggaagagggagacagcaaaggatgatatcaaatctgtaaacctgaatgatgatgaacatggtaggaatgttaacaacaaatgattagagagtgacgtggagcaaggagcagaggtgaggatgaatatgattttggatatgttcagtttctattgatggaaaatccaggtggccgttccagcaggtagttgggaagataagcctgagtctttggagttggggtgtgagtccaaagatagagattggagtcctcccggtagaacttatgagaatgggtaaccttacatagctctaaggctctaggggagagccttgggaaatccccgtatgaaagggatgagaggaacccagcacagtggctcattcctgtaatcccagccaaggtgggagaattgctttagcacaggaattcatgactaccctgggcaacatggtgacaccctgtctctgcaaaaaatacaaaaattaaccaggtatgctggcacgtgtctgtagtcccagctactcgagaagctgaggtgggaggctcacttgagcccaagagattgaggctgcagtgagctgtgttcgcgccactgctcttcagcctgggtgacggagtgagacactttctcaaagacaaaaaacagaaacccaaaagaaaggatgagaggagaaaggtctgtcccttgaaggaaagccagagtagcagcagggatatttcaaaagctgagtttcaagtgatataaaaagaagaattaactgcagcgtcagttgtaacagaaagacttgcggggaaaattgagaagaggtcatttgattttgcagtttgcaagtcattggtgacttttgagaaaacatcttttaacaggaggcttcagaatagaagccagctttataagggaataagtaagtaaagggaaaggactatgtcgtacttcaatttaggactgaaggggagagaattatttttgaaaaaaatcagcatcttccattaagcaagaataattgagtctttgagtattgccatctatccattcatttgcaaaaatgtacattgagtacgtttccttaaatataacaaccatgggaggtaagtagtacagaaaatggtcttccagtattacatgtagtactgttgctattaataggaaccaccatgtttctacatgcctgagacgatggtaagcactttatatcctgagggagttttagcttgaataatagcaaactgttacttgatgctgactgtgttccaggcactgttctgggtactttatttaactccttcagtcctggcaacagtcccatgaaataaactttttctcattgtacagatgaggaaactgaggcccatgggggtgaggcagcttgtccagggtcatcacatggctagtaaatcacaactgtggtacaaacccaggcagcctggctccagaggccgtttcctaagtattaaccattactgcccaatttgtacataattagtatcagacatgatttagagtattgagtctgattttataaaacaatattgtagattattactgtaaaacaatattgtggattattactatagaaaaggcatctatcatgaagatcatctattttagcttcttcatttcatacatgaggcaacctagactaaaggcaaataaaaccccagaattcctgccttttggtgtaggctgttgtctctggattgcaggtctagggcttttctgctgtcatttgttactttctcatggagtagttctggtttctaaatcagttggtttgaaatgtgtttaaattttaagtccattagtatgtaaaataggtcttataaaatatcttaattttagctggtcaaaacttttaaaaactatggtatggcagaattgttgataattttttttttttgagtgagagattaggtagttttattcaatttctatttagataatattcaaaactaaaaccttcttcgatgtatgtatactttggaatcacacaagttttcatttgcttttgtgtccagagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccagtgagtggaaacaattggcataaacaggccataattttgttcgggattctgtttcactgctaggatagggtagaaaggacttttaatattgacaacctagaaataatcctgaagtgtggtctttaaattttttaaactttaatgtcaaagttttttgaaaaagaacatcacccagtcttgccaccccaatatagctgttttttatttagttgttatgctagtgtgccataaatattttctaatttctaataattaccatttttattttttagtggctgtgtaatattgaggcatgacttctttaaccattctcttattgctgaatgattaggttgtctgccctcttccctgcttttaaaccaatgtatatagcactgtaataaaaaaatctttattcacatagtattttatgttaaattatttgtcatggaataaattcttaggcaagggaatactggatctaatagtcaaagcatctttctctctctcattaagtattgtctcattagtttataaaaaggctagattaatgatagagtaccactgttaatgattcagaggtatcattgttactgaagtatgaaagaaaatgcagtttagggaatggcaagaatgagataggggcactaactagataggaggaggaaagataggttggggcaggtcatgatgggccttgtttgaaatgtattttgctttgattatgaagtggggaacttgcagaggtttttaaatagaggaatgctgtgattagatttgtgtctttggaagttaactggtagcaattgtggaggtcagtttagacagaataaaggctggaggcagagggcccagcatgtatgcagtggcccaagcaaggaggggatggattcagagttgatgcatgtcattggatgtgagtggtaaatgggaggcaagattcaaaaattagtctatcagtctaaggagcctattggtaacttgagtgactgggtgaatgctggtactataaattgagaaagggaatatggcaggagctcatatcaggcctgatgttctcaggttttgttttgttttgttttgtttttttcctgaagcaaaagagaacatattcagttcatgatccatctttacccactggatgtcagacactcggggatgaactaaaggggctccaggagttttaggacaagatggaggctcagaggagaggagagggaattgtgcttggacaggaaggaggagggttgcttcttcctttgacactgcaggagaggagaggtggagatcactaagtgggaagctactgggtgaggtaggacttctccagaaaaaaacaaaatgtttaaaaatgtagacatgaagagaacttttaacaacactgaaaaagatcataatattgaagtgttgacttgtttcttctagtttggtggaggagaggttactatcctatttctgcagtttctttcaccaaatgcttttacatagtcttttatgtcagataaagagatataattatatgattggtttgaataaaggatttaactttgtttttctctgcctgattgggttctctctttattttagtttctacagagcctgtggagacctctcgatggacagaagaagaaatggaagttgctaaaaaaggtaaattgtagtagttctggtttctcaggtttttgttttgttttttagggttattagtaatgagtgagatggaactaattgttttaattggaaaaaaaattctttcaaaaaggcaaagaggactcagaagtgactttaagagttcttttctggtagtatggtacccaataaagtacccccagtgtgccttgtttaagatgcccagttttaagggatttaagattctctctgcagttttattttgaatgtcatttaattaaagaacaagtaggtcgttttcacttttttagaataattatgactctatgctattgaaattgttctggaatgaatgttgatataaagtctatatttctattacctaaaagttgtatttaataggataggatggtaaatacttttgtcagtttgcatttggtaagtcatgtaattataaaccactagcagattgctctgtgattcagaggaaagagcatgaagtttgtaaccaggccagcgaaggtttgagtcctgtctctgccactttcatagctttgtggccttcctcttactctggcactttatggactttgtgcttttctgtcgttgcttgttaatgtactataatttgaaattgaactaaaatttctaataggataaataattggtaatattgagaaagattagctaatttttggtggttaaatatttaccttgcagttgtaaagataaattattgtaaatagcttgacatttgagtgacacatttcatatttttttgtatcaccccttatatatgtatacaaatgcatagatacatattctttgcacgtatgtgtgtgtttatgtgtgtgcatatatatattgattagagaagtgttaaattgcataggtttctgtaatgcattgtattaccataggatttttttaaattggctagtatttttctgatggcattgcttgattgtgaattgactgaggacaaatatggattataagtggagtcatatatatgtctttaaattgtgtttatcatttatatatgattatcttattggcttgatatattgtgtccagagatctagatgtacctaatcatttagtttgcaagtatttgagctattactaatgtgtctaatgttgtcctagccctgtgagagatacataggaaggacaaggtttagcccttctgttaatgagcatgttttaaatttgagggggaaaaatatagaactgtaaatgagttttgtttcaataagtatttttataagtatcaaagtatatatgataagtaattgaaagcacacttctagtgtcaatggttgtgaatacagtgattaagttaatttattatttctcttgtttgcttgatcaggtgactgttcaattaacatttggtctgtttttaaaatgcaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaagtgagtatattggggtggtgactctttacttactgttttttacttagagtgttgttgttgttgtttgagatggagtctcactctatcacccaggctagagtgcagcagtgcaatcttggctcactgcaaactcttcctcccggattcaagcaatttcctgcctcagcctcccgagtagctgggactacaggcgcccgccaccatgcctggctaatttttgtagttttagtagagacagtgtttcaccatgttggccaggctggtctcgaactccagacctcaggtgatccacctgtctcagcctcccaaagtgctgggattacaggtgtgagccactgcatctagccttgatgttttttttttttttttttttctgagctccagagattggttttaagagaaacctttttgtatcttatatttttatttattgcacttatatgtaaaaggtatgctaaatttttagtataggctagctgtttctctatttattgctcaaggagtaaagtttctatttgtattcctaacagtccaaacaaggcccatcatgacctgccccagcttatctttcctcctccgaagtttctatttgtagtaaagggaattaaatactcttgaattactgtaggctggatttgaaaaatacaaactttttggagattgaattgaaaactttagttggaggtctgttgataatatcgagtgaattgatttggtatattagacattttttcagagagaagattccatggtataaatattaaaaaccagagagtataacattattggaaattccttaataagtaagttccagtgtagtggttgtcaaagaccatagagctttttgatgattccatgaggtcaagactgttttcataaaaatatcaatcaaatgttatttactttttttcagtatatgacatttgcatttatggtgtcaaagctgtggtagataaaattgctgatgcctaagcataaatcttggcagggaaccaaacggtgctagtactcaatgtatttttcatcgctgagcatttgcagttttttcttaaaatgtcacttaagaatgtccttgatgacgcagtaaaagttaattttattaaatctcacccattgagtatgtctttttatacttcgtgtcatgtaatgggaagtaaacataaagttctgctctataccaaaatatgatggttctctcagggaaaagcactttggcaattgtttgagttctaagttgcaccagcctcccctttttcatggaatgtcattttagattgaaagaatgacagacaaactatgttttcagactgggattttgggagacattttcttgaaaattagtgaatgaggctgtctttgaaataaaataactgatagtgtttgttgccactttaaaattttgagttttcaagcaaaaaatgagaattttggaaaatatgtttctctaaccatgagcttcacaccttctcattacagattttctgatgagatcagtggtaataatagcaaatgcgatagttgttactgtgtgatgaaatgtatccaaatttgaaaaacttgctttaactctactttccaaatggccatttcatgatgttataatgtgatatggtttggctttgttgccacccaagtctcatctttaattgtaactcctacaattaccatgtgtcatgggagggactcagtgggagataattgaatcatggggcaggcctttttctcatgctattctcgtgatagtgaataagtctcacaagatctgatggttttataaagaggaatttccccgcacaagctctctttttttgcctgccccatccatgcaagatgttacttgctcctccttgctttctgccatgattgtgaggcctccccagtcatgtggaactgtaagccctttaagcctctttttcttcccagtcttgggtatgtctttataagcagcgtgaaaacggactaatacaataaattggtactggtagagtagggtgttggtgaaaagatacctgaaaatatggaggcgactttggaactgggtaacaggcagaggttgcaacagtttggagggctcagaagaagacaggaaaatgtggaaatgtttggagcttcctagagacttgttgaatggctttgacaaaactgctgatagtgatatgaacaataaggtccaggctgaggtgatctcagatggaaatgaggaacttgttgggaattggagcaaaggtgagtcttcttatgttttagcaaagagactggcagcattttgcccctgccctagagatttgcagaactttgaacttgagagagataatttaggttatctggcggaagacatttctaagcagcaaagcattctagaggtgacttgggtgctgttaaaggcattcagttttatgagggaagcagagcataaaagtttggaaaatttgcagcctaacaacgtgatagaaaagaaaatcccattttctgaagaggaattcaagcctgctgcaggaatttgcataagtaatgaggagctgaatattaagttccaagacaatggggaaaatttcttcacagcatgtcagaggtctttatggcagccctttccatcataggcctggaggctgaggaggaaaaaatgatttcatgccctggacccaggacccccttgctgtttgcagcccagggacttggtgctctgcaccccagcagctctggccatggctgaaaggggccaaggtacagcttgggccgtggcttcagagggtgcaagccccaagcctttgcagcttccatatggtgttgagcctgtgggtacatagaagtcaagaattgaggtttgggaacctctgcctagatttcagaggatgtatggaaacgcctggatgttcaagcagaagtttgctacaggggtggggctctcatggaggacctctgctagggcagtgcagaagggaaatggggggtcagactccctactagtgcactgcctaatggagctgtaagaagagggccaccatcctccagaatggtagatccacctacagtttgcactgtgtgcctggaaaagccgcagacactcaacgctaccctgtgaaaacagccaggaaggaggctgttccctgcaaagccacaggattggagctgcccaagaccgtgggaacccacctcttgcatcagcacgacctggacgtgagacatggagtcaaaggagatcattttggagctttaaggtttgactgccctgctggattttggacttggatagaccctatagcccctttcgtttggccagtttctcccacttggaacagctgtatttacccaatacctgtgcccccattgtatctaggaagtaactaacttgcttctgctttcacaggctcataggggaagggacttgccttgtctcagatgagactttgggctatggacttttgggttaatgctgaaattagtgaagactttggaggactgttgggaaggcatgattggttttgaaatgtgaagacatgagatgtgggaggggccagcggcagaatgatatggtatggctgtgtccccacccaaatctcatcttgaattgtaggtcccacagttcccatgtgttgtgggagggacccagtgggagataattgaatcatggggcaggtctttctcatgctatttttgtgatagtgaataagtcttaggagatctactggttttagaaagaggagttcccctgcacaagtttttgttttttttttttttttttttttgcctgccgccatcatgtaagacgttacttgctcctccttcccttttgccatgattgtgaagcctccccagccatgtggaactgtaagtccattaaacctcttttacttcccagtctcaagtatgtctttatcagcagcgtgaaaatgaactaatacataatggatcatgcattgataaaagattgataatgtttttttaatataccaaacgtaagataggttacagatttttttcttttttctttttttttgagatggagtctcaccctgttgcccaggctggagtgcagtggcatgatcttggcttactgcaacctccgcctcccaggttcaagcaattctcctgcctcagcctccttagcagctgggattacaggcgcacgccactatgcccagctaatttttgtatttttagtagagatggggtttcaccatgttggtcaggctggtcttcagctcctggcctcaagtgatctgcctgcctcagccttccaaagtactgggattacaggcgtgagccaccgcgcctggccagattatagattttaacagagtatgaagggttccttgatatggtataagatttcatattgtaactaacaaataagaagtgacacttggtgagttttggtacagtatcaaaaaatagtatgcataagtatctgaaaaatctgttaaaatattcttcccttttccaacgacatatctgtgtgaggctacattgttttcttatacttcaaccaaaacattagattacttaatgtaatccacagattagatcatatgtggaagcaccttgagaattgtgctgtctctgttagatcagacatggaagagatttccaaaaggggaaggttgtgccactgttttagtaagtcatttttttttttttggaaaatggttacttttcattaaaaaaataaattcttggccaggcgcggtggcttatgcctgtaatcccagcactttgggaggctgaggagggcagaacacaaggtcaggagatcgagaccatcctggctaacatggtgaaaccccgtctctactaaaaatacagaaaaaaatgttagccggccatggtggtgggtgcctgtagtcccagccattggggaggctgaggcaggagaatggtgtgaacccaggaggcagagcttgcagtgagccgagatcgcaccactgcactccagcctaggcgacagagcgagattccatctcaaaataaataaataaataataatttatgagtttatattgtttttaataatttaaaattttgaagttttcttagttttagtttctgatatagtaagtgtctatctggctgtctatatttctcccataaagaaaagctctttggccaggtgcagtggctcacgcctttaatcccagcacgttgggaggccgaggcgggcagatcacgagttcaagagatcaagaccatcctggccaacgtggtgaaaccctgtctctactaaaaatacaaaaattagctgggtgtgatggtgtgcacctttaatcccagctactcgggaggccagtagaatcacttgaacctgggaggcggaggttgcagtgagctgagatcgcgccactgtactccagccgggcgacagagtgagactccgtctcaaaagaaaaaaaagaaaagttctctgcggcctttaatactttttaagagtgttgcatccttagaccaaaaaatttgagaattattaaagtgtgatagtaaagctaataagatttgaatttattaagagtatacaaagtataacattgactgatttaaaagtgtgtatacaaagcggcctttaggttaataataagaatgtgagagttaaaaatatgctgtagcaaccaaaacatgaaaaagtctactgataagataaagacttgacttcaggaggtaacatccaaaatgttttgagaaaaagtgaagtaaaaaatgagtcagatatgtatttaaaatataaatgttggctgggtgtggggactcacgcctgtaatctcagcactttgggacgtcaaggtgggtggatcattaggtcaggagattgagaccatcctggctaacatggtgaaaccccttctctactaaaagtacaaaaaattagccgggcatggtggcgggcacctgtagtcccagctactcgggaggctgaggcaggagaatggcctgaacccgggagccggagcttgcagtgagccgagatggcgccactgcactccagcctgggtgacagtgcaagactccgtctgaaaaataaaaataaaaataaataaataaatgtatgttatattagtcatggtcctcctcagaaacacagttaacaggatgtgtgtatgcatatatatagaaagaaagattgagatttaaggaactggctcctgtgattgtggagggttggtgagtccagtgtctaatggagtaggctggttgattggagattctgggaagagttgcagttggaccccaaaggcagttttcctggcagaatgtcttctttttttttttaattttaatttttatttaattttattttttgagatggagtttcgctctgtcaccaaggctggagtgcagtggcttgatcttggctcactgcaacctctgcctcctgggctcaagcgatactcctgcctcagtgtcccaagtagctgggattacaggcacacaccaccatgcctgactaatgtttgtatttttagtagagacggggtttcaccatgttggccaggctggtcttgaactcctggcctcaagttatctgcccgccttggcctcccagtgtgctgggattacaggtctgagccactgggtctggccatgagccactgcgcctggcctgtgtttctatatatttgactttacattaagaattagtgaatactatcatatattgaagaaaatgcttggcaacgtagtgaattattgcatgtgaacagagggatgttgtagtagggtaaaaagttgtctcttccctagttactagtgaaaggaccaaacagaatgggttgatagtggtgagagagggacatacactgggctctggaaaaatccatataataatttatctgctgggcatggtaggtcacacctggattgcttgaggccagatgttccagaccagtctgggcaacacagcaacacctcatattcaaaaacaaacaaataaattaaaagtagttattatccttgaaaatttacagaatcttctgaaagctttttagaaagtgtagccagtgtgtctctgggattctcttgcattcctgctatgaacttagaaatattagccttgagaattgcaactaattctgtgactctgatattagaaaatgattgtttctcttgagttaattaatattttagttggatcctaaatatcatccgcatgagaatgttgagtagatgtacgggtaatttttaacagggcagtagtatattttcctcttctgaggagtctcactgggagaggctgacagctcatatgaggtgaaacgtaggctctgtaaggggcacaagacagaggaccatcagggctgggacttccagaaccctgggtctgcaaacacagaagatattaagccttctatttagtaacatgaagttataaatataatgtaaatagctaacgtcttatagttaaatgtgtacacatgtactcttacgtatatgcgaccccagtagaagaatgagcaattttgcataaacatactttgcagaagggagcatacaattttttttaaaaaggaattaaaaaaaatttttgtttttttgttttttgttttttttttgaacgagtctcactgtcacccagcctggagtgcagtggcatgatcacagctcactgcagattcagccttttgggctcaagcgatctccctggctcagtctactgtgtaactgggactacaggagagcaccagcacacagagctaatttttttattttttgtagggacaggtgtccaactttgttgcgcaggctaatctcaaactcctgagttcaagtgatcctcccacctcagtctcccaaagtgctgggattatagacatgagctcctatgcttagctgaatttgtgcttttttatagtaaaagaaattgagtggtattggctgggtgcggtggctcacgcctgtaatcccagcactttgggaggccaaagcgggtggatcacgaggtcaggagttcaagaccagcctggccaagatggtgaaaccccgtctctactaaaaacatgaaaattagctgggcctggtggcgggtgcttgtaattccaactattcgggaggctgaggcagagaattgcttgaacccaggaggtggaggttccagtgagctgagatcctgccactgcactccagcctgggtgacagagcaagattctgtctcaaaaaagaaaaaaagaaaaataaattgagtggtaaaaagaaattcagtagtaatatcaatgatgagttgttgcttataaaattgcgtgattcttaatgctagtgaaggaagtttcttgcagcattatttataccaaaaattgaaaattaccaaaatgccttaaaataggagaattttaattatatgtcaacataatatatgtcagtattatgtcaacataatgttttcatgggatcattaataacaataattaggaagaatttgtaacagtgatatgttctgctcatggctacattatgttaaaaaagtgaatatgtaattacatagggctttcctggttgtgtttacatgtatacataaatatttatattcatgtatatgcctctgaaagattgaaaggaaatgtaccggtatatttaggatctcttactgttggaataatgagcagtgatttttgtagtgttatgtcttccacatttcaaggtatatattatctttagaaaaaatatatatatattgtttttattagataacattatctggagtgagtaaaaagcatggaggtatgtgatttttggctttttatacatgtatagtggtgagtaattccaaaagtggatcagatgtaacttttgcttagtttgataaaggcgagccatctacacaaaatttggccagttagtgattatggagaggtatttatctgcactttaaccagaactattgtcaaacatgtgacctccttgtctggtgtgtgtgtgtgcttatcaatgttctacattatttcagaaatgaatttttttttctttttagttatttaaatcaaataatactctttcctcctttagacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtatctcaaaattttaaatttagttgtgacatctgctatccagaataaataatttttagtcatttgactgtgtaggagttgcttcattgaggaaacagtgtgccagtgttttcatggtgtggagacttcaaacttgaacataatgtttttattcatttaatcaacaaatatttatgtagcacctaggatggtccagaagatcttggaaatggcagtcctgcttcagacatcaagtgccaacatcaataaaatacctgtgtgtctgtgtcattgccacatttatttgttcagttagtatagttggttacatttctctttattttattggcttaagtttgatttattttcatatttttacagagatttatatgtactgtagtaatgtttttacgtaaaaagaattagtgaccttagaagcaccgatagaaaaaaaaaacacgaaacttaaggaaatttaagaaataatgtatctttgtcatttaaactaatgacaagttcatggaaaggtaaatgttttcttgatttttttggtaagaaaaaagatacctaatttatttcagtttacactctgattaaagtttctgtggattttttttttttttttttggaaattgcttctgatgtggggatttttataatgcttttagtagctcttcatatattataaattaaacatgttcatgttttgtatatgcagataattttttccatcattttctttttgttttccttttcaattacttttgtttaaagtttgtgtaattagagttgtatctcttttctgtgtagggtctttattttgtataagctttaaaagttgtacatcctccaggtttagtaatattagattccatgttttttttttcctatagattattcttgttgtcttttaaacttaaacttgtattgaaatgggttttggctttgaacaacccctaaccttaaacttgtttttgggagggtttgtgaaaaatgaggtcatctttacaagagtagagagagtattagagaagtcccacccgagggtagggtaagagtgctgcaaacagggaaggtagtttggtgtgttaatggcacttctagagaggttgtcagagtctcttggttttaatgggtttgtttctggtggctagtattccctggggttataaatgttaatgaaggctggaggttaataaatctccttgggctgccataacaaaataccacagattgggtggctgcagcaactgaaattaattttctcacggttctggaggctgtacgtgcaaggtcaaggtgctggcacagttgctttctgatgagggctgtctttgtggcttgcagatggctaaccgccttgttactttgtccttacatggcctttcctttgggtgtgcgcactcctggtgtctcttcctcatatgaagacaactcctactggattagagcccactgttataatctcatttaaccttagtcatctccttaaaggcctcgtcttcaaatacagttacattggggggtagggctccaacagaagaattttggtggggaggggcacaatgcagtccataacaaagcccaagtctggtattaatatgtctatctgggccgggcgcagtggctcatgcctgtaaccccaacacttggggaggcccaggagggcggaacacgatgtcaggagattgagaccatcctggctaacacggtgaaaccccgtctctactaaaaatacaaaaaaaagttagccgggcatggtggcgggcgcctgtagtcccagctactcgggaggctgaggcaggagaatggtgtgaacctgggaggcggagcttgcagtgagctgagatcacgccactgcactccagcctgggcgacagagcgagactgtctcaaaaaaaaaaaaaaaaaaaaaaaaaaaaatatatatatatatatatatatatatatatgtctgatcaagtgtagggtggcaccatcacatctgctcaatcatctagaagagtttcctattaagaggaaatgattttcccagtagaattgtaggctctctcttcctgttgacttagcttcatttggaaagtgtcaagaagagaacataaatgcagctcatgtgacctgtgatctcatacttattcctaatctcaatgagacagcacagatgcactgtttattgtgtggcaagtctcttgccaattgaagaacgaaggcagctgctgaagggagggttcctctatctgttttcctaaaacacatctgagtgtttgagtatctttcatgattagaagaattaaatcagaccaaacttcaccaaaatttggatttgctcttgttctctttttctacatcattctttaaggtttttttttgtatttttaggaaaaaaaaagatactcatgtttggctactgcttggtgaaacattatgccttggaaaccttcctactcttttgtggcttggaagaagaaaattggaaaagtgcttatgtcaaatgatatcatctgctgtataaccactaacatgtcttctaatattttgaagataaatgccttgttagtttgcccttggatttggggctttctaccactatataaacagaaatgaaggttaagttgggctttttgttagcttttcaatgctttggtaggatctttcagtaatgataatggctgccgtttttgtttgttggtttgtttgtttgttttagagatggagtctcgcgcttgttgcccaggctggagtgcagtgttgcaatctcagctcactgtaacctctgcttcccgggttcaagcaattcccctgcctcagcctcccgagtagctgggattataggcacttgccaccacgcccagctaatttttgtacttttagtagagatggggtttcgctacgttggtcaggcttgtctcgaactcctgacctcaggtgttccgcctgccttggccttccaaagtgctgggattacaggcatgagccaccgcgcctggccatggctgccatatattaaaaccttactacatgtgaggtactcttctgaattatttgcttgtctgtctttgtttgtttgtttgtttgtttgtttgttttttggagacttgaactctcatgtgaactccaggctcatatatttgatcacctacagtatttccatttggatgcctaagagccatcttgttgttaacagccaaagcaaactcatgtgtctctaccaccacaagctgcttttccctctggtctttcactatatcaataaattaggttttctttagtctctttagaattggatccttgtctccattgctcctaccctgcttctgaggagccctcattgcagtagttttttgattagtctcttgcttctttttgttccattctttttatttatttttagagatgaggtctcgctgtgtcacctaggctggagtgcagtggctcgatcgtggctcactgcagcctcaaactcccaggctcaagcgattttcccacctcatccccccaagtatctgggaccataggcgtgtaccaccacacctgactaatgtacttttttattttgtgtagagacaaggtccattctgttttttcttccacagcagcccaagtaattcttccaaaatgtgaatcaaatcatgtttcttctctagtccaaattctgtaatactttcccatctcagtaaaaataaagacccaaggccttactgcaatttatgaggctctgcatgaactgacctttgtacctctgtgaactttctgccagctgcttttttgttggccccctctgctccaaccacactgtcctctttgctgttcctgggcaaaccaaccccgacttcaggagcctttgtgctttctaatccctctacctgggatgctcttccccaccatgtgcctagggctcattctctcatttccttgagtcctctgttcagatatcacttttttctataatacctcctcacccacttctttctcagttttgtcgtttagtcactgcactgatcaccacctgatatatcacttcttttgtttttttgagacagggtctcactctgttaacccagcgctgaagtgtaccagcgtgaacacagctcactgcaagccttgacctcttgggctcaagtgattctcttgcctcagcctcccaatagctgggattactggtgtacgccaccatgactagctaattttttaatttttttgtagagatgaggtcttactatgtggcccaagctggtcttgaactcctggcctcaggcattcttcctgccttaacttcccaaagtgctgggattataggcgtgagccaccactctcagcctatatcacatatttactgttgtctatttcacgctagaatatgggctccatgagagcatctgcttaggttttcttaaattgctgtgtccgtggtacctcagacagctccctgcacatacatagttgacacttcatcatatttgaaaggatgaatttgtagaagttttttttatattgctgtctattatatacaattaaaaaatatttttttttcccagacggttacttaggttttcacaaccattcatgtactttataatccagccagtatttgagtctactgtgtaccaggctagtacttaagtgataatcaaaataaatgatctctgtcttcatggagtttatagcctagtggaagaaatagccagaaatcattctagtaaataaatgtaagattgtaactgtaactagtacatgtggtatcagaactatattagcaaaatataactttgttaaggaaaccatggaaggcttttttgggggggtgggggtacagagtttcactcttgttgcccaggctggcatgatctcggctcaccacaacctccacttcccggattcaagcgattctcctacttcagcctcccaagtagctgggagcacaggcatgccacatgtggctaattttgtatttttagtagagacggggtttcactatgtcggtcaggatggtctcaaactcctcacctcaggtgatccatccacctcggcctcccaaagtgctgggattacaggcgtgagccagtgcgcccagcccatagaaggctttttaagcatgtgatgtttgagttgatcaccaaaggaaaagtaggtgaaagagcctttcagtaaaggtgaatggcatgtacaaagtctctgtggtagaagatgcatgaggcattgaacaaactaaataaaggccagtgtgacttgaattcagagagctgtgtgcaagctggagaggctggagggggcccactgggcaaggccttgcagaccataccagcaattttgggactttatcctaatagtaatgggggtccactgaaaagttatgagagtgagagagtgagttattgtggtaaaatctggcttttaaaaagacaactctatctttgttgtaaagaatggtctgaagtggagtgaagagagttggttttggactagagtgctagctgtgaagttgaacaggattggatagattcaagagaaatttttagagagaaaatcagtgagccttgtcaaggctggatatggggtaaatgagaagagggtttaaaagatgacttcttggtctctgttttgtttaattggatagtaaaccctagaaaagaatctgatttgcgagtggttattacaactctagtacaggacatactgaatttgtgctgcctttgatatatctaggtaaagatgtcaaaaagcactgaaagtctatttatagaacaatataaacgattatagaacaatataaacgatatggggaaagatctgttacaacattaaattaaaaatctgtgaaatagtattctacagccttctgtccagtgtggtagccgctagacacttgtggctattgagcacttgaaatttggctagtttaaatttagatatgcaggctgggtgcggtggcctatgtctgtaatcccagcactttgggaggccaaggcaggcggatcacctgacgtcaggagttcaagaccagcctgggcaacatggtgaaaccccatctctactaaaaatacaaaaattagccgggcatggtgccaggcacctataatcccagctactcaggaggctgaggcacaagaatcgctggaacctgggaggcggaggctgcagtgagccaagaaagcaccactgcagtccagcctgggtgacagagcgagactctgcctccaaaaaaaaaaaattagatatgcagaaaatgtaaaatgcacaccagattttgaagatttagtacccaaaaaaaggaaaaataatcttatgattttttgctattgatcacatgttaaaatgatatttcacatatactgggttaattaaataaattctacaaaattagctaggcatggtggcacacacctgtaaatccagctacttgggaggctgaggcaggagaatcgcttgaacccaggaggcggaggttgcagtgagccgagatcgcaccattgcactccagcctgggtaacaagagcaaaaccccatctccaaaaaattaaaaattaaaaaaaaagtttaaattatttgaccaatttcttcttacttttttaatgtgaccatcagaaaaattaaaattacagatgtgattacattatatgtctattggatggagccgttctagagtgtcagttcagctgggtaaaaggaaattcacaggaagaggcttctagaaatacaccagaatgtcatcatttataggaatgttttttgtttagttttattgttcgttctttttcaatttcatataaattattttcagacattaaaatcctttatgcttttagtttcagaaggtcaagataatttgatctttcacttttatactctgtaggaaactttagccttctcaatggctgtaaatacttcaatgaggtcatcaaaggagtagaattcatcctaaacaactactttcaaacatggtttctatcaccacctgaaacatgttcattatcagatttttatgctgtatcattatctttaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagaggtgaggctcgttccataagtcctccccgtgcttactctgctggttggtgactgaatcacagggtggtgctggctgcagacatgtctcctatgtaaatattggcacgttataggtagtctgtacaattttaatattgggctgatactgttctgtttaaataaccacaaactattgtatgatcattttaatgaaacagattatacatttctcctatatctgtcttgttacgtgtattctgtatgatagcataacagggaatttcaactaataaagttgtgaataaaccacagataactgttgtgcctgaggagggcagcagtgggatgtggtagaagaaggtggaggctagaggcattgaggcactcccgcttctctaaggcagtgcaacctcaaaacaaggcctaccagcccctacttattaggtagaagaaaatgctgaaaagagagacatgttcagtgttctgaaaatttttagaaagcataatttaaatgcaaagtaatgataattatgaccacttttttgtatcagttaacattttagattgttcatatttgtaatttaaaatatcaggtataatgcagattaatttacaagttttttttctttttttgagacggagtctcgttcttccccaggctggagtgcaatgacacgatctcgggtcactgcatcctccacctcttgagttcacgtgattctcctgcctcagccttctgagtagctgggactacaggcacacgccaccatgcttggctaatttttgtatttttagtagagatggggttttgccgtgttggccaggctggtctcaaactcctgacctcaggtgatccacccatctcagcctcccaaagtgctggaattacaggcatgagccaccgctccctgcagtttacaggtagctttagtcattaaaggttaattaattatacaaaaaatgtatcatatctttatggtttttgtaaaaattacagtaaaagatatatattttacaggtacagttattactttatttaatatattttatttcctggtgtttccttttccttaaaagacattgaatcacttataattttagtagaatgataaattggtgcaaattctagaagtgaattagactgaaacatcacttaatccgaacccaattaaaccccactccttttttttctttttaataagaataaagagacaagctactcaacagatagctaaattctcttcaaagtttatctttcagagtgtgtcttggtgtcactgtattttcagttcatatccaatatattttatatcttatgtactccataatgagatttgatactagaataataatatggagcattatagtgctgattcctcagagtgttttatatagtagatgctagaattttcatcagcatgaattgaaataaaataggtgttctgcttaagtgttggtttaccagaaaatttgactatcactctttttctttcacctcagagtaatctagattttattttaatggtgtcagtctttaactgcagtaaacataaatggattcaagctgtgtagtccctttttaagcattccttattgaaacatctcatctaaataaggattatctgtgttttgcactgttggttttggtaactatacgtgaaggaaaaattaggtaggatggcagtaattttaaatggtaaacatcctaagagatgaacatgatagtagttttgaaattcagaaattccttggaaaaatatgatggtttcttaatgacacactaaagtctacactgctcccaaatgaccgaaataacactttcaatttcctatagctttaatataatctttctttatatagtatgtgaattgtttttttaaatacattctgattttcttaccaatttctacatttttaaatgttcaccttcccccagtgaccatgacaacactgggaaatatgaccaggcccataaagcatgacactagtacaaaatttcctcaagtttatatattgggcatcctaaacttgagtgtaggtatgggcaacatcagccggtggagtgtgagatggcagggactatggtgagcagaggagtgtgtgctcatgtgagcggggtggcggctgctggatgcatggcaggtcgctgctgttggggagtgctgatttcatgttgttggttctttccatttttcatgagaagccagaggtctggaattttggatgaaattttcagtttaaaaatcacagcagcttattcaaatatttaaaaaaatactctgtgatcccaataaaacatcctctaacaggtaactagtttttaacccatgttaggatatttgtggtaaattaggactgaacagttttaaatggacttcgtttagattgttttgttggttagatatagacaatacagataaatttcaacctgtaagtcagtattaggtttcttttttcttttctttctaatataaaatgctttgcaaatttgcatgtttttcttgcacaggggccatggtaatctttgtatcatttcaattttagtatgtgcgctgctgaagtgagtacgatattcagtttctttatctggaaaatcagctttgtaggttcctttttccttaactgtccaaatattttatatgggttaatatatgtgtgtccatgtgtccatgtgtgcatgtgtatgtacatactaacttagaagaacttatagtgattatatgtttgagtcttaaaaatgtattcatttatcttttttttaaattgcaattgcagaatgtttcctatggactcaaagccttcactgttaaaccccactggatctatactcgtctcatctccgttaaaaccaaatccactggatctgccacagcttcagcatcgagctgctgttatcccaccaatggtaagtttttattgtgaggaagaaaactaaatatgaaaaactgagacctttatagacatatttcttctgttctttaattggttcttgattaaaaaaatagtggtacaaaacataacatgaaattaataatcgtaaccaattctaagtatacagttcactcgtgttaagtgtgttaagtatattgacattgtttagaaaatgatccccaggaccttttcatctttcgaatgcgaaattaattaaacaactcctctcttcctcctgccgcttgccactggtaaccactgttctgctttctggttctatgaatttaacacacagtttagataccaatgaactgttctttcccacaatacttactataccaaatgtatgggctttttcctcacaccaacgaattctccacctctttggtcaccaactaggttcctacagttcagttcaattcggacaccaactacctggcgtaatcatctaataccacaagtgtaagggctcagtaccacaaggctacccccatttctgatgccagttctataggtattgggtccccaggttactcacgcttctgactaggctgcagactggggattcctccgactctcctcgtcaggttccataatttgctaaaatgcctcagagaacttaggaaaatgctttacttataattactagttcattataagggatataactcagaaacagccaaatggaagagatggatcgggcaaggtgtgcagaaggggtgtggagcttctgtctcctatctaggtctgcctccctcccagcaactccacgtgttcaccagcctggaaactcttaaaaccccatcatttggggtttttatgaaggcctcatcacataggtatgaatgattaaatcattggccattggtgatgggtgcatgaacctttagcccctctcctctccctggagggttgggggtggggtgagctggatggagctgaaagttccagcccttgctgggcatggtggtgcccaacagtactcccagccctgtattcccagctatttgggaggctgaggcaagaggattgcaagttcaaacccagtctgggcaaaatattaagagacatcctaccccaatccccaaagaagttctagcctcctgccttgtggttttttgggctgtcagcccttatcctgaggcaatctagaggccccagccaggagtcatcttgttagcatacaaaagacactcttactgctctggaaattctaaggatttggaacaaaaaaagtctttgggagaaggaccaaatatttaatttttattgtgccacattatgtcatataaatgaaatcatacagtatttgtcattttgtgataggcttatttcactcagcataatgtcctccaggtatacttagcaggtgccagaatttctttatttttaaaggctgaataatactccattgtatctgtatatcacattttattcattcatccattcatagacatttggattgcttccacctctggactattgtgactagtacctgtatggtcagcccttgattttagcaccttggtttttcttacatcctcttgtgctgggcttgggttagggagtgctaagacatatgggagagaagggtaggaagatgctgagtctaactttgagtaaactctttgagataaccaaaggttatatccttagtacattgctttttcaaatgacttgtgatgattgattgaaacggtcatttccagttaagaaaaaaaaagaaatataatgctctagccataaatattagtaagtcctgtttttgtttgtaaccacagcactaaggagccataaaacagtagtagcattaagcatgtaattaggttttgaatagttagaataaattgtagagattatggctaactccagtatacaatttcaagtctagtttatttttatattttaccttaataatctacagatttcaagtatattttatttatattttaccttaataatctgtaaaatttgactcatttttgatactgaattccaatcttgggtattgttcttttctttattttattttttttttattgatcattcttgggtgtttctcgcagagggggatttggcagggtcataggacaacagcggagggaaggtcagcagacaaacaagtgaacaaaggtctctggttttcctaggcagagtgtttgtgtccctggtacttgagattggggagtggtgatgactctcaacgagtatgctgccttcaagcatctgtttaacaaagcacatcttgcaccacccttaatccatttaaccctgagtggacacagcacatgtttcagagagcacagggttgggggtaaggtcatagatcaacaggatcccaaggcagaagaatttttcttagtacagaacaaaatgaaaagtctcccatgtctactactttctacacagacacagcaaccatccgatttctcaatcttttccccaccttgcccccttttctattccacaaaaccgccatcgtcatcatggcccgttctcaatgagctgttgggtacctcctcccagacggggtggtggccgggcagaggggctcctcacttcccagtaggggcagccgggcagaggcgcccctcacctcccagacggggcggctggccgggcggggggctgactcccccacctccctcccggacggggcggctgacccccccccccacctccctcccggacggggcggctggctgggcaggggggctgaccccccccccacctccctcccggatggggtggctggcggggggggggggggggnnnnnnnnnnnnnnnnnnnngctggccaggcagggggctgacccccctaacctccctcccggacggggcggctggccgggcggggggctgaccccccacctccctcccggatggggcggctggcctggcgggggctgaccccccacctccctcccgggcggggtggctgccgggcggagacgctcctcacttcccagacggggtggcagccgggcggagggtctcctcacttctcagacggggcggccgggcagagacgctcctcacctcccagacggggtcgcggccgggccgaggtgctcctcacatcccagacggggcggcggggtagaggcgctccccacatctcagacgatgggcggccgggcagagacgttcctcacttcctagatgggatggcggccgggaagaggcgctgctcacttcccaggtgggatggcggccgggcagagacgctcctcactttccagactgggcagccaggcagaggggctcctcacatcccagacggtgggcggccaggcagagacgctcctcacttcccagacggggtggcggccgggcagaggctgcaatctctgcactttggggggccaaggcaggcggctgggaggtggaggttgtagcgagccgagatcacgccactgcactccagcctgggcaccattgagcactgagttaacgagactccatctgcaatcccggcacctcagaatgccgaggctggtggatcactcgcggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcggcacagtccagctttggctcggcatgagagggagaccatggaaaggggaggagagaggggagaggggagaggggaggggagccggagtcactcttgtttgaacacctccaacactctcaatttttctttaggcaccagaaaatgaccttgttcttttctttagttattttctatttattcaaatatttaaagctcttgctttattcaaaaatgtgttttctatctcaaataataagtggtaaaagtttttaattgtgtacttaccacaaaaagatcattaaacatttgttcattcactgactcattcaaatggacatttattgagtgattagtttaagataatgttcttaatattgtggagagtatttatatattatagcctctgatttcaaaaaacgtatggaccggtctgcataataaggcaaagaggctgggcgtggtggctcacgcctgtaatcccaacacttttgggaggccgaggtgggtggatcacttgaccgcaggagttccaagaccagcttgggcaacatagcgaaaccctgtctctccaaaaaaaaacaaaaaaaaattagctccgcatggtgccatgcgcctgtggttgggaggctgaggtggaaggattccttgagctcgagagtttgaggttgtggtgaggtgagatggcaccactgcactctagcctgggtgaaaaagcgagacactgtctcaaaaaaaaggcattaaaaaaaattatcgtaaaggttaaaatgaattaaaatgcgatgctctattaggttaaaaaatactatggatgttttggagaagagggagtgtcttcttaattagacacttacagaagactgcataagaaataatattttcattggatcaaaacagctcatttggcgttatagcaaaaggaggaaaagctatgtttatatggaagacaaagcacaaaggcaagaaagttatgggttttaggatcagtgaataatactacttacgctaggggaaaaactatggaagtcttaagttaccagattctaaaaaaaagtcagacctctagggctttctagggatatttgttattcatgaggtatttaatcctggactgtgttctgggctatttttttaagtattggacaaaacatcttgggttattttcttcataaagtcagagagacagaaaaataaaacagtttcaaactggcaaatactgtgtactgtgaaagcagtgaacaggcctcaatgagaaggaaaacagggagggtatcaccatgttttattggatggttatggatggcctatcttaaggaacagtccatttctatcctaagggaatggctatgtgaatgagttggttgtgggagaggaggagattaattagtcaaggatggctgccaggtttctggctgaagcacctggggttccatgtctaaaatggagagcaactgaagaagaatggagtttcaaaaatgggaagttccctttaacataagttctgagcttccttgagatatcccaagtggagttgttaggtaggccattttatgtaagtgtggaacttggagaaagtgtcttgaggaagtagaaaatttgtgaatcattaacaaatggatgacatttaaatcaacataaatggatgtgatctgccaggcacggtggctcatacctgtaattccagcatttcgggaggctgaggtgagtggatcacttgaggccaggagttcgagaccagcctggccaacatggcgaaaccccttcgctactaaaaaaaaaatagaaaaattagttgggtgtggtggtgcacacctgtaatcccagctacttgggaggctgaggcaggataattgcttgaacccgggaggtggacgttgcagcgagccaagattgcaccattgcactgcagcctgggcaacagagtgagactatgtcttaaaaaaaaaaaaaaaaaaaaatatatatatatatatatatatatatatatatatatatatatatatataaatggatctgatccctggtgaaagagagatgagggatgggacctagggccacaagggacttggctgccataaattagaatcagacagatgtgttgtaatttctgatttttgatttctgttattacagcttgtgtgatttatattgtgatcagttctgaaagaaaactaggtcttgctgtgttgcccaggctggagtgcagtggtgcaatctcagcccactgcaacctctgcctcccaggctcaagtgattctcatgtgtcagcctcccgagtagctgggactacaggcatgcctcactgcacccagctaaatttttgtatttttggtacaaagatacaaaataccagccaggctggtcttgaactcccgacctcaggtgatctgcctgcctcggcctcccaaagtgatgggattacaggcatgagccactgcaatgccttaagcattattcttgaagataactttgattaaaaaatgataaaatcaattcaaccaataacatgacagaaataagcattacattacttgttaagagatggcaattattacattggttgtttgcatatttcgatttattttcttcctataggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggtaggtagatagagctatcaccaagagaacttttatgaagggaaataaagctaaacccaaaagcagtgtccattgtgctttgtaagttgtcagcctcccaactgattattatatttgtcctaacagacacagttccttaaattgaccttaaactatgaagaaatgttagtattattaactactaaaggatgccagtaacatttttaatagcattctagttaatgtgaattttctgatattcatctttgtgctggaagacattataaataaagttatgctttatgttccgttcatctgaattttcagagtgagaattgttgtcctgtccttgaagcaaatcaccttcaagtattacagtgtaatattcacattctctggtagatgagagacacaactttgtgtagtggatatttccaatcagacgctggctaagccttcaccttggcatttgccagctgtgtggccacaggcaagtcacttaacctttcatagctttagttttctcatctgtaaaatgaaaataatagtacacgtctaccttgctgtggttgtaaagttaaggaaggagcattcggtattgttatataacaggtggctctgcattattttatgtataatgtagcacgttattacatattaattagtgtattagtactgtatatacacagtagatactatggaggtacctgttttcattgttacatcactgtttttatttcaagtgatggatttgagttggtccgttgctgttttagttggtgtgtgatacacttttactttctttaaaaaaagaagaaaggggtggtttttatgttttaatacattcttctgacatggttagaagaattggcacatgtttctggttaagaatgagtttatagtctacttatatgctacgatatgcttagaatatcagaatactgaaatagtctgaatgattcagaagattctttacagtactttatttagctaaataagagctattagctttacaatgccatgcattccaagggttatttaatataaaataggaactgtggtacttaactgatcctgctgactctgcccagatcacaccaatattgagttattagttgcctaatacactgaacctcttatgttagagttttaaatttaaacttgttaatttttaaacataaatcttgtgctaggaaaaatgtgaaccagaatgataatatccaccaaggaatataaaaggcgctaaatgaatatttccttgaatgaaggtagaaatattgataacttttaggcttttactctgttgggtctagggaattcttaatcgctagttctgtaattgacacaacatgtactcagtaattacaccttaaaggaatgaattataaatgaatgacataatggagatatccttatcgtgtttcactacagggtattaatggacatcgcaggtgtttgtcttttgaacattcgaattatgaggaaatccgtcagtggaaaatgaaactttagagaataaaagtctctggatgtattccttacatttattatttaggatagattttgtgaagaagtagtaaaagttagaaaaatgacattcagatggtatcatttgttgaacttatgacaaggcataacatcattgttagtaatatctgggtcatttaaatatggatatcataattttaaagcctcaatatcttttattggtctgctttataaaatgagttgtatttgggaactgaagaaactgaaccaggctggagccccaaattctgagactccaaactgtgaattgtatttctctgtgttagtcacattactacacgtggtttagatctcagtggtatcctaatttttaatcataattcagtcatcttaaaatcaaattgtaattatacttttgattagtatgacattaagaattttacagtttggtcgaaggtgatgctctacaaagtagggcaagtttatccaaaggttgttttgttttagctaatctccctagtgtattcatcctgtaatttgtttaacaagtaccagaagtttttccttgagtctatcctgtagttcagtgtataggataacctttcaaataacatttaaatgtttgcagttaagatgcttgtgtctagaatgtttgacaaaaatggtttaaatttaacctcatagaacagtttatagaatgtgaagaatagtgatagtatggatttatgtataaagtatcaccaaatattggtacagtccacctgaattagggccatggtttttacttttcccttcatggtctcttttagcaagtaacaggcagcacttgttgtccaactatttggttgtatttatttctcttaatgtgaatggtataaataattactgtaggtatgcctgttttaagttgcttaaagcttttcccatctgtagaaaaggttgaaaaaaaaccttagagaattgttttcacttaccagtaacatttatacgagttgacctctgctttactgataacttttaagcctcttttctacagtgaaggaactcaaacttaagcatatggaggtagagttagaattgaacttctaatgcaaatttaacaaaattatccaattaaaataagagttaatgcttctatgtaactgaccctagtttgttgcatgtttattttgttgctgttgctgtttttcttttcctgctctgggtacatggtgatgtagatagctgtgtttagaaccatccaatttccatcatttaaaaaaaaaaaaaaaccactactatgaccagtggatttttttttttaaacatagttataaacttactggaaatggtaaaataatcagacattggatttttaatacattatcatattaaattatctaggaaagtgattttcttttggagttggttatttcataaatctgttttctcagtattaggacacttactctaattcattatattaatatgtcaaagaaggaaaaagtaccatcgtcttgatggatacaccagagacatctgaaattccacacccagtcctttagtgagacactattgcactgtggtttagagctaacggtccggaattatactgcttttaaaaaaatcgctggtagaccttgattgggcaattagatgtgatttttctgagcctcagtttcctcatctgtaaaatggtattaataatcacattggtcttgagggctaaatagatattgtatgtaatgcacactgcctagcacttgaatatcagttgatatttttgtaattgtttctgatttttaaaagcaccttacaaaagatagtgtagtaaggaaataagaggtttaggtatttgaagggaaaagacaaattatttacaggataagattattcacctagaaagcctaaaagaatcaactgaaaagttattagagctaaaaggaaagttcattaggtttttcagaaaaaattattacacagaaatccgcatctttcctgtatgtctgcagtaatcaggtttatttatataaactcatatatataaaagagatggttttcttaccaatatgacatatctaggaataatttttaacaagcaagggatggaactatctgacaaaaacaagatttctcaactagaaaactcattattataaaatatcatcacctgtttattcataaatttaatacaagtctaatgaaaattctatttattctttgttttgagaggaagtactcaatgattttaaatttagatttacttggaaagataaatggatacaactaggtaatgaaaataataaataaaatgagtgggaatttattctgacagacattaaaatgctacaaatctaagtggtcagggttacaaatgagttttactttgtgcttttttgattttcaaaaattacagatgtttcattttaaaaagaaactatatattttaaagtcttaaatatgactgcatttctggcgtgccctttaaaatatttaaagtttctttatgctttatgtggagataacttacatgagaagtaattttcattagtattattgtagttatattcatggtttttataagcttatgtaggatttttgaattagtttgatctgcatcttttgaaaggcttcttccatttcttaattaaatatatttctgtgaatattagcaaggagtgagcttcaacaggctaattataagacttgtgaaatcctcgcaaagctaataacctccagtcaggccagatttgaattaacagaattgcttgataatctgatgtttgcctgttgtgattttattgcatgtgaaaacacttgattctccttaagaggaaagagaagttctttttcctttaaagggaaaactcgtaaatgaatttttgaggatacacaggagatttagatttacaggatttcttaacttctctgtgggtgaattttgcccccaggagttttagactttaatgttatagtcggatcagcccctggatggtgtgggcttggtcctttcacacttactattttaatttggggttcttcccttattttgataactttaactttcataggaaaatcagtcgcctatatgccttatgctgaggtcaaacgtgctctagaacaggaagcacagatgcacaatactgcagcaaggtcagcctcaccgtgtaggctttctccaagagaagtcagtaaagccgctccacagcctgatatgagtgcagcccgctatagtgtcccgccaggtaaatatcactcctctgtgcagtggctgctggccatccacccacagatgttccacgtgggtggtttaatctcgtgaatgaactgctcttccaggacgtgtccttgctgtttcagaatgactttgtttctctgcgttccatcatcagttgtatttagttgagttcactgggccactgggaaatttgtgttcacacatttatactgtgacattgactggctcttcctttaagaagagtacatgaatttgtaaaagtcttgagatctccccatccccaaaattcaagtgttctgtgagagccagaatcagtaagtgtttctcaatatgcaagatgcaaaaaggatgtataactggttgtcagtcatgtctgcgcattctctgaagtagtgttatcagctgtttttaagaagtaccctaagagtgattggcgagagagaaaaaatttttgaagactgatgtttgctatgctaagcagaagtttgaaataagcatcagcttgaaagctgtggtttgaaagggagttgaatatttcaaccccacaaatagtatttgtgacaaatatgtatacaggcttacgtgaatgagaaatttaaaatagaaatgttcattgttggtttcatcttacattttttaattagtgatttaaaaattcaggaatgactgagagaggtaacatgttgtaaactaggaaatggactagtttaaaatcatttttctttccttttaaaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacaggtgaaacgacttctctttacagtagatttcttgttgaatatggctttgttaaaacttgtcctccctcctcgcactgatttgtcagagttgtaataaataataatctgtctgaatatgaagtttcaagagataatgaccagaagatgcagcagtcactgtactcttgccacaaatcagaactttcagtgagttatgtacccagattgagtggtcataacataccacccatttaattacacttggcacttggcataccacttggtttaatttacatcactctaaacttaccaagttttaaacttagtttcaaacagtagaatatttgttcactaacatatggtaaaggctcaaaatattaaattgtaggtggttagtattataatttattctgactttggccactaaatcttttttctggttcattactttttaaaaaattgagatatggtctggtcttcacagttccatcagttttgactaactgtacatcagtggtcacacccctgtcaacttattgaacacttccatcacttcagaaagttttctcatgttccttcccaggccatctccccttccactgcctgaagcaaccactatttgatttcctgttgttgtagattagttttgccttttctagaacttcctgtgaatggaatcaaacatggtgtactcttttgtgtctgtcttctttaacccagcataatggttttagggaattcatccagggttttatgtaatcagtagtttcttcctttttattgctgagtaataccagtttgtttatccattctcctgttgatgaaaacctgagctatttccagtttttggcagctatgaataaagctggtcattcttgtaatgggttctttgtggacatatgtttttatttttcttgtacaattacctgggagtggaattactaggtttgtgtatgttttatacttttccagaatggttctacaattttatgctgccactagcaatgtatgagacgtgattgctccatttgctgttgtcaagtcttggtcattttagtcatacttggtgtgtagtaatatcttattgtggttgtattttacatttccctgaaaacaaacaatgttgggcacttttcatgtgcttattggccatttgtacacctatgaagtgactatttaagtctgattatctgtttctactgggtctttttgatactgtgttgtagatctttattatggttgaaagttctctgttagatatatgtattacaaatattttctctgttttttgtctgtttattttcttactggtattttgatgagaagtttcaaatttttatatagtctaaatatatatacacacttttttctcctatgattagttttattttgctaagaaatcttggcctgctccaaggttgtgagatattcgcctgtgttttcttctgaaagctttataattttggcttttatattgaggcatgtgaccagtctcaaattaatttttgtgtatagtatgaggtcaggattaacattcatctttatttaaatttctagttgaaaaatagcaccagttgaaacgtcttttactcatttgatcgcttcagttcctttgttagaaatcatttgacagtatatatgggtctgtttctgcactgtctccatgctgttccactgatctacttgttcatcgttttgtcagtaccacagtcttgattactgtagctttattgtaagtcctgaaatcatgtagtataagtcttcagtgtttttgtttttcaagattgttttgactatttgatgtcttttgcattttcatataaattatataatcagcttatcaatgtctgtctcccccctttttttggttcccaagttttattcaagaactcatacaaaacattccaggtaaatgagttataatcctcatcttccttctctttgtcctggttaatttggaagtaacacaatccgaaattctctttgctattagcagctacgcacgaccaatcacatagcttattcttcagatattttttgatgagctatttcaaataccctttggaaaaaggcacctcagaagttacggtgcttgtgttcttgctcctttcaatagttactacccctccaccaagattcccagcttttccattcactttaattctgtcttggagaaactgctcacaattggcagcatcatctgcggggtagatccagtcaagggtatacttcagaacctgctttttttctttttttgcccccactttttcatgggcacctggcagcagcagaggcagaaacaatctgtttgtcagtctacttaaagaaaaaaaattctgctgggatctcttctcttctctttttttttcttttctttcgccacttcatttattttatttgcaggagttgaaacatgttttaagggtgatgtttatttccccccccaaacatgaatcatttaagtaaaaccaacttaactgtagaaatgtagcaaagtaaggggaaagtagcacaaaccacccaagaggcaaaggttgtggggaagaggtgggtgcagtgagcatttaacatatgcataaatgctttacgattcacctgctcagcactgcctccccagaaggcgagcatagggaactattttacgaggatgtttccccccaaacatctgagaatgcttcaaattatagtttaaggtttaaaagaccaaaaaaaaaaaaaaaccatgaaccacccatctgctgggatttttgttgggattgtattaaatctatagatcaatttgaggtagaaatggaaatcttacatcgaatcttctaatctatgaacttgtatatctatatctctcagcagcgctttaaagttttcactttagagatttgtatgtgttttgtttgatttatatttggctatttgattcctttaaattttgtttttgttttttttttttggacaaagtcttgctttgcagtagtgtgatcatagctcactgtagcctccaactcctgggctcaagcagtcctcccacctcagccttccgagtggctaggaatttttttttttttcctttttttgagacagagtcttgctctgttgcccaggctggagtgcagtgacacgatctcggctcactgcaacctccgcctcccagtttcaaacaattctccagcctcagcctcccaagtagctgggactacaggtgcacgccaccctgtctggctaatctttttgtatttttagtagagacggggtttcaccatgttggccaggatggtcttgatacaggaatactgaatagtgaattggtgaacatggacatgaatttcttgttgctcatcttagaaggaaggcattcagtattttactgttaggcagaatgttaagtttttcatggatgtctttcatcagattgaagatgtttccttccgttcttagtttgctgagacccacccccacccctagttcttatatttttttagctccagaatttctattttgttctttttaatgatttctttctctttgttggtgttctctatctggtgaagtatcattcttgtactttcttctttttttttttctttttctctctcctaaaacaattctgttgctcaggctggagtgcagtggcatgatcttagctcactgtagcatcagtctcctgggctcagtcaatcctgcctcagcatcctgagtagctggaactacaggcatgcatcactatgcctggcttttaattttttttttattttttatagagacagagtcttaatatcttgttaaggctggtctcagactcttggcctcaagcgatcctcctgcctgggtttcccaaagtgtaaggattaaagaaggcaggccactgcacctggcctcctttaatttagacatggtttattttagttcttggaatacatttataatagctgatttaaagtctttattcctgagcccaaagctcaggaatattttctgttccctgctctgtttcatatgtatggctcacactttcatgtttctttgcgtatcttataatttttggtcaaaaactggacattttgtataatgtagcaactctggaacttggatcccccccacccccacttttcttttcagagcttgttgtttcttttggctgttattatttgcttagtgacttttcttaactaattctgtaaagtctgtattatttgttgtgtgtagccactgaagtctgattaacttagtgatcagctaatgattagacagacatttccttaaatgtctaaaatcagtaaaatcagcctttgctgaggggtgctctttatgtgttgggcacttaacagctttgccttagtctttacttcctggcgtgcagagccttaagggcagcctaagttgagagcagtggggccttcccatgtctttcctaggcatattcatagccttgcacatgcatgtagcattctaggttctagggaatatgttggagtttttcagaccccatgaacatctcattccctggcttttccttttaagtgttttggttagcctgttgtttaccctggctgttatctactgtctcaggcagtggagaagttaatcagttgcctctgattgtttttgacaagtctgcacctcctctcccactccagtcaggtcaaataaagacagctttgtgaatggagtctcccagagaaccaacagagaagtcaaacaatgacagttatctgggaatgaggcttttaaggagctccatccttgctctttcccttctagtggctgccaggcagccaccataggtttgcactatgattgagtgcttttggttttcaacacttccatagagtttgatcaggagaatgagaatggaacaagttaaaatgccacaaagcccattgtttttacctgtttttacctagattcagctttttttttttttttaaataaatatttccagatttctacaagcctttggttaatttccagggttctttaaaagtcgattcttacattgcttgagactgggaggcggaggttgcagtgagccgagattgctccactgcactccagcctgggtgatagagcaaatctctgtctcaaaaaaaaaaacaaaaagaaaacaaaaaaaacaaaagaaaagaaaagaaaaaaaaaggttgattcttaaaatttttccaggttttcttgttgcttttatggaagagagtttttggaagtccttattactttgctgtatttgctgataccactctccatagcatttttagtcggaatgaatattaataatagtagcttacattttgattgcaacatataagtgctttatttatgtaatttattaatagtaaatactatttacatgtaatgtatggtaattttagaagacatatcctactccctttaaaattttttttatatttaagcaatctacgatgaagattttcttgctttacaaaaactattcttggttttgggtagaaggggtataattttttttttttttaaacagaaatgggaatgctgactttgtgaaattgaccttgtgaaaaaaacaatgtttgcttaatctttaaatttttttttgtttttttcttagggaacaccaggcacttatttgacttctcataatcaggcttcctacactcaagaaacacccaagccgtcagtgggatctatctctcttggactgccacggcaacaggaatctgccaaatcaggtcagtgagttaatacagtcataatgcatctacgtttgtagcatcacagccagtaatttagtactggattgtttcatgtttctctgcctttccacagctactttgccctacatcaagcaggaagaattttctccccgaagccaaaactcacaacctgagggtctgttggtcagggcccaacatgaaggtgtagtcagaggtaaaatatgctggttggcagaaatgttaaacttttgtccccaataaatttattaaagtaagttattaatatattttaatgatgggcttttttaactatagtctttaaattctaaatttgttttctttccatgtaaaagtcattttaaaaccttgaagttccatgtttcagcagttctttagtattattttggaagtacattttaataaaacaaacatgatgggttttgtgctgcttttttcttttcttcttagttgagtactctcccaagtaggggctgtttttttatgttttggggcaggggctgggggtgtaatttgctaatagctttgtttgtattcaggtaccgcaggagccatacaagaaggaagtataactcggggaactccaaccagcaaaatttcagtggagagcattccatccctacggggctctatcactcaggttagtcacgatcatctctgatatactcaacagaagctcaggaaaaaatgataaataattcttagcactttggctattttgtggcttaagttcatttttctgcattatgggactgggtctcataacctagatctgcaaactgtctccacagagacgttaatgtgatcattttgactacaagctatattatgaatactttggttcatttgaaaaggtcacttatttgcaaactggaaaaagaaatatgttctaattgatgcagctcttattgtcttcctggaaaagcttttaccatgtgtttagcctaaatagaaattgagaagaaaatcattacgaattatttgcttacttttgccctggtggagatgtagttgtagaatctcagtatgtgggctgccttgttagaatctaatgctaaaccaggaaatgtggatggtattaacaaaagcaccagaagccttccaattttgggctaaatacatcaccaattttgattaataaaatttctctcagttagttgttaattttaacttgatacttaagaagttcttagcctctttatgtatatgcataagagggaaaattctgttttgggaaatcattgtaaacagaaacctgtgccttgcattttctaaagtgttcactcattgtcacaagttttttatttgtctagttactatcctctaagacagttgttctcaaagtatgatccccacaccaggagcatcagaatcacctagaaaattgctacacatataaattttcagatcttaccccagatttactgaaacccaacccttgttggtggggactggcagtctgtgttttcccaagcccttagctgattcagctagggctttgctggccaagtgtggtttgtgcaccagagcattggcatcactgggatgcttgctagaataatgcagaaatgtcagtccgcactctagatcatgtgaattaaaatccccattttactgaggttcccaggtgatttctttctgaaatgtagtttacatactacttccttgtggttaagttaaaaacagaagaaaagaaagttacatactgactcttaaaatctctctttttaggccaggcgcggtggctcacgcctgtaatcccagcactttgggaggccaaggagagcggatcacgaggtcaggagtttgagaccagcctgaccaacatggtgaaaccccgtctctactaaaaatacaaaaattaggcgggcatagtggtgtgcgcctgtaatcccagctactcaggaggctgaggcaagagaatcacttgaacctgggaggcggaggttgcagtgagctgagattgtgccactgcactccagcctgggtggcagagtgagactccgtctcaaaaaaaaaaaaagtctccatttatattgggtcagtgtgtttctgttttaacagcaagctaatactttaatatggacagaggaaagtaaatgggcctgtatgtattattctttctcttcactctggcatccaaactgtgggaagaaagagtatgaactgggccaaaggagactaaattttatctgtttaaaatctgtttgtgcacttgacatgagtacttctgaagtgggcgttaaggatttctagacacttactaatgagttcacttaatgactggacaagtaagtgtatgtctcttatcgcttttcttaagcatatggtatcagattgtgctctctagggttttagcagtcctcagagtatagtggtgaccctaaatgtgagtaaactcagtctaggcctctaactcctattttacaccaagctgctctctcttgcaaaatgctctacgtattagattctatgaacaattttccttgaaggaagggctcgctgcttaaaggaagggtaaaaagaatcatggtcattggcaactccagaggaggattgatgatggtgaaaatatagataacctgacctaaactgaatcagtgtcaaaacacagaggcatccaaaggcctaacaacctagtagtcagtttgatatttgaaagttatttttccctcatatcacaatttgagaaaaagttgtagtactctaaatttaaaactactttatcatcttatttttattagaaaatttatattaggttggtgcaaagatgtgatttcggactgtgaattttaaatcattataactaggctcaaacgcatctttatcaaaataggaaccattacaatcaacacatttttgccagtgagaaataatcttgttcattcctgtagcataaaaatacatgcttcgagattcaacaaactcttagaaagcattttctttctcttttcttttctcttttcttttcccttcctcccttcctcccttccttttcttttccctcccttctcccctccccctcccctcccccctctcctcccctcccctatcctctcctcccctctcctccccctcctccccccctcccctctcctcccctctcctcccctctcctcccctctcctcccctctcctcccctctcctctccttccctttccttacctttcctttccttcctttttgcttgcttgcttttttgacagagtcttgctctgttgcccaggctggagcatggagtgcagtggtgccatctcagctcactgcaacctctgcctccagggttcaagtgattctcctacctcagccacccaagtagctggaattacaggtgtgcgcagccgtgcctggctaatttttgtatttttagtagagatggggtttcgccatgttggccaggctggtcttgaacccctggcttcaggtgatccgcccgtcttggcctcccacagtgctgggattacaggcgcaagccaccacagccagccatggaaagcattctgctgcttgtggaagaattttccctgcataaagttgtcgagatgcttgaataagtggtagagagagaggtcaggtgaatgtggcagatgaggcaaaacttcatagcccaattcattcaatttttgaagcattggttgtgtgacacaggtgttgtcgtggagaattgggctatttctgttgaccagtgctggctgcaggcattgcagttttcagtgcatctcattcatttgctgagcatacttgtcatatgtaatggttttgccgggattcggaaagctgtagtggctcagactggcagcagaccacctttttttggtgcaagtttggctttgggaagtgttttggagctgcttctcagtccagccactgaggtggttgtcgctagtttttgtataaaatctacttttcatcggatgtcatgatccagttgagaaatggtttgttgttgcctagaataagagaagacacttcagaaagacagtttttaaaattttcgctcagctcatggggcacccatttactgagctttttcacctttccagtttgcttcaaatgccaaacaaccgtagaatggttgacgttgagttctttggcaacttctcgtgtagttgtaagaggatcagcatcaatgattgctctcaattggttgttgtcaacttccgatggccggccactatgctcctcatcttcaaggctcttgtttcctttgtaaaacttcttgaaccaccactgcactgtatgcttgttaacagttcctgggccaaatgcgttgttgatgttatgaattgtctctgctgctttacaacccattttgaacttgaataagaaaatcacttgaatttgctttttgtataacataattttcatcgtctaaaataaatataaaacaccaagtaataagtcattaacaaaaaaagtgacaaatgcacattaaaatgatatattgcgtaactacattcagaagaaaacaagaacttaaccacatttatttaagaatgtattccagtatcaaacggcaaatttcaacaacgcaaaaactgcaattacatttgcaacaacctaataaaagctgttacatttacttgattttagtccttaagagaaacttctgagagttaaatcctgtaatagagtcctcacatgaaggtgagagcaaagttgattcacctaatgtacgtgtcataattttaagtgttatgtggctgagttgaaggatgaaggtacaggatgtcttcatgttgataaaaattcaatgtctaatttcctttcatgtatgtgtgctttcttctttgaagctatagattagcctgactctgtcataggttaaattttctgagcatcttgtgttttccctaaactcgagtgactcctctgctatttatgcttgatttgatggcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgatagtaagtattgtatgtatgcaccaaagccagtattacaatatgtgctaaaaacataggcttgggttttcccgcatttctgctctctgggagtcagtttatctttgctgagcctatgttttctctcagtaaatggggttagtaatacttgtctcatgagaattttgtgaataacagcttagtcgataaaaagtaattaacaacgcagagctcatattaaatgtcccataggtggtagctaagattgtcgactgtggtcagtcagtttagcttaggtaaagagcctttgttgaactttaatggaatacttttattttgaagagattcatgttttatgaattaagaattagagggtagataggctgggcgcggtggttcacgcctatctactatctaatcccagtactttgggaggccgaggcaggcggatcacaaggtcaggagatggagaccatcctggctaacacggtgaaaccctgtctctactaaaaataccaaaaaattagccgggcatggtggcgggcgcctgtagtcccagctactcgggaggctgagccaggagaatggcgtgaacccgggaggcagaacttgcagtgagctgagattgggccactgcactccagcctgggcgacagagcgagagtctgtctcaaacaaacaaacaaaaagaattagaaggtagataatattctgataatcttgataatattaaatactccttaataaaactattttaatgtctatgtacatttttttagatgtattcttgttatattttctcagtagtagtattttataagaatgactcaaatgtgatagaaatattagccaaagttttgagtgaatttgagttcttatttgcacctgactctgtgaccttggagtagtcatgagctatgctttctcttccaatacaaagaaataaagtatgtgcgtacatagtgccagatgctgcaaaatgcttgatagcattcttatttccctctcctttacacgtctggcatattatgattcacattttgtttttggggttaagaaattaataatgtacgttgtccatatcagaagtctacacacctctgtttctttccacatccaccaaatcactaagccatttctgtttattttcctaaagtgtctagaatccatccattactctgtattcaccactgtcaccatcatctttaacccagcagccacctaactcatctccctaccttcagtctcacccatattcaaagtgtgtaccacgtcactccttgactgatttttccatcaccctggatataactgcaaacccctaccttagctttataacccctccaggagctgctttcagcttagctcttcacatttttcccttctcacttttccctttagtcccctatatttacctcccccacactcttcctcccaactccactctacacattagccggttaccacgcttacgttcttttattgtacctttctctgtctcaccttggggtcttcgtgttcactgttcacactgcctgtactttttcctcctattacctttgacttgaacaactcttattcatccttcattctcagcttacacattgcttcctctgagcaggcttatctgaacctggaggtgttaggtttctctcctagcattttcatagcacattatacttctcctttcatagcttattttactacataatctgtacctacattattgtgtaagtttcgtgcagaaagggacttaatttgttaatcttacctgcaagcctagcttatgcctagcacacagtaggcatcaataaacacatttgaatgagtgaaaatattttcatgaatcatctacacatattttattgtaggttaagacaagttttaatattattatttttataagatagactatgaaactaacctatttactgtacattgtataccatgtgctccgtctgagcaagtcttgtttgtgtattctgtagatattaagaatgcccgagaagggactaggagtccaagaacagctcatgaaatcagtttaaagagaagctatgaatcagtggaaggaaatataaagcaagggatgtcaatgagggagtctcctgtatcagcaccgttagagggtaaagcattgttttcagaatgttattttgatacatgttattttatatagtaattttgcattgttgaattaagttgtatgcaatttctgtcatttccacctgaaatgtatatttatattaagttgtatgcaatttctgtcatttccacctgaaatatatatttatattaagtttatatctgtatctaaagtggcacataacaatggaaggaagtcaaatttaagcgtaattggtcatatcataggttactattagaatgttcatatttgaatgctcatacaatttgcagattattcctgtttcagctaagtgagttaaaaaaggtaaagtttattatgagaacttctttttgaattgtgagacagataaagtggtgtaatggataaagacatgaatttaaatttcagcttcacccttccctggtaaaattcctttgagcctgtttcttcctctgtaaattaagggatcgtacctaacactgtgtgagggttagaggcaggtgtctgaactggtgctgctcatgtgatatggcttcagtacatgatcagtatgattttgttttgttaatggcccactttgtttaaatcttaacctgcctcaaccaattttaagctagatgaaatactaaaagcagggtaagtcctgtgtaattttctaagagctgtatttttctctatgttaaaaacacacacttttactgtaaatatgtgtggttatttctaacccttgatttatatttatcagcaacaataatgtgaagcttcttaggaggttatttacaactctttcgtttcaatttgcatgtttcatttaatacattttccctatttttatggtatccatatttcccgttttccctttatcacaagtatatttcaaagctaagcaatggtttccaatcctgtatcttctttcctcttgataaagaagtgttgggattttagatttaactttgaaggtatctttccttttcaacctttcattagatgcctttggtggccattttttatttaggaaaatatttacaaaggactgtgtgatgtcatattaggtacttctggatagttcacaaacttaaattgacattccttccttcatagagcatttatcaaaaacatagactttaagaacagcattcagtatatgtgagttgacatatacattatgttgaataattgaattgctttcttgttttggaagggctgatatgccgagcattacccagggggagtcctcattctgacctcaaagaaaggactgtattgtctggctccataatgcagggtaaactttctgcttgttttgcatttttatttataactgcctccctggcaaaatagtttgacattaatttacagtgtatttctgcttttcaagttattttcccttttgaaatattaaagtcttggttattacttttctgcctctgagctacataatttattggaagatgatagttgcttaatcttttaatatagagatatctttattatgcaagaaccattctgtgactattatgaatgatgcattaatatcatatctcaagcaaccctaaagaaataatgattgataaatactgatttgaggatctactgtaaacagaaagttaattagaaactacaagatgtcaaggcattattttaaattatgttaaaatatatgtaacaaaatttaccattttaaccatttttaagtgcacagttccgtggcattgttgtgcaaccatcagcattattttaatgtttcctgaattctttttcaagggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccaggtaactaagttttggctctttttgtcagtaactgatatttatggaacatttaaaaaagtgtgacttaataattataagtggttcttatgatgtcagacctcctggaagtaaacatgaaagtttcctgtaccttttttttttttcctctgtggaccaggctggagtgcggtgtgtgatcacagctcactatatagccttgacctcctgggctcaagcgatcctcccacctcagcctcccgagtagctaggactacaggcatgtacctccacacccagaatttttgtatttttatagagacagggctttgccatgttgccaaggctggtctcgaactcctgagctcaagtgatctgcccatctcagcatcccaaagtgctgggatcacaggcgtgagccactgtgcttggcctttgtgtaatggcacgatcttggctcactgcaacgtccgcctcctgggttcaagcgattctcctgccccagcctcccgagtagctgagattacaggtacctgccaccacgcctggctaattttgtatttttaggagagacagggtttctccatgttggtcaggctggtttcgaactcctgacctcaggtgatctgcccacctcagcctcccaaagcgctgggattacaggtgtgaaccaccatgcctggccttgtgtacttcttatcatcaggttttcttatgtctatagcatagagtgtggaatgtgggaaagtatgcagcttgggatcagtggggttgtgattgagatttgtaaacagaccaaaaaagatcaccacagtgaactgtaactgccatgggccagacatagacctgagatagaaaagtagccagatgactttgctacctgtaatgtttgtttctttccctttagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatggtatgttacttttgttgcttggtctgatactttttattgcatttaaaaaaaaaaaaaaaaacctttgtcaagtagtaaatatcaaattgtcagctttagagtatcccaagatctacaggtcttgcttgagtctaggagtatggaaggctactaatttaaaagtaggcataatttaagtaaaatacctgatatttaaatcaagtgcagattatgatgcagtccagaaatgctatagagtaagtatatttttagagtggattttcagccaattgcataaggttttctggaagtcagttttgacattgttccttcagcggcagtgtggtgtgaaagctgtaagtagcctctggaacaagactgcataagcttgaattaacattcttactgcatcaactcagatgagttacttagtttttttgtagcttagtttcctgatctgtaaaatcataatgtaacattaagacctacctctctggattgttatgaagatcaaataaggtagtacatgtaaagaacttagaatggtgccgagtatttacgaagggctcgataaatgtgaattattcctgttggtgttactgttgttattattgttgtcactataaccccatgctactggcagctacatcagttgagaagtgatttttaccaagtggtccctatcaacctgaggcccttaaaaatgcatccacttaccattttttattataatacaaatttattgatggctcacatggtacgtcctgggctgggcactgtgagctgtacaagtgtgttttggcgggtgtgaggggcgtagcacagagtgaggagaaggggaagtccttgttagggatggggaggtgagtccaaatgcttgtagctttagttttgatggcgaattgccctgcagagggaagggcactccatatttgagcacgctgggacttggaaggggatgtgataaaccagtgtgatttctttctttgggcaggcagatttgtttgattgtggtaaagtttatagtatcaaaatattagtaattagatgtgatggttacacagccatcatgcttgtacttaatgccactgtgaattgtaccctttaaaatggctaaaattgtaaattttatgttatgtatatttcaccacagttaaaaaaaattgagggtggctgggtgcagcagctcatacccataatcccagcactttgggaggccaaggcgggcggatcatgaggtcaggagattgagcccatcctggccaacatggtgaaatcctgtctctactaaaaatacaaaaacaattagccgtgcatggtggcgcgctcctgtagtcccagctacttgggaggctgagacaggagaatcgcttgaacccaggaggtagagactgcagtgagccaagatcacgccactgcactccagcctgggtgacagcgagactctatctcaaaaaaaaaaaaaaaaaaattgaggatgatggctaataagtgtttgaatatatatttattggtgggacaatctgaccatcctgaataacatcatttaagagaagagaggctggagtagggaggtgatagatattggtgaagtaatgagaaagtcattgtggaagaacagagcaaggaaaaaattagtgaaactagtgattaatgggtaggaaggaggttgcataacacaggcaatgagagaaaactgaagtttactacatgtggggacaaaagaatttagaatgttaaagtcatacaaaaaacaaaatgattcataatgagatttaaagaagagtattgaattttatttttaatgttacataaggtggtaaaatactggtgctatgatccaaaaggtgacagtactctccaaatctcagtttctactagttgtttacattttcatatgttgtttacattttcatattttgcaatattgaatgttaaatgttgagtggaaagagaagatccaaatacatgaatatagtctttatttgaatggttgagaaatggacaaatattatcatacttgcaagtttcttaagaacttgtggcattggctctttttttccagttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctggtaaacacaaaatatagtgataatttatggcaaataaatatgccaccagtatgacttttcagctttctgttgttgtacaatatagtacaattgcaaatatcattaatgtacagctcagtgaattttcacaaactaaattctcccatgttaccagcacccagatcaagaaataaaatcttatcagcacccggtaaagaactaaaaagaatagtatatgaaaagctctcttatctgatggcacttggtgaaactagttgaaaaagtggattaatgtgaataattattttaaaatgacagaggcatacctaaacatgttaacttacagcataaatagacgttcatttaccagaactctgatctaatgccaaggctttttcataaacaagtgattaagtctcactgtcttatataaaagaaattcttttttttaagtaaagctagaacttccaagtaaagacacttccaagcaatctaaatacagaatccttctagattttttttccagcctttgaagttgtctagtccgcacctgattcaacttctgtatcaactctttccaaagctgttagttttcagagaaaccactcttcattcttccttgatttacaaattatgtcattaagttacataattctagtaacaagtacagctggaagaaacttcagaacaccactgacattggtagacagaatctgataggtgcagatgtgcaggtttctagagagcagtctgctgggcagagggcattgtgttttacacagggaggggagaggagcagtcacatcggttggtacagagaggcttggctgggctgttataatctgcaggaccaccggctgcaccttgtcctcccagggtgcagtccttgctcttccttgccgctattggctgagcccagtcacacatgtgttttctgctgagacctcttctctggcctaaataaactctttgcttaataagtatccttcaggtgcaaattaggacacagaatacttgtgcctcactttggtccttagagaagaatttttcattatcagtatgctaaattttaaaagtaagaattctaagggttatttacatttcataataataggaaagtaactgtgggaaatattttatctaaaagctgtgtaaatgccatcaaattatttgtcatttgacaacactgtttcagaggagcccaatacctattacttagggcactgtctcccagattgtgtcagctgacagacttacctagcttctagatgaaggggaagcaaatattccagaaaacatgttacttgtttttctagggagaacatatacatataaaataggtcactcaagttctcagacaaaatggaatttttctggtttctatttagtgtttatcattgtcttcattttgtagtggtttcttttgcttgtttttgagcctgagttggattataatgttttgaggagagagacattatctactttttaccacgcctaccccttcctcgtatcttgtgtcttgtgtcattctctcacctaggggttgctaaaaactacagctttttggccaaatcctgttgccacttgtgtttgtaaataaagttttattaggatacagccacaccatttattctttttttccgtagctctttttgtgctacagtgacagagttgagtagctgtgacaaatgcgaaatggcccacaaagcctaaaatatatttaccatttggccctttatgtcaaaagtttgccaatctctgctccaaacacatggactaattaaatgcttatagtctataatcattttcaccccctggagagtaaagttactgattgccacaaagtattttcgtatacatttctgttggttgtactggatgatcagtactataaagacaattttattttcaaacacaactcttgcagatgccaggtaaaaatatgataaagttacatgtcaaagattgaaagtaaaactacttgagaagtttttagctactgttatccttccccttttccattacatcttagacattagaattgctattgctaatacatcaaggtctaaaataaatccaccttaatccttgtagctaagtaaaagttccatgtgcactagctcagcatgtgatttttctctactcttttgtacgtggtgtttagcaaatgtatttcagccaggacaaaactcagtgcctttctttcattctctcaatcagcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggtgtgtgtctttgcatttcagatttcgtagaatttattatgtttacctagtgtttcttaggtactcagtaaatacttgttgaatgaatgatggaaagaaagaaagaaaagaatactatatccttcctcccgtagactttttagcccagagacatacattgagacaaggtgttttggtgaatactgaaattaactaaaccaaatccttgtgctgagtatttgtaatccatggcttacaaatttgctctctgtaatctgcccatactttgaggttactgatgtgaagtacagtctttaatatccttctttaaagaatgtcttaaaaagtaatgatgatagtaaacatttttatttatattatgtacaaattacccttgattcacagagatagacaaaatccaaagtcatgtatggttctgtacctttagaataacacttaacataaattgtattgtcttttggataggaatcattgacctgaccaatatgcctccaacaattttagtgcctcatccagggggaacaagcactcctcccatggacagaatcacttatattcctggtacacagattactttccctcccaggccgtacaactctgcttccatgtctccaggtgagattgtacagttacacacctctctaatagaaccatcgtgtttacatttttacaacatagccttttaaggtatcttgggcaatttttcctcatttggtttcttgtttttcttttaacatttaatagtagttcttatgtgccagctgtcactagataccttaggaatgccttaaaagcttatgttatgcttcagttcttatccaggactcttaataaaacaaacttctttttctcttttcttgttttttttttgtttttgttttggagacagagtctggctctgttgcccaggctggagcgcagtggtgtgatctcagctcactgcaacctccatctcccaggttcaagagattctcgtgcctcagcctctggagtagctgggattacaggtgcgcgccaccacacctggctaattttttgtgtgtttttagtagagacagggtctcactatgttgcccaggctggtcgtaaactcctggcctccggtgatccacctgccttggcctcccgaagtgctgggattacaggtgtcagccactgcacccagccaaaacaaacttcttatatcccaaatttgaagctttttgaaaaattttcagtcacttagaatttcggaattgtttgatatactcagtcagttgatatttttatctttaagctgcaggtttatgttttacaggacacccaacacaccttgcagctgctgcaagtgctgagagggaacgggaacgggagcgggagaaggagcgggagcgggaacggattgctgcagcttcctccgacctctacctgcggccaggtcagtgaaaggcactgctcttccattctctggacacatcttagtaatcttgtacactgtgcttaatgctgcgcacaaaaagttttgatggaaacaaaaattctaagacaacgttattacaggccccaagtgaaaaacaggtgaaagtgctgtagcagctgagatggtggaaacgtgaattttacacggaaaaatgttttcatgatgaaggtatcatttttatttggtgcaaacagtggactgcagttgggcctgaagatattggtcacagagctttcaaggctgaaagaacagccctagcaaaaactcctagatataaaggtgttgttgagcttgagtttagaggaggaatggaaaatacagttagcagcttgtgtagcatcttgaattacagtgaaatgttgtgtccaggaggcaggtgacatgatcagagggacatttacacgagtggaatagatggattaaaaccctgaagagtgggtatggctggtcccggatgtagcctctgtggagataaaaattttaaatactcttttgtctagtaattccacgtctaggaatatatcccatagaaatactcagataagctgggcatggtggctcatgcctataatcccagctactcaggaggccaaggcaggaggattgcttgaggccaggaattcaagaccagcctcagcaacatggtgagaccctgtctctaaaatatatatataaaaaattagccagcagccgtggtgtgcacctgtagtcctagctactcaggaggatgaagtaggatgatcccttgaagccaggagtttgaggctgcagtgagctatggagtgtcactgcactccatcctgggtgacagagtgtgatgctgtctcttaaaaattttttaatttaattaaaaaaataaatattcatataagctgatgaatggttagaagggagaaaactgctgagaagcctggctgaggtggtggtgtctgtgagaagaggggtgtgtgctaaaacataaaacagctagctgttatgaagccagtgagcacgttagaaggttggagtgaggacacagaacaagatgaggtcaagaagaaagtgactggggagggatttgagagttcagaatcctctgcgtgaagtagttcttaccaagtccaagctctgacttggttatgggagagttagggttaagtgaacaaaaacataccaaatattgtagaagtgtaattgtgggagccaagtgttttgtgggaagataatgtgaatgatttcatttcaaaagagagagcttgctgagagaaagagtcacctgtgaaggggacagtgaagaagtgaagcagggcaaactgtggttgaatgaaacagtctcaaaccctagtgtagcagtggtatattattttcattatgatgcttagaaagttgtgcctgattagattttggaaatcatatacacactagagtttgaggaaaaatcagaaagatgaacttatatgatttgtagtagtacttcttgttggtgctgttttatttatggaatcaagattgaaatttatcagagaaatggaaatgacagtaaatgatggctgatgttttgtttcaagttactgctgcggttttattgcatctttatttggacacttttagaacatatttctggaaaggccagaaagtagactatcaagtttcttatcttgtttttcttttttctatttaggtatgttaggaaataaacaatccataagcattgcttccttttgtctctggcttcctccttatgtctttgtttctttctctttttcacctctgcaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgtcagtctcttgtacatattttgacaaaaaatgtctcttgcatatacattttaaaatttgtgactgcaatagtctaagtatagtcatgcttttctgcccatgccatgaaggctttttttgttgttgttgcagtttgtccttccatctccccaccacattcccagcaaatggtcttcccttcacagagctgtgatttggttttatttacaggccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagctgtatgtatctcaatccgagtttcacaatgtgatgtctgagtaaagaattactttattctttaggtcaagtagaactatatggtatttaaaaatcctaacggttgatagtaaatgtaatgcaaaaatgtatcttctgctgtttttatgattatttaaatatcccagtttcctacatataagcctatcaatgtatcttccacaagaaaactgtatcattcatgtaattaaatttggaaagtagaaggcagaccttattaacatatttaggcatctgaaaggtaatggatatatcgccaggctctgggctactgaggtgtaatttctcaggaagcatttgctaggacatggttctatatttatgccaataccccaaagcctctaatatcctttttctaagacacaggtttttaaaagtgagactacctattattggtgattggtatttatattgcatcgtttttgcaagttggattttgttcaagtctggttagtcattaggatggctacactgcaaatgtgttagaattcacaggtctacattaaaatgctagaaaagttactttttaaattttcttttaaactattgccttaattctatgtggaattgcagaaagaacaagcaagtatttaaataagcatctgctaatactggaagtaatttaatcatatataatcatctttctgttatctccattgaataaattcagtagagttagacatcatgaaaaaaaaaatgatttctcatgctccagaatgcaatgtgcagttcttttgatctctgagtatccactagcttaattataatttgtttacgtcatatctaccgcattgctgaggcttttagagagagagttagtgttgtgtagacaaaagacttcttttaacctgagattaggaaaatctgcaatatagattttctgcatgcagaaaattgctagctgagaaagagatattctatagttgtatgaataggtcttttgaagggaagtcaccggcacactgggagatcccacctgggcttattgaatggtatagcacatgggttccttaatcattggattaaacatttcttttcagtttgcatcacaaaccaaaccttgctttaggaatttgattttcagaaggtgtgaaaatagaaagctcatcttttctgagtgtccatgtctctgtgtgtggttatcttttttatcactggtcagtgaattccatgatgtccaaaggctatgtacagttcttcagtgtggttttcagtttgactcttgagaaccttcctcatcctgaaggggaggtccattgccatagtcttgccccttaaggcttcaagaacaatgtgaacacggtttggattccgactttctactgagtgaatattggaagttgtaaccagatttaggatgttgaatacataaacagtgatgagtaacagtggatacaaaagtcacaaattactgtaaacttcttagaatatagtgatttattttagtttctcaatgatcatttctgttccatttatcaagtttccaatctcctaagtgtactagaacccaggtagctgcagtttccatgacctggtggggataggaaggactgttgagtaccagaggagcaggtggtggctagggagcagagttcattcccacctgctgcatctgtgtccagcccagggccatgcaccctttggagctctgacagtgctctcagattctgtagtgcagtttgtggatgtgaagagccctctgaattcagaggttcctgagcaggcggttacatctgctcccaactgtcagctctgaggctatggcaggactgtgaaaagctgcctgttagccccactgcatagccctctgtttacttgggaactgtgtcttagaggaggtccttttctgatgtgggtatcctccagagttggttgacatcctccctttctgggaatatacttcccttcagacattctctaccatttctggttattttcacaatgtaacacagtgctaaaaaattattaatgtttggagtaagttttgttagcaatactccatttatttgagaaaatcattatatagtgttatataatccatagctttaaaatcatcatggtggtgaatgaagcagctttatagcctcagcgtttttctaagaacagagtgtcccacagaattggaatcattggaatcagttattgagatctactccctcatttgtttattaacctcttccataaatgtttccctggtgatttcttttccagctcccaggaaaatatcataaatctgttctctgttctgcctcattccagtgtttattattgggctttaaaacatgtctttttttttttttttttttttttttttgagacggagtttcgctcttgttgcccagaatggagtgcaatgacacaatctcagctcaccacaacctccgcctcccgggttcaagcgattctccggcctcagcctcccgagtagctgggattacaggcatgagctaccacgccctactaattttgtattttttttagtagagacagggtttctccacgttggtcaggctggtctcaaacccctgacctcaggtgatccacctgcctcggccttccaaagtgctgggattacagccatgagccactgcacccagcctaaaacatgtcttaaagcccataaaacttcagaaaaccctcattaacctggaatacctttgaacatggtggatcagaattgaaaaaatgctacaggtgtgaagaacttagacttcagaaacttttcctgggattagttttgaaataagattttcttttcttaaagtatcttctcacaggtatgaaacacctagcgatgctattgaggtgataagtcctgccagctcacctgcgccaccccaggagaaactgcagacctatcagccagaggttgttaaggcaaatcaagcggaaagtatgtcttcttaagctaccatttacatgttttcatatttgcatttatcatttgcttctaattatctgtctagaccatagtaagaattaacttgttttgtttgttttagggtaatcttacatgagccttctttagaaacagcaatcgattcttttttattttttaatgatacagaaaattgtttatattaattttgtttgcttacttctgcatttatattttgttccactagtcctcagacttcttcagtgaataattttttttttctccaaaattaagataagttctttgtttggagctatgtaccacatcctttcaggtgttcttctgaattatatttaatctttgataatgagtgaaaagcacagacattcctggagtaagacatctatgtgttctctcctagatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtgtaagtttttcattattcttattagttaatttttcttttttgatcatggggaaagcagatttcatatagaaaaagaaatttataataaagatatctagatttcttaatactattttttttttgcaagtactcaatgaattttaccacttccttcatttctcattcacagcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaaggtatgatctttattccaaattatatataaattgcccaacagtaaaacaaatggaatatatctacaggataaggaatttgtttctcacaactaaagttcatttgcctttattcccaggaaagtgtaaatgagctttcttccccctgcatattattcttagaatgtccactgtcttggcatttggtactatgactttttaatgtatattcaaaagatgattatattctatttgttggtttgtaaagacagttaagaagaatgtgtagtttggtagtggtttggggacacttcagtggtgcttccgaataatacctctcatatttatctgtctcaatggtttctactgggtcagcatcagtagaagtttaagaaggtgatattggccagacatagtggcttatacctgtaatgctagcactttgggaggctgaggtaggaggattgcttgagcccaggaatttgagaccagcctgggcaacatagtgagatctcatctctacaaaaaaaaagtttatatattttttgtttgtttgtttgcttgcttctgcatttatattttattctaggcctcagacttctgtcagtgaataattttatatatatatatatgtatatatgtatgtatagatacacacacatatatatatgcacacacacacatatatattttaaggtgaccttaaataaaggaaagggaagccaatagtggcatcatgagtggaaacatgttatatgccagggctctctgataaagagcatatcttcttacctgatattctgtgtttggttaaaataaagtggacacaggattcttgcttcaaagtggtagactaaatattagcaaatgttaaattatagttaacaagcacaaagggaaataaatttaagaatgctgagaaggccgggcgtggtggctcacgcctgtaatcccagcactttgggaggccaagctgggtgcatcatctgaagtcaggagctcaagaccaacctggccaacatggtgaaaccccgtctctacaaaaatacaaaaaaaaaattagccaggcatgatggcaggtgcctgtaatcccagctactcaggacactgaggcagaagaatcgcttgaacctgggcggaagaatcacttgaacccgagatcatgccattgcactgcagcctgggcgacagagcgagactccgtctcaaaaaaaaaaaaaaaaaaaaaagataaaaagaatgctgagaacaagactgagatatgggcagatcaaagattctggcaaatacctgaagacatagaggacacatgagccagagtaatggaagccatggctcagagcctgaaaaagagaaatttgtagcagaagtgattctccagcctacctaccaacccatcaaagtgagcaaagagcagatagaagaatataaataagctaaatggtcttctttaaaaaaaaaaattattgtggaagttttcaaatacatacaaaagtagagagaacaagtataatacacctctaggtatccatcacccaattttggtaatcctcagtgtatgacgagttttgtttcattttcatccccgcttgccccgacccccaaactggataattttgaagcaaatctcggacttagtcattagacgcagctggataaccttaaggataagatgaaagcacatttattccctttcagccaaaacaaaaccaaaaaaagaaaagaaatgtgattatcaaagaaaaatggaaaactatatagcattgtcatggtccattcctgatgaaaatgtttgcacaatctgtggtgttagaaaacagcatcaactgattttcattttagttatttatttaactttcattttaagttcaggagtacatgtgcaggtttattatataggtaaacttgagtcgtgggggtttgttgtaaagattattttgtcacccaggtattaagcctggtacccattagttattttttcctgagccttctcctcccaccctccatcctccaataggccctagtgtgtgttgttctcttccatgtgtccgtgtgttctcaccatttagctcccgcttataagtgagaacacgtggtatttggttttctgttcttgcgttagtttgctaaggataatggcctccagctccatccatgtccctgaaaaggacaggagctcattctttttcatggctccatagtattccatggtgtatatgtaccacattgtctttatccagtcaatcactgatgggcatttgggttgattccatgtctttgctgttgtcaatagtgctacagtgaacatacatgtgcatgtgtctttataatagaatgatttatattcctttgggtatatacccagtaatgggattgttgggttgagtggtagttctgcatttaggtctttgaggaatttccacagtgtcttccacagtggttgaaccaatttacactcccaccaacagtgtataagtgttccattttctccacagtcttgccaggatctgttattttttcactttttaatagccattctgactggtgtgagatggtgtctcattttggttttgattggcacttactctttttttgttgttgttaaaacagagtcttgccctgttgcccaggctagagtgcaatggtgtgatcttagctcactgtaacctccacctcccaggttcaagtgattctcctgcctcagcctcctaagtagctaggattacaggctcctgcccccatatctggttaatttttgtatttttagtagagacagggtttttcactatgttggccaggctggtctcgaactcctgacctcagctgatctacccacctcagcttcccaaagtggtgggattacaggcatgagccactgcacctggcttgatttgcacttctctaatgatcagtgatattgagctttttttttcatatgcttcttggctgcatatatgtcttcttttgaaaagtgtctgttcatgtcatttgcccactctcttttttatctcattctgtttgcccaggctggatttcagtggcgcagtctcggctcacagcagcctcaaccctcccaggctcaggtgattgtcccacatcagcttcccaagtagctgggattacaggcacatgccaccacactcgctttacccgctctttaatggagttgtttttttcttgtaaatttgtttaagctctttatacatgctggatattagacctttgtcaggtgcatagtttgcaaaatttttctcccattctgtaggttgtctgttcactctgttgacagtttccttttctgtgcagaagctctttaaattagatcccacttgtcaatttttgtttttgttccagttgcttttggtgtctttgttatgaaatctttgtccctgcctatgtcctgaaaggtatttcctaggttgtcttccaaggtttttatagtttttttttttttttttttttttacatttaagtctttaatccatcttgagttaattttatatatatatggtataaagaagaagcccagtttcagtcttctgcatgtgatagccagttatcccagcaccatttattgatagggaattctttcctcattgcttgtttttgtcaggtttgtcgaagatcagacagttgtaggtgtgaggccttatttctgggttctctgttctgttccattggtctgtgtgtcttatctttgtaccaatacaatgctgttttggttactgtagccctgtattatagtttgaagtcaggtagtatgacacctacagctttgttctttttgcttagtattgccttggctattcaggctcttttttggatctatattaattttaaaatagttttttgtagttctgtgaagaatgtcttcggtagtttaataggaatagcattgaatttgtgaattgcattgggcagtacggccattttaatgatattgattcttcctatccatgagcatggaatgttttttcattttttatcttttcatcttttatctctttgagaagtgttttgtagttccccttgtagagatctttcacctccctggttagctgtattcctaggtattttattatttttgtggcagttgtgaatcgaattgcattccttatttggctcttggcttggctctcattggtgtataggaacgctagtgattttttgcacactgatgtatcctgagactttgctgaagttgtttcatcagcttaaggacctttggggctgagactatggagttttctagatatgggattatgtctgcaaacagagatagtttgatttcctttcttcctatttggatgccctttctttcgttcccttgcctgatcaccctggtcaagacttccaataggatgttgaataaaagtggtgacagagggcatccttgttgtgtgctggctttcaagaggaatgcttccagcttttgcccattcagtatgatgttggctgtgggttttcatatatggctcttttattatgttgaggtatgttccttcaatatctagtttactgagagtttttaacatgaaagggtactgaattttattgaaagccttttctgcatctattgatatttgtgtatattgaaccaaccttgcatcctagggataacatctacttgattgtggtggataagctttttaatattttgctgggtttggtttgccagtattttgttgaggatttttgcattcatgttcatcaaggatattggccggaagttttctttttattgttgtgtctctgccaagttttggtatcaggatgatgctggcctcatagaatgagatagggaggagtccttccttaatgtttggaatattttcagtaggaatggtgccagctctttttgtacatctggtagaattcagcagtgaatgtgtctggtcatgggctttttttgggtggtaggctatttattactgactcaatttcagagcatgttattggtctgttcagggaatcagttttttcctggttcagttttaggagggtgtatgtgaccagaaatttatccatttcttttagatttcctaggttatatgcataaaggtgttcataatattttcttatgattgtttgtgtttctgtggggtcagtggtaatattccttgtcatttctgattgtgtttatttgaatcttctctattagtcttagctagcagtctgttttattaattttttctaaaaaccagattctgaggccgggtgccgtggctcatgcctctaatcccagcactttgggaggccgaggcaggcagatcacgaggtcaggagatcgagaccatcctggctaacacagtgaaaccccatttctactaaaaaaaaaaaaagaaatacaaaaaatttgccaggcgtggtggccggcatctatctgtagttccagttactcgggaggctgaggcaggagaatggcgtgaacccgggaggcggagcttgcagtgagccaagatcgcgccaccgcactccagcctgggcgacaaagcgagactccatctcaaaacaaaacaaaaaccagatcctgaatttgttgatcttttgagtgtttttttgtgtctgaatctccttcagttcagcttccgttttgtttattttatttatttatttattttttgagaaggagtttcgctcttgttgttcaggctggaatgcaatggcgcgatctcagctcaccacaacgtctgcctcctggttcaagcaattctcctgcctcagcctctcgagtagctgggattacaggcatgtgccaccaccccagctaattttgtatttttttagtagagacggggtttctccacgttggtcagactggtctcaaactcccgacctcaggtgatccgcctgccttagcgtccccacgtgctgggattacaggtgtgagccaccgcgccccctgcagttttggttatttcttgtcttctgctagctttgggatttgtttgctcttggttgtgatgttagcttgttaacttgagatctttctaactttttgatgtggatatttagtgctataaatttccctgtcaacactgccttagctgtgtcccagagattctggtacgttgtatctttgttctcattagtttaaaaaaacttgctttctgcctttatttcattatgtactccaggagcaggttattgaatttccatgtaattgtatggagtgatttttataagcaaaacacagaggagtttctctgtagttctagaaaaggatgtgatgcaataaatcttaaaaatggctgacagatattgggaggtgagggttgcataggaaagagatggagaagtaagggtatgtgtgctaatttcttcatttttaaaaaagaaaatataaaaggctgaagtatgctatgtaaaggcaaaatggacaaaattaaaataggcaagccagcacagtggctgacacctgtaatttcagtgctttgggagaccaaggcgagaggatcgcttgaggccagcggttcaagaccagcctgggcaatgtagtgagaccccatctccacaaaaaaactaaaaaataaaatcgcccaggcatggtggcatgcacctgtagtcccagctacttgggagcctgaggtgggaggatcacgtgagcgcagaagttgaggctgcagtaagcagtgattgtactactgcactctagcctgggtgacagagggagaccctgtctcaaaaataaaaataaaaataaaaataaaatgggcaacaacagagaaggcaaatcaaattcttcatctttcatggaagagagttaacagatactgtttcaagttttataaataaaaaaaacatgtttaagattatttacagagttttggaggtaaacagcaaaacaacttaaaaaaaaagtggctatcttgaacaactggatgggctgattgagaaaggccataacaaatcatattataattttgctttagtctaatagtcataattccagatgttgaaagtcacaggtggctttcatatgcataatcgctatgtcaaaaaattttagcagggccgggtgtggtggctcacgcctgtaatcccagcacttcaggaggctgaggcaggtggatcacttgaggtcaggagtttgagaccattctggccaacatggtgaatccccgtctctaataaaactacaaaaatcagccaagtgtggtggtggctacctgtaatcccagctattcaggaggctgaggcactagaatcctttcaacctgggaggtggaggttatagtgagccaagatcgtgctactgcactccagcctgggtgacagagcaagactctgtcttaaaaaaaaaaaaaaattgagggtgtggtggggcgaggtgcttgtaattcccattacttttggaggctgaggtgggaggattgcttgagcccaggagtttgaggtcagcaacatagtgagacccctgtctctacaaaaaattaaaaatgggccaccagacataataaaacatataataaaaatattagctgggcatggtgacgcatgcctgtaatcccagttactcgggagatgtaagtgagaggaccacttgagcccaagagtttgaggctgcagtgagctatgattgcactcctgtactcctgcctgggcaacgagcgggaccctgtctctaaaaaataaaaattttaataataagataaatgggccaggtgcggtagctcaggcctgtaatcctagcacttttggaggcccaggcaggtggatcacctgaggtcaggaggcctagccaacatggtgaaaccccgtctctactaaaaatacaaaaattagccggggtatggtggcgcatgcctataattccaattccagctgctcgggaggctgaggcaggagaattgcttgaacctgggaggcagaggttgcagtgagctgatcacaccactgcactccagcctgggtgacaaagccagactctgtctcaaaaaaaaaaaaaatgataaatgggtgggagctaaacagtgtgtctatcttatattattcttaccaaatggtatccagagaaaaaatataaaattgcagagaacccctctgccataatatagtgtaactagaacctatgttgactcacctgataaaacttcttgggtgtcagtttagtactgaagtcctttatctttaacttgacgatgaaagaactggtcagtcgactcaaaataggtaggaaaacccttgaggtttcacctggactaaggagccaagggtgagatggtgtctgatgttgaaggacatgcggagcctcaaggacgcagcttctgccactgctgctgcccgggcagcactgtctgatgacgtgactcctggatccacggggcgcgcatgggtcaagtggcagtaacacagtggttttttttgttgttgtttgtttgttttaactatgtatatagtgaatacctgaggcaactttttttctgatagaaattggcagcttttgctccttctcctgaatgaagtcatgagttaacaagtttctgtttaggtaagtcccaggttagcctttgaaacacaatctaatatttcacatattacaatagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggtaagtgtgcttcctagtgacagcaaccattcatggcgtgggtgctcatgctttaacatttccttcagttgttgccgtttttctcagaactttgggcttttatgtctggatggcattcttagaggatcatttgtctcttttcctactcatctaatgctagtgtattttagcaaaaagaaaatatttataatatcatatttaaataggttagaaaatatttgttcattattcttgaaattaaatctttctagattttttttttaatgtttttgtctaggggaaagggtcatccattgattcagccaacatttgaatgcttactgtataccaagcactgtggactctgaatagatttaatcttacctatttctaaccgtgaccccaaccctattaattattaaattatccccatttgactagatgcctttgagttggctcctttccagtcagtctccatacctccacctgagtgatttgtctaaaactcatgcagaatccagcacccagtcttttgcatggcatctgagttcctggcatgaccaggtgtatgctgcgcattcagcttcacttccctctgcatcatccctacactggaatctctgtccaaatcatgttgcttattgttccctgaattcctttctgtccatagtcgtgcagtttgcctagtgctgaaccctccactgatgcgctgaaagccagacatgtcacttgctcatggtcgtactgatactaatggggaagggccagttttaaacgaaggcctttctaactccaaattgctagtgcctttcttacaaagtgttgctattaatttattgcatttattcttagggagctaaacagatattgctacttttcaatgaaatgaagaaaatccatttttggagagggagtgatgttcaatttaattatacatttacatctttcccctacgtttatgagtgttttgaggacagggaccatgtcttattcctgttcctatcaccttaattgtctttcctggcatagagtacgtgttcttgtgtttgaatgatgactgaatccacatgattggattaggttttcaataacctatagtctctgttctcatctctggctctagctagatccttggtggcctggagtttttagggaaaccttgtttttttttaaatgtgttagtataggaagctgccagtaaaatatgaaactctttatattaaactcagctcatttgttaggttgcttgaaatgattgtaacaaataggcagttttattcctatactgttgtgttccagtccagctgttgattgcttagatatgagttcttgctattttgtagtcaagcgtgctattagttttaattttagtgtacttaaaactaattctagtaaaattgttcccagtttaggtggtaaccattaatatatcagtgtttgtgctgttaaggagagagcatcataagctgtttctgagttttcctattaatattcatttactgcttcttcattccttcctaagaatttctgctctagattatctccattctaattctaattttatgatttcattttgagagctaaatcatttttcctcaaatgatgtactaagtggtttatgattacatactgtttcttagggctgtaaccacaaacacaggatgaggaggcagtagttttctaagtactctctgactgttgttatcattgataggaatgtccccaggattaggagtacgtggttgtaatatacttaactttggccctaacaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatgggtaagtgggatttctttcatgaaccccaaataaaacatgcattaataatgatatctccagtgttgcttctcctgtaatgcttgagtttgaaggctctttacaggacatctgtccaacacatctgatcctagagttccttctcaagtgtctgccagcccatgaagagttctaattaggaggcaggagttcgctcctttctgaagctgtgccgtttctctttgaagaaatgctgtgtctaggttacttttctttatgtaggactggattaactctccatagtttacttttctttctcccctacccatcagtcttcattttgtccatttgggcctatccccacataacatctcctcagatatttgaagacgtgtctttcaggagtcctctcaatcagtgtccccagtttcatcagctgtgggtcacatgtcctcattcttagtacccctaccatctcagttattctccaccaaaaacatttaacctagcctttcactaggtttcgagtaatacaaaatagagtagtataatatgatctatgctaaattcatcatttttaaagtagcctaagactattagctgttttgttggcagcctatacactgttaagttatgaagtgcactgttaagtacttagtatgaacgttgatgtcaaggtcttgggctacttttaattcatgccttgccctcgctctacttttacagtaactagctccaagtataggacaagtccaagtccgtctgtgcttgctccagtccagctactttttctaccctaccagtgtctttgtggacttgagttgattcattcactattcatatgcaactctgataaactaaccgtgtaaaaataaaacattggcctggaatctcaacactttgggaggccaaggcgggaggattgattgggcccaggagttcgagattagcctggacaacacagggagaccccatctctacaaaatataaaaaattagctgggtgcggtggtatacatccctgtagtcctatttacatgggaagctgaggtgggaggattgcttgagcctgggaagttgaggctacagtgagctacgatcgcatcactgcactgcagcctaagccagagtgagatgtctcaagaaaaaaaaaaaaattttttttaaattgtctgggtgtggtggctcacgcctgtaatcccagcactttgcaaggccaagacgggttgatcacctgagatcaagagtttgaggccagcctgggcaagatggtgaaaccctgtctctactaaaaatataaacagctggtcatggtggcgtgcacctgtaatcccagctactcaggaggctgaagcatgagaatcatttgaacctgggaggcagaggttgcagtgagccaagattgtgccactgcattccagcctgggcaacaaagtgagtctctgtctcaaaaaataataaattaataaaataaaaatataaaatcagtaataatggtagcaaaaggttatctagcgtactatgtggtaggctctattctaagcatgtgtagatatagtctcatttaatcctcacaacaaccctacatattacaattatctccattttgtagatgaggaaacagactcaggtttaagagttggcacaggttacatatctagtaagtaatgaggctgcagttcaaacccaggcattccaactccagagtccatgttgctaatgatggaccaactggcttctaacagttccatactcatagcatcttaaccagattgttggtaaatattctagctaatgttctgtggcagaacctttttcctctgggttgatatgcaagtattaatcagaacctcctcgtgctctctcagcactcacttgtactaactatccccccagtcttatcagtcttttcctcagtccccttgatagagagactttgggtagaccatagtctggtttattctttttttttttttcttaagttcagctttgtattgaacacgttataagaaatttagtcaaaacaaccaaaagcccatgtcatcatcagactcctcagattcttctttgtttgcttccactttcttctcagctggagcagcagcagtggagtgggcaggatcccactggtgcagcaccagctgctggagcaggtccaccagcccctacattgtagatgaggctcccaatgttgacattggccagggccattgcaaacaagctggaccaaaaaggttcaacatttacaccagctgctttaacgagggcattgatcttatcctccgtgatggtcacctcattgtcatgcagagtgagggctgagtagatgcaggcgagctcggagacagaggacatggtatgggcaagtgtggggctggcgctgccggacgtggtggtagttgccggatgaagtgagggcctcatcccaacgtggccttagcttccttggaaggaccaagcactgtggtggcagctgaggaaaggacgatctgctttatttctgtgatctaccatctactagtctcctgatcctgtcaaaagaaaggaaagtgggggccttgcactgtgaactgcctggtggatgtttgtttagatctgtgtcactcttgtgattaataaatgttgaacaccaaggaaaaaaggatgagccagtgtcaccactgtttctgaacttgtcctcgctcttaattactaggttctgtttaggtggcaacaaaataaaagacaaatattttagaatgctgaccagaattgttatcaggcttacagatagcctttctttctttctttttttttttttttttttttgagatggagtcttactctgtggcccaggctggagtgcagtggcacgatctcggctcaccgcaacctccgcctcccgggttcaagtgtttctcctgggccagcctcccgagtagctgggattacaggcaccagccaccatatccggctaattttgtatttttagtacagacggggtttatccatgttggccaggctggtctcgaactcctgacctcaggtgatccacccacctcagcatcccaaagtgttgggattacaggcgtgaaccactgtatccggccaccttttcaaaaaatattgttattactattttctgtctccagtcttcaacagtttaatctattatttacagctcctcaagtgtcaccaacaaaaatatactcttgttttcaatttctcttggcactcagagatgaatctgtgtgagcacggagagctagagatctcagagcagccaggaactgagatgcaaatcatttcacctttgtgtggtctgctcattctgtagtctttgtcttacccttaaagtgggaaactctttgacagggaaatgccatgtttgaactgaagaagcctactttatagttttttctctcttgcctaatgttttcagtagcgtactatgttgggtgttttagtatgccacatggtctctattctctgaagctgtatgatgaaacaagtacctaactttaacaggagataattaatgtcttaagggaagtactaacagaattgctttagagtctgggattttttttttattgcaagaactatttttcatggtggaaaggagaatttatattaaagaaccagtgggctcctgggcccaccatggcacatttagccttcactgggaagtagaactaaatgaaagccatcagcagccaacacagcttcacttcagctcattgtatctgaatccagtgttcccaaggacatcagtgactttatttttttgaaaactgtaatgctttaaaacttactttattggatctctttgcagcttttgacacagtgaaccactttcctttcctgaaatgctttcctctcttggctttctgatgccatgttctcctgtttcttctctacttctctggccacttctgtctccttagaagctcagtcttgctttgcctggcccttgattgttagttttccccagggctcacttcttagcccctttctcctcatgtcttataatttgagtcatctcatctactctggggagttgaatggtcgcttgtatgctgaaaactcccaaatttgtatctgtagcccagcttttcctactaagctctacttacatatctttgcagacctcattacttcttgactaacttactggctccttaaatatctaaaattgaatccatgttctacctccccatacaaaaagttcctcctccttccctaccacagttaacagttaccattactctggccattactatcctggtctctctgcctcctgatgggagtcagctcctcctgtcaagttggcctccacagtggctttcacatgtctaccttccattctgctaatttctgagcagttaccacattcttgctcaacagtaggtaccagtcacctggattgcttattaaatagttgaattatggagccccaggaatgtagaaaatttactaagctacccaggtgattctaatttgtatggccttagcaagtaccacactgcactgtaagctccattagcaaaggaagggttatcctgcaagtgcagtatctaaggattatcattggttaacttataggaaattgtcttcatctgaccatttttgatcaataaggtaatcttaacaattcagtcaaataactgctcaattaaatatctatcaaatgaatgactcctgttccacacacttcatgataacagggctctgctgtttcaggctcaatttatttaccttgtcacctggcccataagtaagaagactgtcatccatggccattgttttctagttcttctgaggacttttctcctctctttgtcagtttaaagcctccctaatcaaccaagtttgtttctaggcacatgcactcttccctcctctcatgtgctcagcccttgggtaagagtccatccttctgtggtctcattagaaatttcacattctggccgggcacggtggctcacacctgtaatcccagcactttgggaggccgaggcgggcatatcgaggtcaggagatcaagaccatcctggctaacacggtgaaatcccatctctactaaaaatgtaaaaaattagccaggcatagtggcgggcgcctgtagtcccagccactcggggggctgaggcaggagagtggcgtgaacctgggaggcagagcttgcagtgagccaagatcgcaccgctgcactccagcctgggcggcagagtgagactccgtcttaaaaataaattaattaataaattaattaatttcacattctggctgagcacagtggcccatgcctgtaatcccagcactttaggaggctgaggtgggtagatcacctgaggtcaggagttcgagaccagcctggccaaaatggtgaaactccgtctctactaaaaatacaaaaattagctgggcatggtggcggggggcctataatcccagctgctcgggaggctgaggcaggagaactgcttgaacccaggaggcagaggttgcagtgagcctagatcacgccattgcactccagcctgggtgacaagaataaaacaccaccatctcaaaggaaaaaaaaaaaaaaaaaaaaaaaagaactttcacattctttgggacacatcatttggctgcccacttgctttctgcattctttttttctctttaaaattcttagcgtcaagttgggaatgacggaaacaccaatttatgtcccaaattcttcccctttctggcacactgctttattataggcggttcccaggtcttatgctgttatcattcaaactgcagattacaagttgcacagtcagcaggaatgaaaaggatcaacagagtcttttgttttttccagcaaatatcctgagtttccagttagccatgcagggaaacacagtcattttcatagtattcactgtggtggctttcctctggatcacatcccaggctgcctcaaacctgttggtatttgtggcggtcatcccagagtccaaggtttcttcttcgtcagaaagccttggttcctgttctgagaacagcattttcctatttgtttttctccagcagtgcaaagttcctttcccttttctgggttacactgcttctttttttatttatttatttatttttggtaaacagatgggagagtctcactgtgttgcccaggctggcctcaaattcctatgctcaagcagtcctaccgcctcagcctgctgagtagctgggggactaggagtgcaccactgcacacagcttattgctcttcttttgatgttcctaccttacctatttcctgatttccctttaaaaatagcctgggcaacagagtgagaccctgtctcaaaaaaaaaaaatacttccattttatcttcacttaatgggtgagaaataaaggttgagatcatgaaaaataaaaagattaattttattataggaattttttgagactttagtttggtatatatgattatcacatcttaattaacttgaatgtttgcttaaatatagcagctgctcagccaggaactgagatctttaatctgccagcagttactacgtcaggtaagattgaaaagacattatttaccaatacaaaattggcacagcagtagtcagtccaacaaatatgtactgagtaccaactgtataccaggggagtgactgctctaatatggaaaaataaataaataatttagtgaaggaaggtttacccagtagcacagaaaggaactgagatccagtaaatacctattgaaaagataaatgaacaaaaagaatgaaactattaaagaacactgtcaaaactagggaactgagaaaattgttgagtaactttaatagaagtgtgggtgactgattcacttgggaaacaaatttccttaaggagttatctgtggattaagatggtctctgggctgggtgcggtggctcacgcctgtaatcccagcactttgggaggccaaggcgggcggatcacctgaggttgggaattcgagatcagcctgaccaatatggtgaaaccccatctcctaaaaatacaaaaaattagcctggtgtggtggtgggtgcctgtagtcccagctacttgggagactgaggtaggagaatcccttgaatctgggaggcggaggttgcagtgagccaagatcgcgccactgcactccagcctgggcgcgacagagagagactctgtctccaaaaaaaaaggtctctgtgtggtgggtcctggtattgttctaggtcacttgccaagtgctgtgtgtattcagtgggctgatggggcaatgcatgtttgtttcctgattggcctttcagaaataagtggaaatgtttttgattctctttcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggtacagctttcattttagtgcttttctgctgcttttccccaaaaaagccagtttatttcccaaattctgatgcatcactaagacatttcatttatgtctttatgtgctcagagtcacctcttagggtttccgttacttaaaaaaggtttttgaaaacctacccagacattataatatgaacagaaataaaatggaagaaaatttttacccaaagtgtcaccctcctgggatgtccattttttatttgtttgcacctagtcctcatctatacatactgcattgtaattgtaacacaaatataatgtttttgaataaaagtgatttaactgtaaaaattaggctcagtagaaaagaaacataagccagccgggtgcggtggttcacgcctgtaatcccagcactttggggggcggaggcgggcggatcacaaggtcaagagatcgagaccatcctggccaacatggtgaaaccccatctctactaaaaatacaaaaattagctgggcatgatggcgtgtgcctgtaatcccaggtactcaggaggctgaggcaggagaattgcttgaacccgagaggcggaggttgctgtgagctgagatcacaccactgcactccagcctggaaacagagtgagactccgtctcaaaatacatacatacacagacacacacaataaaataaaataatcgtaagccataaaaaaagagtaggaaaaaaggtgtaatcatagcactttgggagggtaagttgggtggatcacttgagctcaggagtttgagaccagcctgggcaacatgatgaaaaccccgtctctacaaaaattacaaaaattagctgggtgtggtggctcacgctgtagtcccagttacttgtgggggccgaggtgggaagatcacttgagcccaggaggcagaggttgcagtgagctgcaattgcaccactgcactccagcccaggtgacaaagtgagaccctgtctcaaaaaaggaaaaaaaaaaagagtaggaaaaagggaagaaaaagaaacagttcttcagatcacatcatccggaatgctaatgcttgtatctgataagcattgtttcagacatgtctctggatagccagataagagttgctagaatgagattttatacattctgttaaaaacaagcacacaaaaaaaccataataatcctaagctttaatcttacaacctttttcttaatattttgagaatatctcttgtgcttttcaaaattacctgaagttcagcagtatttctgttttagtttagatttattttcctgttatcttcaagcaaaagatctatctcactatggttaagaaaaagattaaagagattagaggtcttaaaaaaaaaactatacatgttaactttaagaccttcccctttctgttcttaccttccaatttttattggctttaagtgtgtgtgttttaaggttataagactggtgacttagtcaattacaattgtactggttgtataggaatttggggcagtgtgaaattgttttgctggggctgaggaaaaaatttgctgatgacctgggctctgatctcttctgagctctttttgatgttttcttttagagcacagtcagaggtgtctcacttctgtgaaattctgctgagttcatcagctacacagtctggaaaaatcaaaagggctaccaaaacttgctgagcctctgctcaagtcctgtagtagcatgaagaagctttgttctgcagtttttcctttacatattatttctttgtgtggtgtattaattccagttgggaaaggggggttggtcattagtgaagtatgatttttgtcaccctgccttctttctttagtagtttctgtactctgaggccagtaaagaaggcttgatgtcccagaaatttcagttccttaattaccacattttaatggcaggaggacgaaccttgttttttgttttgattgttacaagtgaaatcctggctttcttttaaatgcaagcatacctcgttttattgtgcttttttttttaactgaaggtttatggcaaccctgtgtcaagcaagtctatcagcattatttttctaatagcatgggctctcctttgtgtctgtgtcatattttggtaattctcacaatatttcaaacttgttcatgattattatctctgtgatggtgatcagtgacctttgatattactattgtaattgtttgggggcaccatgaggagcacctgtataagatggcaaacaacccataaaggtggtgtgtgtcctgactcctccactgactggttgttccctgtctctctcctcctctggctcccttattccctgacacacaacaatattcaaattcggccaattaaccctgcaatggcttctaagtgttcaagtgaaaagaagaatcactaagtctgtcacttgaaatgaaaagttagaaatgattaagcttagtgagaaaggcatgttgaaagccaagacaggctgaaagctagacctcatgtgccaaacagttagccaaattgtgaatgcaaaggaaaagtttttgaaggaaattgaaagtgctattccagtgaacacacaaatggtaataaagcaaaacagtgtttcgtgacacacagaagattttagtggtctggatagaagaccaaaccagccacaacattcccttaagccaaaacctaatcctaatccaagccctaactcttcaattctctgaaggctcagagaggcgaggaagccacagatgagaaggctgaagctagcagaggccattcagaggttgaagaagccgtctctgtaacataaaagtgcaaggtgagggagaaagtgctgatgaagatgttgcagcaagttactcagaagacctagctaagatctttgataaaggtgactgcattaaacaacagatcttccatgtagacaaaacagccttctactggaagagtccaaaacttcaaaagacaggctgactctcttgttaggggctaatgcaggtggtgacttttaagttgaagccagtgctcctttaccattctgaaaatcctaggccacttaagaattatgcttggtctactcgcctgtgctctagaaatggaacaaagcctagatgacagcatgtgtttacagaatggcttgctgaatattttaagcccactgttcagacctactgcttagaaaaaataattttcaatactgctcattaacaatccacttagtcacccaagagctctgatggaaaggttcaaggagatgaatgttgttttcatgcctgctaacacaacatccattctgaagcccatggatcaaggaataatttctactttcaagtcttattatttaagaaatacatttcataaggcaatagctgccatagtgattcctctgacggatctgagcaaagtaaactgaaaaccttctgaaaaggattcaccattttagatgctattaacgacatttgtaattcatgggaggaggtaagaatatcaacattaacaggagtttggaaaaagatgattccagctcccatggataacttgggaggggatcaagacgtcagtggagggagtcactgcaggtgtaggagaaatagcaagagaggccgggtatgatgactcatgcctgtaatcccagcactttgggtggctgaggcagtagaatcacttgaacccaggagtttgagaccaacctgggcaacatggtgagaccccatctctacaaaaattttaaaaagtagccgggtgtggtggtgtgtacctgtggtcccagctacttgggtctgaggtgggaggattgcttgagcccaagaagttgaggctttagtgagctggtaagccgtgattgtgccactgcagtgcagcctgggcagcagaggtgagaccctgccttaaaaaaaaaaaaaaaaaaaaaagaacaagagaactagtagtggagcctgaagatgtaactgaattgctgcaatctcatgatcaaacttgaaatggatgaggagttgcttcttagggatgagcaaagaaagtggtttcttgagattgaatctgcccctgaagatgctgtgaacatggctgaaatgacaacaaaggatttagaatactacattacataaacccagttaataaagaagggtttgagggatcaactccaattttgaaagttctactgtggctaaaatgctatcattgcatgctacaaataagtctttcatgaaaggaaaagaaattgccacagccatcccagcctttggcaaccgccatgcagattagtcagcagccatcaacatggaggcaagaccatccaccagcaaaataattgtgacttactaaaccctcagtatctctgaggtatgcctgtagtattttatttcattgagtaccaggatctggattcttcatgttaccattctgcttttttttcatttagcaatatataatcattagcattttggtaatttttgagaacttaatatattaatactttaacttgaatttcactttcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggtaaggattctgctttaacttagaaaatgagacagagcaataatatcaatgtcttggttattagttcttcaaaattcagcaactcttctaatttggaaacctatattcccatttctgtatcattaatatgttccactttcccgaatagaagtatttttttgaggggtcttgttctgtcacccaggctggaatgcaatggcatgatcatggctcactgcagcctcgacctctgaggctcaggtgatcctctcacctgagcgacccaagtagctgggactacaggcgtgcacgaccatgcctggctaatttttttcattttcattttaatttttattttttgtagggacaaggtctcactacgttgcccaggctggtctcgaactcctgaactcattcctcctgccttggcctcacaaagtgttagtattacaggagtcaaccaatgcacacacccagaatagaaactgaatgcacatataacctgaaacatttttagaatgcaaagcctgattaccataaacaaaggaagagctatgaaaaaataatctcaaccattctcctcacttctgtattacactggtagcgaacatttactatttgcaaagcaaataaggtggttttagttcttttgagaactgtacctgaatgtacccatgccacttctaagagtacttcacctttcatattggtattcttagaaaaagttcttagggaaatactaagaaatcaaaattagaaatgagaagactagtttaaaaagccatcatctagctgggcgcggtggctcatgcctgttatcccagcattttgggaggctgaggcgggcagatcacttgaggtcagaggtgggagaatcacttgaacctgggaggcggaaattgcagtgagctgagattgcgccactgcactccagcctgggcaacaaaaagagactccatcttaacaaaaacaaaaaaagccatcatctgtctgtacgttcactacatttacacaaactgatgaaaaacaatactccaggatacttattattttctattttgtgcctatttgtaaacttaatgtatgtaataactatgatcacagtagctttaaaaagcaacagacttttaaaataaaactgggatattacgaattttagagtttcagagaattataagccatcttttccttaggattaaatacaaatatgtcactgaaaaaaatctgaaatgtgcccttccctgtaagatatatgtaaattatatcaggcttttgcattataaaactcatgtcacatgcaaagtggttgttttgagtttgaaagcttacagcccagaccagtggttgctgcttctcagatctcttagggaagaattaattaggccatacatgagatttattatttgattaaatggttatgttttatgtttttgggtttttttttttttttttttggagacggagtttcgttcttgttgcccaggctggagtgcaatggtgctatcttggctcacagcaacctccgcctcctgggttcaggcgattctcctgcctcagcctcccgactagctgggattacaggcatgcaccaccacacccggctaattttgtaagatggggtttctccatgttggtcaggctggtcttgaactcccgacctcaggtgatctgcccaccttggcctcccaaagtgctgggattacaggcgtgagccactgcgcccagcctgtttttgcgttttcttaagctgtaggaggctttctggggacagttaaacatctagaaactgatgaagggtagcagtgttcattaattacctcatttctcaatcttgtagactttaaaatctgcccagtgagattcagcagatgacttgcatcctgctgcccctcagtctgcagacgttcctgggtacttgtccattgtcgtctgagaactatactcttgcatttctcttgaagagttaagaaagctcttgctataacctgactctgtgattctccatggaaacatctgatatagacttaactaaaaatctagcctgggctttctcttctgggctcagcagccctcactcatatgctactcatgttactcttcttttttggacccgcactgactgctatatatcattggctaggatttaagtggtgagactttggccattccgtgttgtattcattttgctttcatggtgtcacatgaccattttacaataatcctattctactccatcctacaaaagttggattggatgaaataccagttatgttcatgacaatgaaaacctaatttttcttttgtcaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagttt

SEQ ID NO: 15547 - DNA, 24741 bp, Human
  misc_feature (1)...(24741): n = A,T,C or G
ctgctttgtttctgagtaaggttcagagttaaattccgagatcggcctttacaagacacacagacctgaggcgcctcacgaggtaaccagcaggtaaatggagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtcggcgtcgctctgctcggcgccccggcccgcgccgaagtcggaagtgcagctcagggcgcagtttcttttggagtcctggacctgagcaagcgctgttttatgcgtcatcatcccgcgcagacacaggaagtgccgcacagagcgagcccctgtcgtcttgagttctgggccagaggtcggctattatatcatcattaggcgtcaacacaggaagtgaggatacttctggcgagcgccggttgctgtttcttctcaggctcagggaccggccgcggccccgtaggggtgagttccgactgggcggaccaggtgtgggagcgcgacgagaactgcgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcacgtaggtgttgttattctggttgtacggaagactgaactgaggtgaattacgttacccaagaccatacaagaatgacagaaacgagacttgatttcaagcggtcatttttcagaacccatcactcttttttgtcgcccatgctgcagcgcagtggctgttcacaagcgcacttcagcctggaactcctgggctcaatcggtctcccatctcagcttgcagagtatatgggactacaggcgctcgccaccttgcctggcttacaacttatcattcttgtttttttttttttttttttttttttttttttttttgagacggggtcttgctggagtgcagtgacgcgacctcggctcaccggaacctccgcctttcggattcaagcgattctgctgcctcggcctcccgagtagctgggattacaggcacccgccaccacgcccagctaagttttgtatttttagtggagacagggttttcgccgtgttggccaggctggtcttgacctcctgaccttgtgatccacccgcctcagcctagagcttacttttttttttttttttttttttttaaccaagtcttactttgttatctaggctggagtgcagtggcgcagtcttggctcattgcagccttgacctctctgattcaagtgatcctcctgcctctagcagcctccttcctgtagctaggaatacaggcacgcgccaccacactgggctaacttttgtattttttgtagagacgaggttttgccatgttgcccgggctggtgttgaactccggaactccagcgatctgctcgcctcggcctcccaaagtgctagggttaccgtcttgagccactgcgccgggcacaacttcttattcttaatgaggatttattctgaatccctcaaaagtgactaggttcaagtgttcagcaccatagcttgctgtgtcctgatgtaggctgaattatttttctttttgcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaacgcttcttcggtgaagttcttttgtacttccaaatgtcgcaggtgagcccaaaatgtattctaatattcagttgacattaaaggcagatttaacacactaaagctgtgtctagattgagcatacatggagaataaaatacgttgaatgttaagtcattagcaaaactggactaatttttctcggttcattattagtatattcataatactatctctaagtatttttaatatagtgggaacttgccttgaaattaatataaatattttacatctttcttggtttgcatggtaatgtactcaggaaacctttttagtaatttggtaagaggcattggcaaagtacctcttttgctaagatttgtagcatcatttgggatgttagtgagtacaggcataccttgcacttcactttattatgcttcacagatattgaaatttttccaaattaaaggtttgtagcaactctgctttgagtatttttccaatagcatgtgctcactttgttagctttttttttgtttttgagacggaatctcgcactgtcgcccagggccaggttcacaccattctcctacctcagcttcctgagtagctgggactacaggggctcaccaacatgccaagctaattttttgtatttttagtagagatgggatctctccgtgttagccaggatggtcttaatgtcctgacctcgtgatccacccacctcggcctcccaaagtgctgggattacaagcgtgagccactgcacctggccaaaaattctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactcaatggaagacaggtgagcagatgtacagatgtgcaagacccagctgtacacagccctggcctggccagtccttcctagggtcactgtgacaactgtgtgctattgtaactattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctattgtaactattaaggtttactctttcctagggttactgtgacagtgtgctcagtgtgctgttgtaaatactgaagtgtactcttttttttttgagacggtgtctcaagagtcttgctcacccaggctggagtgcagtggcgccatctcggctcactgcaagctccgcctccctggttcacaccattctcctgcctcagcctcctggctaacacggtgaaaccccgtctctactaaaaatacaaaaaattagccaggatggtctcgatcttctgacctggtgatccgtccacctcggcctcccaaaatgctgggattacaggtgcgagccacgacctaggattactgtgacagggcatgctgttacaactattgaggtttactctttcctagggttactggtgaaagcctgtctctactacaaatacaaaaattagcctggcatggtggtgtacacctgtagtcccagctactcaggaggctgaggcaggagaattgcttgaacgtgggaggcaaaggttgcagtgagccaagattgtgcctctgtattctaccctgggggacatagcaagattctgtctgaaaaaaataataataagtccgggtgcgatggctcatgcctgtaatcccagcactttgggaggctgaggcgggtggatcatgaggtcatgagtttcagatcagcctgaccaatatggtgaaaccccgtctctactaaaaatataaaaattagctgggtgtggtagcgcacgcctgtactcccagctactctggaggctgaggcaggagaattgcttgaacctgggacaggaggcagaggtttcagtgagccgagattgcgccgctggactccagcctgggcaacagagcgagactccatctcaaaaaaataaatacaggccgggcgtggcggctcacgcctgtaatcccagcactttgggaggctgaggcgggcagatcacaaggtcaggagatcgagaccaccgtggctaacacagtgaaactctgtctctactaaaaaatacaaaaaaaattagccgggcgtggtggtgggcgcctgtagtcccagttacttggaaggctgaggcaggagaatggcatgcacccaggaagtagagcttgtagtgagccgagagtctcgccactgccctccagcctgggcgacagagcaagactccaatctcaaataaaataaataaataaataaaattaaattaaataaataagatgtgatgtatttttacatgcccctgaaactgtcaccacagtcaagctaatgaacctgcccctcaccccctgcaggtcctctgagaggcatttcgttccatctgcacaaaacattgatttcttacatttttcatctgaatcttaagactcctaggccgggcgcggtggctcacgcctgtaatcccagcactttgggaagccgaggcaggcagatcaccaggttaggagattgagaccatcctggctaacacagtgaaaccccgtctctactaaaaatacaaaaattagctgggtgtggtggcgggtgcctgtagtcccagctactccggaggctgaggcaggagaatggtgtgaacccggaaaggtggaggttgcagtgatccgagatcgcgtgtctacactccagcctgggtgacagagcgagactccgtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtcttggaaagaaaaagttcatcacagaaaagatgaaaagaggaaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctagctgaaagcatgtgtgcgtcacagaccgaaaaccagagagagcaaactagctgaaagcatgcgtgtgtcacaggccattcagaagggctatagagagagcaaactctagctgaaagcatgcgtgtgtcacagaccattcagaagggctatagagagaatactctagctgaaggccgggcgtggtggctcaagcctgtaatcccagcactttgggaggctgaggcgggtggatcacaaggtcaggagatcaagaccatcctggctaacacggtgaaacccagtctctactaaaaatacaaaaaattagccgggcgtggtggcgggcacctgtagtcccagctgctctggaggctgaggcaggagaatggcatgaacctgggaggcggagcttgcagtgagccgctatcgcaccactgcacactctagcctgggcgacagagcaagactccgtctcaaaaaaaaaaaaaaagaatactctagctgaaagcatacgtgcgtcacagaccgttcagaatggctatagagagaatactctagctgaaagcgtgcgtgtgtcacagaccgaaaaccagagagagcaaactctagctgaaagcgtgcgtgtatcacagaccgaaaaccagagagagcaaactctagctgaaagcgtgcgtgtgtcacagaccattcagaagggctatggagagcaaactctagctaaaagcctgcgtgtgtcacagaccgaaaaccagagagagcaaactccagctgaaagcatgcgtgtgtcacagaccgttcagaggggctatagagagcaaactctagctaaaagcatgcgtgtgtcacagaccgaaaaccagagagagcaaactccacctgaaagcatgcgtgtgtcacagaccattcagaagggctatagagagaataccctagctgaaagcatgcgtgtgtcacagaccgaaaaccagagagagcaaactctagctgaaagcatgcgtgtgtcacagaccgaaaaccagaaagagcaaactctagctgaaagcgtgcgtgtgtcacagaccattcagaagggctatagagagcaaactagctaaaagcatgcgtgtgtcacagaccgaaaaccagacagagcaaactccagctgaaagcatgcgtgtgtcacagaccattcagaagggctatagagagaatactctagctgaaagcatgcatgtgtcacagactgaaaaccagagagagcaaactctagctgaaagcatgcgtgtgtcacagaccgttcagaggggctatagagaggatactctagctgaaagcgtgcgtgtgtcacagaccgaaaaccagagagagcaaactctagctgaaagcatgcgtgtgtcacagaccgttcagaggggctatagagaggatactccagctgaaagtgtgcgtgtgtcacagaccgaaaaccagagagagcaaactctagctgaaagcgtgcgtgtgtcacagaccattcagaatggctagtccatttttcctctggggttttctctcccccattatattgtttgggagcagtttgtttacatttgaaatgacctgaattcaacaagtataggagaaaaacacaccccaaaatgggtatttgctcaagtccaaagaatgggttaggcttgagcagtttgatctcgtaccaacatcaggagattcttacgggtgttaggaaaattggacctggagcccgattgaaatctcattattataaatacgcttgattaattaatgtggcttcattgcacagtggagaagcccactgatagcaaagctttgttctgtagtctttgtgaagagtggtttttgtattataaaactgataattatagtttattcagtatagaaaatttttaaaagattaatattacaattctcttctgtgatagcagaattgtttttcttttttcttctttcttcataattagacgcttactgcagatagnnnnnnnnnnnnnnnnnnnngtgtcacagactgaaaaccagagagagcaaactctagctgaaagcatgcgtgtgtcacagaccgttcagaggggctatagagaggatactctagctgaaagcgtgcgtgtgtcacagaccgaaaaccagagagagcaaactctagctgaaagcatgcgtgtgtcacagaccgttcagaggggctatagagaggatactccagctgaaagtgtgcgtgtgtcacagaccgaaaaccagagagagcaaactctagctgaaagcatgcgtgtgtcacagaccgaaaaccagagagagcaaactctagctgaaagcgtgcgtgtgtcacagaccattcagaatggctagtccatttttcctctggggttttctctcccccattatattgtttgggagcagtttgtttacatttaaaatgacctgaattcaacaagtataggagaaaaacacaccccaaaatgggtatttgctcaagtccaaagaatgggttaggcttgagcagtttgatctcgtaccaacatcaggagattcttacgggtgttaggaaaattggacctggagcccgattgaaatctcattattataaatacgcttgattaattaatgtggcttcattgcacagtggagaagcccactgatagcaaagctttgttctgtagtctttgtgaagagtggtttttgtattataaaactgataattatagtttattcagtatagaaaatttttaaaagatgaatattacaattctcttctgtgatagcagaattgtttttcttttttcttctttcttcataattagacgcttactgcagatagttttctattttcaaagttttttatttaacataaaatcatgattattcgactgggtgcagtggcccaggcctgtaatcccagcactttgggaggacaaggatggaggatcacttgagcccaggagttcaagaccagcttggccaatatagtgagaccctgtctcttcaaaaaaaaaaaaaaaaagattaggattacttaacatcattatttaaatatttaatgttcttgatttaatttcattttcatgtgattttttttttttttttttttttttttttttttttttttgagatggagtctcactttttcgcccaggctggagtgcagtggcacgatctcggctcaccgcaacctccacctcccaggttcaagtgattctacagcctcagcctcccttagtacctgggattacaggtgcctgccaccacgcccagctaatttttgtatttttagtagagacggggtttcaccatgttggccaggctggttttgaactcctgacctcaggtgatccgcccgcctcggcctcccaaagtgctgggattacaggcgtaagccaccgtgcccggcctcgtgaaatttttgaagtgaggtttctttgcatgacactttatttctcattagggaagcatgctagagtgaaagaaagagagcacgaacgtcggaaacgacatcgagaagaacaggataaagctcgccgggaatgggaaagacagaagagaagggaaatggcaagggagcattccaggagagaaaggtgagtgggctgggtcagttgaggactttatgaaagggccgtggtagtgtgtcctgtcacagcaatgaagaagaatttggcaatagaagtcacatttggtgcagaagtggtagacatggaaacagcacagtgaacagctggacgaggctgaccaagagaactgtcctgagggagtgagttttcactgcatctggaagtaagaacgggtgtgatttgattgagggaagacaatgaagggatcagaaatctgcacgtccggccaggcgcagtggctcacgctagaattccagcacttacgaggctgaggtggttggatcccttgagcctgggaggtcaaggctgcagtaagctatgaccatgctactgcactccagcctggttgacagagtgagactgtctcaaaaaaaggagaagggagatcccaaaaaccttgaaacagtctggaaatcgggacactggactcctaggactcctggccattagtttatatattcgttcccctttatgaaccagattcccaagaaagaacatcggtgtagccccagatctgttctgtgaaccaggaaaaaggctgtaggccaggtgcgagcaggcccatctccgccttcagagtgagtccacagaaagcttgcaagctgctccaggaagagaggagtctgaagcggaagggcgtgtgcagcgatgtttgccagcagccagggctgggtacacagcatgtaaagatgatgagagggcgctggttcttgttgatgccgaagggtgtgggagacactgaggcccaggggtcaaggtccgagaccgctgcggggtgagcaaggtttcagttggcctagttcctgttagtgtgtgaaacattcatgtatgccacaccctgtgccagacattgagtgtgtcttgtcccacgagagtacagcttgggatagaagtggaggttggtagatgaaatttgggctgtcatattgatttcccagaaggtaaagacaggagagtgaatgagcaaaaattgttgggggcagacttctgggtagggccgattcagatcagccaatccagaactgggtatggtagcatatgctacgtgggaggctaaggccagaggaccgcatgacgccagcctgggcaacgtagggagaccttgtctctgacaaaaaggaaactgataaggataatctgagaagcactgatgcttggaaaactgctgagctgtgggtgaaagcagtaagaatctgaccttctggcctgagagctgctccctttactgcttccactctgcacttgggaagcacggaggttccactgggacagggcagctgcaggacctgcagtttccttgctgccttggaaggggttactccgtttagagcagtgggcagtggccttgcccaccagcatcctcagtggagggaggaagaaaaggccaagaggtctgctagaatgaagtacagtgtggttgggagcagctgtgatcccgccaaagacgtgcagcagagactggagagagctcgagccgccacccacttgtgaccagccctgaggatgcagctgcgtgaaaggacctggcagaaaatagaagccgccacagatgcgaatgacgcgtgaacgttcagtgtgctccctgtccacacacagccgtgggccaaggaagccttactgtgctcgaggtatttgagcccagcctttttccagtgctggctaattgctaagctgtgcagccatggtggtgacccctaggaagccaaggttgaaaattaaaataggcatgtgggaaggaacggggtggccacgagctgtgagggagatggatttcacggacaaccagacaggcctcggtggtaacaacgaaagggaaaacttagaatccagaattgctacaaatgtattatctaaaatacaaagaagtatgacagtgtgacccgtactgaggaagaacatcatcagtagaaactgtctgagtgtccagatgttgaatttagtaaaggcttggaaacaacttgtggatggagcagtagaaattatccattctgaagaacagagagaaaaaaacaagaaaaatgcacagagcctcagaaacccgtggtacaacatctgctgtaccaaagcacgtcgaatgggggttccaggagagaggaaagatatttgttacaataatggttaaaaactttccaaattttaattaaaaaatatgcacattcaagagcacaggaagtttgaactagaataaatgcaaagtcacatcatagtcaaactggcaaaggccaaagagaaaatgttgaaaggcctcagagaagaatgacccatcccatgaaaggggagcttcaataccgccagccactgacttcttagaaacaatggaggccagaaggcagtggagtggcatactcaagctgctcagagagaagaaccatcagccaggaatcaaaaccgttctacacaagtgaaagggaacgaacgacattccctgagaagcagagactggtgggattcattgttggcgaaacctgccttaaaggaaatactaaaggaagaccttcaagttgaatagaaatgacaccagacggtaacttgaatcctcaggaaggaaggacaggcactgcagatagcaagtgtaggttgacgtcaatatcctgtaactatctctcctcacatcttaggttttactggaactacgattgtataaaataattacactgttgtcatggtatgtggcataaatggactgcacaaagaagacagggaataaagctgtgttacaacagttttatattgtactggacttgagctagtatcatgaggcatacggtgatccctagagcaaccactaagaaagttgttttcttagtgttctaaaaagtacaaataaattaaaatggtatgctaaacatatgtaatttaaaatcaaaaagggaagaataaaaaagacacaacaaagcaaggaaagtaaatccaactgtacgtgtaattatatgacatgtgaaaggtctctgtgccccaaacagacagggcagattatcagatagaaaaacaagatctaactgtatgctgtctgctagagaacaggaaaagacgcagcgtacaaacatcagctgtcataggagagcttgaatggctgtactcataccagacaaaacagatgttaagaaatattagaaaccagcctggccaacatggtgaaaccctgtctctagcaaaaatacaaaaatcacctgggtgtggtggtgcacacctgtaatcccagctactcgggaggctcaggtatgagaatcacttgaactcgtgagatggaggttgcagtgagccgagattgcgccactgcactccagcctgggtgacaaaccaagaccctgtctcaaaaaaaagctagaaacaagaaggagcaaggacttcacagccagaaacaggccaatacagcaggaagatacagcaatgatacgtgtgaatgcatctaaccacagagcccaaaatccatgaagcaaacaccgatcgaatggaaagaaatggatcatttattaattagaattggaaatggcagctgggcacggtggctcgggcctgtaaacccagcactttgaaaagcggaggcaggcggatcacgaggtcaggagattgagaccatcctggctaacatggtgaaaccctcgtctctactaaaaatacaaaaattagctgggagtacagggcgcacgcctgtaatcccagctactcgggaggctgaggcaggagaatcgctcgaacccgggaggcggaggttgcagtgagccgagatcgcgccaccgcactccagcctgggggacagatgaagactccgtctcaaagaaaataaaataaaataatgaaaaaaaaacttcacggattgaattacgtagaaagccagtttacaaatgtggacaaaaacgcgataagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaaggtaggcggcgcggtgggcagctgtgctcggcgggacgcgtgtctgctgccccctggtgctgggcacttgctgtcacaggcgggcgcttggttccggtgcttgcttttcgcccctgccttttttttttttttggaggcagagttttgctcttgtcccccaggctggagtgcggtggcgcgatctcggctcactgcaccctctgcctcccgggttcaagtgatcctcctgcctcagcctccggagtagcagggattacaggcacccgccaccatgttcagctatttttttatatttttagtagagacagggtttcaccgtgttagccagaatagtctcttgatctcttggcctcgtgatccacccacctcggcctcccaaagtgctgcgattacaggcgtgagccaccgcggccggccagtacgagcttttatagtcacccacgtcctcaccttaatggagatctttatttcttcacccagcttccggtttctgtctcgcgtcctttccttacaccccacacaactccctggagcttattcttcaaggcaggtctaggtctagtagtaatgaactccctctgcttttgtttatctgagaatatcctcatttctccctcatctttgaaggaaagtttgctggatacgtggttcttggttgacaattttgttgttgttgttttgagacagagtcttcttctgttgcccaggctggagtgcagtggagcgatcatagctcactgcaacctcgaactcctgggcacaagtgatcttcccacctcagcctcccgcgtagctgggacctacaggcgtagcgtgtgccaccacacctggctcatttttcagtagaaacaaggtgtccctgtattgcccaggctggtcttgaattcctgggctcaaggaaccctcatgcctagctgacagtttttccttttcacttggactatttcagcccattgtcttctggcctccaaagtttctgatgagaaatctgatgatcttatagaggatcccttggatgctttaatctgatgacctgattgaggatcccttggatgctttgaagattctctttgccttaggctttcaactgtttaataatgggttttcctgtgggcctcttgacttcattctacctggagttcactgagcctctctaatgtttatatttacggttttcatccaatgtgggggttttgaggaattcttcagataccctctctgctcctctcctccctcctgggctcccacagatctgttggggtccccgaggccgctcagcactgctcccttttcttcagtctcttctgctttcttttcctcagacgatgtgattttattgtcttcaggctcaccgattatttcttctgcctgctcacatctgcctgtgagtttctgttgtgaatatttactttttagtgtctattgtgagcatgtacttattagctctggaatttctctctggtttcttgttggatcttctgtctctgttgatatttccgtcgtgttcacgcgtcattttcttgactttctccacatcttcctttcgttctctgaggaactgaaggtttaagacagttccctaaaatctttgtctgggacatctaccgtcaggtgattttcaggaaccgtgtctgttggcttctttttttcccctctgaatgggacatactgtcctatttctttgtttctcttgtgtttttcttagtcaaaaaaatggacatttgattctcatgatgtgattcttcctggtccccactcaagggtgtgcacttgttgttttggttgtgctgggctgtgtctgtggggtcggcctgttgtggaaactcagggtcttcacgggtcttttctgagcctgagccttttcctggtcacgtgcagccactttttaacgttcccgtcaatacagatgtttttaatgttcttgtcctgaagtgtctgcctcctaaagggggaatagagagaaatgaagggggcaacgggggacgtggtgctcatgccctggaagtaccttcagcttgggggtggccgtggctgctgcctcttcatgcctctggggtgggacacgcagtcatcacactgacctcgggtgtgtgtgtccgtctgcccacctgggtccggcgagctgcatgcaggctgctgcctgccagcggggagtgaggtgggagccactaatgtgcgaagcggtgacgttgattaatgaatcacagtttactctccaagattccccctgaagttgcaaaccttcagtagactccagagcacctcagtagttgcacaggcctgatcctgtgatgcaagtgttgtctcggtggggagactgattcccagtgcttcctactccatctttccagaatcttctcccgccccttcctttttgaccagtgaagatcagtctagaaggtccacctgggtcctcgggctcacggcctccaggttggagctttttctccctgggcttcctgggagacctctggcctctgaccccgatgctgtcagcaccctgtgcacgctgtgggtgtgtctgccaggtgcgggtgtgggagacgaggcagctgtgccgggtggggccttttgaggaaggcagtgctgctagtgccatctccctctctgccctgcgcgccagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagtgtgagtcttttctgggggatgtttggcataagtgtgtaggattcatttaaagcccagctaagtaaccgcttcagaagaaagtgagagatgtgctggctgaagtcctctcgtgtcgtgagagggaccgtgagtgtctgtgtgcggccaggacacaggacgtgtgtttatccgctgggacattcgccactggccccgttagagaagtggcttccagcgtctctggatgagctggtttccgaccaagcaaagttaatcgttacgtgaaaggcactagttttggggtggtggtagcttgtttgtttaaaaacatttccccaaattcacctttatggtttatctcataagtaaaagaagagaaaatggaagaaagggacctgctgtccgacttacaggacatcagcgacagcgagaggaagaccagctcggccgagtcctcgtcaggtacctggaaccgcctggccaaggccttgaccactgctgcccaggaaggcccaggttcaccctctgctctgctgtctttctacagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccggtgaggcaccgcgacgactgtgtgaggtgttgtgacttcactatagtgttagaaaccgcagagaagtagctggcgggcgggggagttgaaactcccttctatctaggactctctcgggacacctccacatcgattctttttgtttgtttttttgagatggaatcttgatctgttgcccaggctggagtgcagtggcatgatctcggctcactgcaacctctgcctcccgggttcaagtgatcctcccgcctcagcctcccaagtagctgggagtacaggtgtgcgccagcacgcccggataatttttttatttttagtcgagacggggtttcaccacgttggccaggatggtctcgaactcctgacctcaggtgatccacccgcctcggcctcccaaagcactgggattacaggcgtgagccaccgcgcccggcctccatatccattcttgggaacacttgttgcttagctgaagcggagcccgcatcctgcctgtggcagcactcgccccggtgctggtctgagcagacgcctcctttctcttgcagaagaagtaagtgaggaagaaatgagtgaagatgaagaacgagaaaatgaaaaccacctcttggttggtaagaacctccctggagacagagccccctccttgtctgtctccgagtgcagcagccctctcctaagacagccggtcctgcgcggcgtggggcacgccagggtctgggaggccgcctgattcgttggccgctccaggctgtgccggtggggcccgcattcctcagcgaggcacagtgctgaccaagggcgtcctgagtgcccagcagggccgaggagctgggaagcccaggaccagttccccacaggggaggcccgtcagatggtggctccgggcctgtccctgcagaacagaggcctggcccagcctccgacaggcagtgaggttatgtcctcagcctggtggacgtggatgtgggcttgtcccccacatgacacccgacgcctcctcccagctcagcatccgggctctgtctcagccgagcctgccagcactcttaggcctcggtgccctgtgtccaggggacgagagcccagcgccagcacctcccagcgggacacggggcagccctgccacgcgcttgatgcccccggggcaggaggaggttcatgatccttgcttactcctagcttcgtaattaggttcaacttttccagttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcaggtcaggccctcccctcgccccgggccgctgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgctcaggcagctatcaataaggcaggatattgttgggagtgatttggaagggacaagcctgagaaggtaccagtggcctcgggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccacccagagtacgtgacatccggcctgggcaccggccccaaggtacaccgaggggtaggtgccctggcatggggcatcatgctgcgcctggcaggtagggcccgtcctcagtgtcatcctggtacaagcaggggacacatccactttgacaaagagactcttgggatggctttttttttggagactgggtctgtctctgtcacccaggccggagtggagtggcttaatcatagctcactggagcctccccctcccaggctcaaacaatcctcccatttcagcctcctgagtagctggaactacaggcgcaagccaccatgcctggctaatttttttattttgtagagaaggagttttggccgggcacagtggctcacacctgtaatcccagcacttttggaggccgaggcggtgggcggatcagaggtcaggagttcgagaccagcctggccaatatggtgaaatcctgtctctactaaaaatacaaaaattagcctggcgtggtggtgcgtacctatactcccagctactagggaggctgaggcaggagaatcgcctgaacccaggaggtggaggttgcagtgagccgagatctcaccattgcactccagcctgggtgacagagcgagactccatctcaaaaagaaaaaaaaaaaaatgaaaacagagtgttgctatgttggccgggctggtcttgaactcctgggctcaagcaatcctcctgccttgccctcccaaagtgctggaattacaggcctgagcccttgcacctggctgggatggccttttgttcacactggttttgtttcataataaagtgtcagatggttttgcaaggaaagagactttgaaagaactgagctgctcccggctccacccctggcccagtcccaaggctctgccctgcacctgccccgtgccgggtgtgccgtgcctgcggacgcagccgccctccctccagctggcatggccactgagacctcacacaggcgcttccttcccagggctgccggagcgtcgaggagttccagtgcctgaacaggatcgaggagggcacctatggagtggtctacagagcaaaagacaagaaaacaggtgggtggggtcccctcaccccacaaaggcaggggaagtggggcaggggctggctgcccgagagctgcgactgcacctgggcccgcctcacctgagcagctactggaggttggacccctcagcacctctagaagccagaggtcagcctggccctggggctttgccactcccttgcagtagcaggcggcctgccccacagggccgaggcccagcgcgtggagtggtctgtgccggggctggtgtgcaggtttgcgttcccagcgtcccacccaagcaggtgtgtgagccgggaactctgttgggagtcggccactgggatcccaggtgaggccggctctgttggggaagtcgatgtggagtcggcgtggccgctgggatcccaggtggctgtaggtggctgtgagtgtctgtggtgtgttgagtgggaagccgtgggtgttgcccagacctcagctggggcgttctcctggtgcccacgtgcccccacctagaacgagacccccctccgtgaaatgctggcgctttgggcactgcctgcggtcctcactgaacgagtccactgttggtaccgtgactttgagaatgcctctcagtgccgtctgtattttcttcacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggtacagccgcgccccgggggcctgtctgcgtacaagtgggggcagggtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggtgacccgcccgggcccacccacagccgcccatctgtcgttgcaggtgggtgattttgggctggcgcgggagtacggatcccctctgaaggcctacaccccggtcgtggtgacccagtggtaccgcgccccagagctgctgcttggtgccaaggtgagtcctgggcgtctgagtgcctcccctgtcccccatgcagcctcccacagcttcgcgggcactggccttcctgaacacctctcctggcgtcttaggaatactccacggccgtggacatgtggtcagtgggctgcatcttcggggagctgctgactcagaagcctctgttccccgggaattcggaaatcgatcagatcaacaaagtgttcaaggtgggtctggccctgccgcaggtgcgctatgggtttcagaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagtgagcccagtgcagccgggtggcgggaggtcccgagccatagcggtgacttcccagtcccaggcctacctgctggctcaccacgttccagaactgctctggtgcctggcgtcccatgccctgagccccgtcccaacacagcccatctttgggggacccagtggagcacacgagcacctcctgggcctctggccctctccccccaggttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgcccagggcggagagggtgggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaagctccccgtgtcgtcctttgagtgacccgggaccatgtgtgggaggggagtcgcagaccaccgggctctaggggaagagggtggggtgggcggctgtggcctctgaccccatgtgggccagtgtcttccccaggcaggaggggagctcctacctcctggggggcctccactctggcaaggtggtcccccaccctgtgccagtcctcccagcccccacccacatctccttgcagaagatcctggaggcccatcccagccacatctttcaggaagccccctttgcctccctcccccagctctgagcaagtcctagacagaacccaggcttctggggctaccccaggtgctgctccacgtgctgcccctgtcactggggcctccgcttatcccactttcccaggggccaccttagcaaagcccgtcccgtcctgtgctgtacctgttgtccgctgtgcggggaagcaggggtgcccagccccgaggacgcccagctctcggtggaccaggggctggggtgtccacctgcccagactggctgcccgctgccctcccaagaatgagcgaggagccatcagagagaaagtgctttatcagccgggctcagccccgcacacggactcgccaggagtaggtggtcagcacgcgctgctggcggcgcaccacgcaggtgtaggtgccctcattgacggcgttggcgatgatgctcaggtgcgcctcgcccagggccaggtagccggggtaggagaactccaggggctcctggtccttgtaccagctgcaggggggcggggcgtctcctgcaggcacagcccccccccgctgcctgccccgcacccctgccccaaggccgcccgcgggctgcccaccccgaggaccgcccggggcgctcactcactacactttccctttcttgtggaggatcttctggccgcagcggaaggtcacgttcctgccctcgggcaccagcctggttttggtcctggggggcggtggggtggtggccaccgtggggaaggggaattctgctccgggtgggggaaagagccccgtcagtgccccctcagccccgaccatggccaaggcccagctcccacgcagccctgtcccggccccgtgggcatcaccgtagcagaagtcgcagctgctggggcagagcctcttcatgagccgccggcgagcgtcgcagaagcccctccgcgcccaggacgcgcacacgaacagcctgtcgaggcatcctatcgggagcgtggggagcacggcctggctcaggaccgcccggtccccgccctcccgcccgacaaagggactcaccgtagagccggtgcagcccccacagctcgtcctgggacaacgccttccagccgcgcagcgtggcgttcaggtgcatgagcgcccggccgtgttgtgagtgcatcaggcccagcgcgtggccgatctcgtgggccgccacgtgcaccaggtccgtgagccacacgcctgcgggccccg

SEQ ID NO: 15548 - DNA, 14305 bp, Human
tagtccacaaaagaacaatgaggaactagctttgattaggcacgtacgttttaccaggcatggtgatagaggctttacataggtcatctctttgaacttcacctcaaccctctgaggtcaacatgtattgcctcattttacaaattaagcacagacccaaggtacatactgagtaaagaaagagagatttggctgggactgagtccaggccctctgactgtaagtccagtgctctttctggtcctgcaatttctaatccacacatcggatagtttacctgagttaaaaatgtgaattaagtcaggcttaaagcagaattttgttttctatcagaaattctagagtaggtggaaggtgaagaccaaagaaggtattttctttttctttttcttttttttttttttgagatggagtctcgctctgtcgcccaggctggagtgcagtggcacaatctcagctcactgcaagctccgcctcctgggttcaaaggattctcctgcctcagcctcccaagtagctgggactacaggtgcccgccaccatgcctggctaattttttgtatttttggtagagatggggtttcactgtgttagccaggatggtctcgatcttctgatctcgtgatccgctcgcctcagcctcccaaagtgctgggattacaggggtgagccaccgtgcctggcccaaagagggtatttttttcttccctctcggtatcatccttactcaattacaaatgatcaagggcggtactgccagagtcacctcgagaggccctgttctctgccacccaggctgttttgtagtctccattccaaattgtcgttactccggtttaccccgtggatggcgtttaagacttttcttaaatttgaaattcacagaaccattttaaagtgaacaattcagtggcatttagtaccttcgcagtgttgtgcaacttccacctctatctagctgcaaaacattttcttttctttttttttttggagacagagtctcgctctgttgcccagactggagtgcagtggcgtgatcttggctcactgcaacttctgtctcccgggttcaagcaattctcctgcctcagcctcccgagtagctgggattacaggcacacgccacccgcctggctaattttttgtattttagtacagacggggatttaccatattgcccaggctggtctcaaactcctgagctcaggcaatccgcccgccttgtcctcccaaagtgctaggattacaggcgtgagccaacgcggccggccttgtaaaacattttcatcacacaaaagaaaaccttctacccattaagcagttactccttcctcttctcagcccctgtcaaccaccaatttgctttctatcctatggatttaactgtctggatatttcatagaaatagaatcacataatgtatgaccttttctgtttggcttctttctattagcctaatgtttttgaggttcattcctgttgaagcatgtatcagttcttcattccttttttgggatgaataatgttccataatttatttatcctttcgtctgttgatgaacatttgagttgtgtccacatcttggctattgtgaatagtgctgccatgtacattcgtatgtaagtatttgagtatctgttgggtgtatacctatgaatggaattgctgggtcttttgacaattctgtatttaactttttgagaaactgccaacattttcacaggggttgtaccatttcacattcccaccagcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggtatgtgtgatggaaaaattcttcattgttctttcctgtgaaatagaaattgagaatttccttgctagttaaaacaacaacaaaacactttacctaagaatactattttccttgggtggtttgttttaatttttaaaataaaaatatactttctggcttatttccaatgaatccttgaacttgaactttatagttggaaagcacttatgttttcagtttttattcttaacagtataaattacagtagtgagctttggggattaataaagcacctctctcatgcagcttcacaatcagctgtgcacacactctaatctagtacttagcttttgctagggttgtcatgacagtacagacagtacagaaatttctacaatcagcacagaaagttgctatcagatgctgttatttttaggtatttatgggttgcaaaagacaggtgtaaatttttgtaagttcatcgcttacaaattggtgtttttcagtttactaatacataataaatagtaacatatattaatatatagcaaattacattacatataatatataacacattattactaataataaattccgggctgttaaagtttgttgattaaaacataatatactgtatgaccagcaagaacctttattcaagaattttcaaataaaaatttactttattatcagtgcctaaaaaagccaagactatgtagaggcctgtgttgaaactcatgttggtaaaaagcctgacacagctggatgtatatggtttcctttatattccaatatacttaataattatttttttaaagcacttaagtgttcattgatcctctctccaacggccttcacctctcccaagaggtaaccactgttatcaattattttgcatgcaaaacatgcctactgaatctatccatagaaaataaacaatacttctttgtaaaacattttttgtaaaaaaagttttatataaaatgtatatgtatgcttatgtatatgttttacataacatatatgttataccatataacacataccttttttacatatacacatagattttttatgtatacatataaattttgcatacatatttttacatgtgtatatgtaaaaatagtacatggtactaatgctgccacttatttttttacccagaattatttaaaatagtattattaagagtgctgtgtatattctgttatatgtaagtgctgtagagtatctggccatttctagctgatagctgtttaggttatttcgagtttgctgtcacacacaatgcttcattgaatatcattttacgtaaatcttcccttgtgcgtgtgtgtagttttctagggtggatgttgggttgtagatgctgggtcatggtgtacatacattttttaatttgttaggtccttgccctccaaagtggctctaccaagttacactcccatcagcagctcgttagggtatgccccgggattctcctaccccagctgactaacattaggttgctgcaattcatcataattttcttaatttgttgggctaaaaatatagagtttatcttgtttcaattcttgttttcttgatttctagtaaggttaattttttttttacattttgagcatcttttcatatattaactgatcatttgtaaatgcagggaattgtctgtttacaccctttgcccattttccttttattttgtctttttcttattgatttgtaggaattctttgaatattctggatacaaattattatttttattattgtttaaattttttgagacagagttttcattcttgttgcccaggctggagtgcagtggtgtgatctcagctcactgcaacctctgcctcctggtttcgagcaattctcctgcctcatcctcccaagtagctgggattacaggcatgtgccaccacacccagctaattttgtatttttagtagagacagggtttcaccatgttagtcaggctggtctcgaactcctgacctcgggtgatcctccccctttggcctcccaaagtgatgggatcacaggcgtgagccatgcacccaaattatttttatgtatgtggcagatatcttttagtttgctgattaacgctaatgatgtctttggtcattataaatgtttaaaagtttgttgcaatcaaatttattgatcttttacttgatgcctttttcattttgtttaaggccttcctgcatgatagagcttactgcagctactcccctttctcaatcaccttcttcctggaacttagttctttctaactgagcctgactgaggctgggcgaatcatgtgaaatgttttgtcatgttttcttccggttggctgtgggaggctatacttgaggactggtggaaattcagctgcactgtgtagatttcaggtgaaggcaaatgttctctggcacagaggaccacagatgagcctgcagagaaatactctactagtttgcaggctctatttgggtttggattgtatttccaacgcttagcataatacttggagcacacagacagtgaataaatgttagttaaaaatttaacttctccacaataaattttgtgagctcctggaactcactgttagcaagaggtgtggaattgtctctgagaatttctagtagtaccctcatctttcaagggtggtacagatgtaaacatgagtgtggccggatgaacctctcccgagtgtagatacaaatacacacattgcctgcacgtgcacacactcagcctttctaaagtttccaagctcttttttttttttaaaaaaaacacctgaatagttcaagttgtagacatgaaataaatactcttggaaatgtcatttcaaagcaatctccatgccgctttcccagctcagatgagacattgattctgtcaacgataggcagtgcttttttgagtcagtgcaaactggcatggaaaactgttatcatcttttcatagtgatgttgacaaatctgcttaaatgaatgaatttactcttgaatgattcatttcaggggaaatggcacaatcacacacctatgctggtagagtcagtggcccacaagaagaggtaagagtagagaaggcacttacagctttatcaagatgtgagcacatacaatctataatttaattaaatgttaaaattgcccagagactttatgaaaactttgaatcaacaatgcggtatgtgccgggtgcagtggctcatgcctgtaatcccagcgctttgggaggctgaggtgggtggattacctgaggtcaggagttcaagagcagcctagctaagatggtaaagccctgtctctactgaaaatacaaaattagcagggcctggtggcggatgcctataatcccagctacttaggaggctaaggcaggagaatcacttgaacctgggaggcggaggttgcagtgagccgggattgtgccactccagcctgggcaacagagtgactccatctcaaaaaaaaaaaaaaaaaaaagcggtatgtgagcacagcatagatgttcagagcaccaactcagaatcagacagacctggcttcatttctgggctcgagtgcttactacctgtgtgaattgtacaagttgcttaacttccctacgtcttgtttcctcatctgtaaaaacaggaaaatattgcaacctatgtcctgggactggtataaggatcaaattagttaatatatgcaaagcacttgaaacaattcctgaaaatgagtactcaatacaagtttaggatttttgtttaccatgtaaaacagatcccctaatgggaagaaacgagactggtctatcagtaataggactcataatctctttcgttattctctttctcctttttgtcagttgtctttccttccttcctgccttcctgccttcctgctttcctgccttcctgccttcttttgtttgtggcttctcatctctctttttgtcctcttccatatttaccatggtttcctcctgtccgctctcctaattggaagtgctgagaggatgtgctctcacaagatctgacaggagagctagtgccatttggctgcctccagcattcataaggaaaggatggttcttaaaaaccattagaatgttcatgagatgaaactcatgtctcttctcttgggatcacccttccttttgaaccagatgggtcttcttacttcctcccccttcaatgaagcattctcctctgcatatgctgggggagtagaaagaatgcttggcactcagctccacatgggagaaattgtgtctacttaatgcatcactgtgtacctcatgcctagcatagaaggtaacaatatttgctgatgggatgattcaacgaaccaacactgaaactgaatatttgaactctggttttctcactcactagaggtataaccttgggtaaattactgaggtactctgagactcagattccttatataatgtatataataatatgacatgacatatgataatttattatatatgtaatatttaatgaaaacaatcttacctacctttaaaggaaagctaaaggattataaaacactttttgtaaaacagtgctttccaagctgtcaaatactgtgcaactacgagagtcgtgggaaattccaggaagtttagataggtaattctttgcccttctgaagtaggatgtacagtcagagttggtgctttcccagtaaccaccattttaaaggttgggtcatacagttaggtcaagaggttttttttcttttttttttttttctttgtcatcctcttactctaaataatagtccggtcaatttgaggccaaataaatgggcacacagagacatgtatagatgattaactaagtgttcactttggcaaaggcatttccaaaaggtataaagatctagcagcaaggtgatactatctcaagtgttcatatatatcctttgattaaataagttttggggcaaaattttctatgtcttttgaatttttacttgagactctaaaatcatttagtgaaaaataaaagaccctcaagtcaggcagaaatgtatgacacttaagtgctagttctctaaccttgggagtcagcctggactcctgtctctcatagcccacatccatccatcagcaaatccccctggctgcccctttgaaatgctgtaataccctgtgcatctaggccgccttcctctctcacttgactctgtcagtagcctcctgccagactccatggttccatcctttatctgctagaatttgttttccacatagcccccacagcgatatttttaaaacttgaggggccgggcgcattggctcaagtctgtattcccagcactttgggaggccgaggcgggcggatcacgaggtcaggagatcgagaccatcctggctaacacagtgaaaccccgtctctactaaaaatacaaaaaattagctgggcgtggtggcgcatgcctgtaatcccagctacttggtaggctgaggcaggagaattgcttgaacccaggaggcggaggttgcagtgaggtgagatcgtgccactgcactccagcctgggtaacagagtgagactctgtctcaaaaaaataaaataaaataaaaacttgaattagatcatgtcttggcctaatcataaccctccaagctgcccttttaccctgggaacaaaagcacaaaatcctgactgtggtcctcaaagccctacatgacctagcctctaaccgcctctcaaatctcatctgtgaatccctccgtgctctcatagctccagcctccttggataagctaagcacattccaccctcaaggcctttgcacttgctgctccctctgcctggaataattttccgccagaagtttgcctggcttacttcttccctttgctcaggcctctgttccaaggttgcctcctcagagaagtcttccttgatcaccccaactgagaaagtactactgccactctctgtctccctacccaactttattgccttcataatagttttcatgactggacatcccattgcatatttacttgcttatctgtttattgtctgtgtctgccgtgaaaatgtaagcttagtgagggcagggatcctgtatgctttcttcaccactgtgtttccagtgctttaaatggtacctggcatgtggccaatgctcaatgaatatttcctgaatgaataaatgaataataatgtttagagaagtgggagtaacataatggtgtttgcgtgtattttgtttgtttgtttgtttttttgaaacagggtcttgctgtcacccaggctggagtgcagtggcgcaatcttggctaactgcagcctcgacctccagggctcaagcaatcctcccatctcagcctcccaaagtgctaggattacaggcttgagtcactgcgcccggctgcctgtatctttaaaaattctgagattttgattttctttggactattgatactgtatattattttatgctttaggttttcttgtaaccaaggtagctgaatttaacaaactatcaccattcccagaaataataaggcctgaactattcttatttactactacattactgataggatattgaatccttgtttgtatatttatttttatataatggttttaagatacaaatagcatcattaaagaaaatatatttgaaaataacatttttgaaaggaagaaaagtcactcccatcaccctaacatatccacatgcagacattgtatgcaattataattagggtgcacaagagttttttcctgtgacatattgtagatattttcaacactgtctcacatatttcatgttaacattaggcattaatttctaatgtctacagaatatttcattaatttgttatatcataatttacttaaccaattcccaattgttagacaatttggttttttcgagttttccccttttagatataatgcttcaatactgaagcatgggtatgcttttctggtgccccctaccctccaatattttagaagactgcctcatgataaatttctaacactggaatgactggttcataagatgtgtgtataattacaatactctagcatattggaaaacatattttctttccaaaagtattatatcaatggaacaatgtcacaacaaacttaatgatgtgggtggtactattaataattttgaggtttgctaggcataaaataacaaagccaatttaataggtctaaaaaacaataagactgtgttaaaagtacatttttaactgctattagtgtttttcccatatacttgttaataatttatatttctctctttaatggtctttcccttttaaactattaagggcctgaggattttctgttacatttgaatgaactctttcatgctatatgtaaatattttcctagtctattgttcttttaattttaatttttcatagtttaaaaaaattttaggctaggcacggtggctcatgcctgtaaccccagcactttgggaggccgaggcgggtggatcatgaggtcaagagatcgagactatcctggccaacatggtgaaacccggtttctactaaaaatacaaaaattagctgggtgtggtggcgtgtgcctgtatagtcctagctacttgggaggctgaggcagaggcagaagaatcgcttgaacacaggaggcagaggttgcggccagctgagatcgcgccattgcactccagcctgggtggcagagcaagactttgactcaaaaaataataataataaattttaatctctttctggctgaattcatcatttttttctttgttcactgtcctttcgacattgatgtatataaggtgatacattatgactgctcaatgataatagacaatgatcattgtcataataataaaaatcatgctgggtgcggtggctcacacctgtaatcccagcactttgtgaggccgaggtgagtggatcatgaggtcaggagttcaagaccagcctggccaacatagtgaaaccccgtctctactaaaaatacaaaaattagccgggcatggtggtgcgcgtctgtagtcccagctactcaggaggctgaggcaggagaattgcttgaacccgggaggcagaggctgcagtgagctgagatcgcgccactgcactccagcctgggcaatagagcaagactccatctcaaataataataataataatttcagagggcctcattatacttgcgaaacatggggtttatgaaaattctaggaaggggagtaatgaagtggatacctcttgagagtgtataggaaactatgagtatgtactggcaggagggaaagaggaagaagagagagggccagtttccttcctctgtcaaggcatgacagcatgtctcagagcacgatgtacacttaacacgtaggcagaaaatggctttcttaggcagtctttcaaatgaaatccccctggctggtggtattcatctgctttgccagtgatgctcataaaatgattccaaggcaccgcagagctctcgagtcactcccaactatcaaagagttatgctcggtttacatttcaatattagttacactgggctctgagctacttgcaggcatttgtaaccccaaggttctgaaacctgtaaggtgaagacgtaaatgtttgccagatgaccatttgaaaaaattattttaacaattttctaattcttttggcacttgtttggaaatgtatggagtggaaagaagtagggtgttcacattctcatccaagtccaggcaccaacgggttggctaatcttagataacttatttttctgggcctcgatttcctcatttgttaaaataatggagggcttcaggctagatgatctcagagatagtttttggtgaggattatttgactacagattgtaaattaactaaataaaatgtccagttaattgggttatcctatatttttaaaactatgtctgatcacaaagagagtagattataaaataaactatcaaccttttcatagcttcaaaggtattagtttaatttggatttactgtgagttctcatgattttcaatacaatgcagtttacagtataatataattcatattacatatataagtgcattgaaatcaatgttggacaattgaacaagaacgagaaaaaaaaaggctttctatcctctagagctgtgcttgctgtccactatggaagtgaaatgtggctagtctgaattaagatgtactgttaagtactaaatactcattggatttcgaaggtttgttatgaaaaaagaatatctcattaatgattttatactgattacatattaaaataaaaataactctaaaactatcctaaaagttagttttatctatttttttactttgtaaaatatggctacaaaaaaatttaaattacagacgtaggtcacactgtatttctgttagatgctgctgcttaacaggggtagaaggggtagaagattaactatttgcactatttaaatgaaaatatttttgctttttattccagcatacttaatctccaatgatgtttaaagtgttaaatttattcttttataggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctatatgccattttgtcttaatttcttgggtctggctggaaattcagccaaagggtaaagctcaacacaggagccaggcaattaattatgggatgatgaccaggaaggcggtgtcttttctgccccacggtagaccctttcaggtgtgcccattgcgcaaaagtccttctctgtgtcactaggctagactgagaagcagactcaggctagaagcagactcaggtcggcttccctcttccctccttccttccttctttcctatgctttctgcagtttccagtgcccctggctgcttagagtttccactgacgcctcctccgcagccttctctctctggcttgacatttggggttgatggatatggcaacccgacatgcaggatactcggggatattctgaacaaagaaaattaggtaaataatttaatgtggagctagtgtttaaaaaaatgggtttgtttttgtttttgttttgtaaaaatgaacagattaggaattacgtggtttgttagatcttgtgttctaatttttaggtcagcaaatctgattgcgatatgggaactccataccttgttctagaccttcctggccttcccttcctcttttttttaattttaattttaattttttaaatttttttgtttgtttgtttttgagacggagtctcgctctgtcgcctaggctggagtgcagtggtgcgatctcagctcactgcaaactccatctcccgggttcacgtcattctcccgccacagcctccctagtagctgggactacaggcgcccgccatgacgcccggctaatttttttttttttttttgtatttttagtagagacggggtttcaccgtgttagccaggatggtctcaatctcctgacctcgtgatccgcccgcctcggcctcccaaagtgctgggattacaggccaggccctcttgccttcctcttagaaacattcccccgggggcttacaaaattacctttccctggaagctgttgatagattgcataaagaagccggagctcgggccatatacattctcgccgggcactttagttaattaatgctttacctaggaggtgtgattctctctctttttttttttttttgagacagagtttcgctcttgttgcccaggctggagtgcaatggtgtgatcttggctcactgcaacctccgcctcccggattcaagcgattctcctgcttcagcctccagagtagctgggattacaggtgtcccctaccacgcccggctaatttttgtatttttagtagagacggggtttcaccatgttggtcaggctggtctcaaactcctgacctcaggtgatctgatcgcctcggcctcccaaagtgctaggatttcaggtgtgagacaacgcacctggccaggaagtgtgattcttaacggtggggattaggacacaggtgctgtcagtagggaagcgtttttggcagaggcagctttggtttacttaagaagtcacgtctgagaggcaaccatctatgccatctgaggcgcctgtcactcggagcagggtaagacttcacagtttcctttttccttctcttcctccaagtgcctcacccccaccccccccccaactgcttttagtgttcattctttttttatttttatttttgagacggagtcttgcttgctctgtcgcccaggctggagtgcagtggcgcgatctcggcttactgcaacttctgcctcctgggttcacgccattctcctgcctcagcctcctgagtagctgggactacaggtgcccaccaccactcccggctaattttttgtattttttttttttttttagtagagacggagtttcaccgtgttagccaggatggtctcaatctcctgacctcatgatccaccagcctcggccttccaaagtgctgggattacaagcatgagccaccgcgcccggctgtgttcattcatttttgtgtgttaatcagagctgagtggtgggaatgaacagtcactgatg

SEQ ID NO: 15549 - DNA, 11470 bp, Human
catggcagtcagtcagtgaactcactgtccaaacatccctgtatcccagcaataggccccacactgagctcccccatacagcctcctctctctgtccccagactccacccaaaattgctatacaagtgaaatcagactaaaaaaaaaaacattaaaagcagtcttgaaagggtgaaggagtcataaatgtgcagaggaggtgaaggctgtggcagggcaaggaacagccctttctgctgggtgaggcaggtgggaatgtttctcgtggaaagcaacagtccctttcctttacacagagctttccctcacatatcatcctcttcaccctcccaacagcccgggaaggtaaggatgaatccacattacagttaaggaaacagaggctcagagagtttaagaacttcctccaaaaccatacagctaggaaggatccaaactggcccttgaaccaggtcttccagctttgattccattgcccgggttgccaaacgcagttgcttttccatggatgattatgatctgcatatgttctagggtcagctggtgagaccacctgctcttcccccaccagctgccaaggtctctctaccctgccctgaagaacaatgtggaatgtggaggtgaggtgggaatcgatcagcctgatcctgggtgaaggtcctgggtgaggtcagctggctgtggagattagagcagatgcaggacagagtacagggcatttcgtgaaggacttatgagaacagcagcatgatggcagtgtttggttatggaaggcttcctggaggaggagtcaccctctgaggaagctcatcggctcttcttccttaagttcctaacacttgggtgtctggctaaccttcctgggggcagacccacatccccaaggtttgtactccataaacattaaaagaatagcacttgttatcctaataagtgtcccaaggacacacagggaagcagaaactagaaggatggggctcccagaacccccaggagccagaagtcatagccaccttagacaagaataaaccactatcccacttccagctttgtgcaatgcagtctctaaacactcctctagggatgacaattcaagggctggccaacagaaggaatacctcttgtagctggtggtctgggaagggagactcacatgacctgtttcttcttaaagagcaaagcaaaggtgcccacagcaaatttatagcccccaggttatcccaaggttgagttctccaatccttttgaccgaatggaagaaagtggctagagggagtctccccataatccgcaagtagccattattgtggccactgagagttctgtggtttgcacttttgctgggtgagaagtgaaagctctggaccagcgccttctgggctggaatccagaaggttccaagagatcatctgccccagccttttatcctggcacgggcatggtcaaaatgaccgctctggtcctgaaccaccttccaagcaatgctgcctagatggggtgggattcgcctgacctattggcccctgaaatgcaatgatttacttgagaatgtgtcctctgtggaaccagatagatgaatgcaatgatcccccaagtctcacctaacccaggaccctccaacctctcccttgagacaatggctcctgcctgtatcccaaacccagccacccccaggctgttgtggagttcaaatccgtctccaagtgtgggttgaggccatctcacagaaagactgtgagaaaattaattacttaatgtatgtaaacgagctttgaagatgaaaagttcaaatgcagtctccttaataacatcttcaagacttcagggagccccagagtcgctgctgagctcacctttaagatgagtccgtggggagttgctggcaaactccccaagcccataaacaacataaaatggctttccactccttttatgcagccaaccccagctctccccaccaataaaaggaccagggaggatcagagagagcagaaggatcctgagcctcgcactctgccgcccgcaccaccttccgctgcctctcagactctgctcagcctcacacgatgtcgtgccgctcctacaggatcagctcaggatgcggggtcaccaggaacttcagctcctgctcagctgtggcccccaaaactggcaaccgctgctgcatcagcgccgccccctaccgaggggtgtcctgctaccgagggctgacgggcttcggcagccgcagcctctgcaacctgggctcctgcgggccccggatagctgtaggtggcttccgagccggctcctgcggacgcagcttcggctaccgctccgggggcgtgtgcggacccagccccccatgcatcactaccgtgtcggtcaacgagagcctcctcacgcccctcaacctggagatcgaccccaacgcacagtgcgtgaagcaggaggagaaggagcagatcaagtccctcaacagcaggttcgcggccttcatcgacaaggtgggtgaggcctgagacggcccagagaagcctccagccctgtcctcccttggggaggtcccagtctgctgaggagacaggatggctgccggtttgaggcagcagagggaatgacgtgcagacccatacaggtggaagggtcagtttccatcacttaactcccgcagcatttaacgaggtccaggtgtggtctagaaattgagcctgtgatccaaagtgtgtgcatgtgtgtgtgtgtacatgtgtgtgtgtgtagcggtgtgtgcgcctgtacgtatgttagtgtgtggtgtgtatatgtgtgtgtgtacatgtgtgtgagcatatgtgtgtgtatgcatgtgagtgtgtacatgtgtgtgagcgtgtgtgtgtttcttgagccaagacgacataggactatcagaactgtgtctgaaaaaccagactgggcagcaggtgctggaagagtgggagataacggggagaccaaaagaccttgtggctcctagccaggcagcccgtgaaggggctggggtaatgcccacagccatgctgcctctcccaagtccttgctgcatcactcagcagtgtgagaccccaggcaggttactctgctgaataacaggactgcctcatccacctgtgaggaattaatgagtccatgcatgaaacatgatggcaaatagtcagcactcaatacatgttagctgctactatcattattttccaaggacagtggtaggtgaggaggtgtgacagccaacccaggcctggcagccccttcatgagagagggctgaaatgcagacagggaggtggccaggctggtaggaggaggccccctaatgcagccagagtgtggagaacgctgcatagctgtgaggctgcctcccaagaaagttttgtcgggggaggctgggagcctccttcacaggctcctcctgtgtccacaggcctctagcagagcagaaggagcagctttgggggcctaggatcagggtttgggggcagaggcagtcaccttcacgttttcactctttctttagtgatctgagtccatcctcacagtgacgggttggagtgggtatcagcgtctccacttatcagacagcaacttggagctaagggggtgtatacgagcatctcagacatgctgtagggggaggcagagcatgcctatctcaagactatcgcttaccatgagctgggcatttcacaccttgggggtctcaatttccccatgtgcaacatggggtaagtaatatctacatcccacagggctgtgataattgaatggaatgcatagttagatgatatagacatagacacagacattagacatggatgtgtatatcttaccacaggccttggcactaagtagtaaatatttaataagtgtttgttgcataaatgagcaagtgaagggcaactggtaattataataatagttaaatagactgagcatttactacgtgtcagggactgttctaagcacttgatatgcattaacttgttcaagcttcacaacagtgctaagacagacactattcgctccattttggaaaggagaaaactgagccccaggaggttaaacaacttgctctctaaagtatcaaaactggggctcgaaacagacctttggctttgagtcagactgctttccctcacacccacaactgcctccctgggggcctgggaatgggccccttgagccgcagacactcagctttatggctcagcccattcagccagcacccgagggcagagagactgtgggggaccaggtgcctccccccaggctccctctgacttcttctttccacctgaatggcaggtgcgcttcctggagcagcagaacaagctgctggagaccaagtggcagttctaccagaaccagcgctgctgcgagagcaacctggagccactgttcagtggctacatcgagactctgcggcgggaggccgagtgcgtggaggccgacagcgggaggctggcctcagagctcaaccatgtgcaggaggtgctggagggctacaagaagaagtgagtgcagcaagctggggggactcaggggaaactcagagagaatgctgggaggctctgcccatagccctcttgccacagcttctttcagattcctctagcaggctgcctggaacccagagcagatatccagtggggcctagatttcttcagattcctgggattcacctctaagactccacccctgtgagccttagagctacttctgggggaatgaagagaggaaatccagtggaattctagcactctctatgtccctgtccttcacagcttacctttatgacatgggctctgtgatctccctgccaatggaaccagctctcttgggacctaggatgcacagatgattttagacttgggggaaggaatgtgcattcctaaccccatctcagaggcagaaggactgcggcggaatgaagccaggctaggacaagggctggcccatgaataatacaaaaaatagatcctggaggggccaagacaacatctggaggggattaatcccttttcaatccccggaagaacttgcccaggagttgggatggtattcaaggtccagtttctcagctccagaccttctctctcccacacccaggtatgaagaggaggtggccctgagagccacagcagagaatgagtttgtcgttctaaagaaggtgaggggctggtcatggggcaaggaggagggggcccatcagtgcaaactccagcgaggggcagggtcaccatgctgaccaaaggcacctttctttggtctcctctcacatgcatgtcccctcctctttgtcccacggccaggacgtggactgtgcctacctgcggaaatcagacctggaggccaatgtggaggccctggtggaggagtctagcttcctgaggcgcctctatgaagaggtaagggggcaactgccacccagccagggcaggtggaggggtgttttggagacaggggagcagtgaggcaagggtgcatgtgtgtgcctatgtttgccaatgtgcaatgtaagtgtgaaaagagcttgcacatacgtgctggggcccacaatacagaggccatgtccacgttcatgtgtgagaggagcatggggtgtacatgttcttgggctgctctgtgtctgtgacctctctgcatgttggtgtgctgcctgtgtgagtgccagtctacagatgggcaagagagtgtgcatgtgtggtgggggtcaggatggcttcgcacatagggcatggtcctcattaatggactgactaatcactcatcctagcctccaaaccccagctcccctgctgggtgactttggaccagatctttttcaccctctgggcctcagttttcccacttttaaggcagacactgttcccagatggcctctacagcccctttcagctttgttgtttttaaggagcctgtgcatgagtgaaggtggtaggagcaggagtcatgtaaccttcatgaccagtgcccggtctgggaagtggacattgtcccctggggtggatcacgtggcccagatcaggcactagaagcaaatgcactggctgttggccccacaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaaggtgagtggcacaggacacctgcctgctaagcatggcagtgggagggaagttaggcatctattagaaaagatttctcttgcctggggattctgacccatgaggacagtatgagaaaagccagtagttctcaggttgaagtggcagggcaggactgccatgtgtggttgcacaggctgagcaccgtacaacctgtatagtcatctgtggtgtcctgaatggatggggggccccaccctgagcctcatgagcatctctacttcctccagtgtgaggagatgaaggccacggtgatcaggcatggggagaccctgcgccgcaccaaggaggagatcaacgagctgaaccgcatgatccagaggctgacggccgagattgagaatgccaagtgccaggtggggtctgtggaggattcaaatacgcagcacaggcaggctgcagcacctggccctaatcaggcttcacagtgtgcccatgaggaagcagggacccagagggaagggaggggctctatcatatttcacagcaatcagaccatgtcactgacttccaaaggaggatccagccccttccttggccaccctgtgaccgccatcaaggagagatgatgaaaagcccacccatctcctccctcatattcacagccccattaactacctggccacgggccaaccttctctccaggaccctcctctccctgccctggctccatcagcttgggtgagccaagctgtggcttctctttctcatcctggcccttgtatctccacctgatagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggtggggctaagaggactttgtggggtttcagaggtggaggctgtggtcctccaggagtgaatttccttgagctgagtgtgagctacaactctggccatggctaatacaatagcttcaataataataataataataactgaatgcttctgtgctagacctgtgctaagtgtttattttataatcctcacaatccaataagatagatatggtttttcccatctttttatctttagataaagaagcaggctcagaattcagtgcctttatcatggctacgcagttaataagcagaagagctgggacctgcacccaagtctcatgcctcccaaatccgtccttgttgaatagcttcctactgaagctgctgccacacaggcctgtgtgttatgatgatgatgcacttctatatgcatttagctcttcatcaaccacaaagccccttcacaccctggtgtatctgattcaactctccttcctgtgagcttgattggcaccatccaggctggccaccatcactcaaactaggggcactgttcataatcttacccactgctgctgaaaatcagaaagccttgtcttcatggttaaaaccatcaaagaaagaaagcatttaatgcagatttgagggagcccttcttgcctttcaggggtagactctgtacacaggatgaccctctctgtccccaagcaaccatcagtctcaaggaatccaactcagtgtctggaactaacagagttttctttctccataggctgtgtgaaggtgtgggctctgtgaatgtctgtgagtatctgcctgaaattctcctggaaaaatggcttttttgatagaaaagctgaactcattggcctaacccatggagcctcgagtgttcccccaactgtttcaccctcccctggctcctcagtgggggccatgacaggtgttagagaaagctgagctgagtgctcttcgcaagtgttgacagtgagctataggccatggacctgtggcctggcagctttgctccccggggtccaggggtcctcacttccttcctgccccagttccctagatgggctgtgcatctcagggacagggcctgcattgttgaccaccaattccttggagagggaggcagctcctgcagtgccctggggcctgttgtagggtgggtgagattgcagggagctgctcacccctccatgtctcctctctccacaggtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctcagggacaagaccagtcccccagcgtggtggtcagcacggaagctccaccttctgggtggaggcgccatcctaaccatccagccaggccacccacaacccgagaatcagggagaaagtccctccccagcagccccctcctcctggctgggaagaatggtcccccagcaagcacttgcctgttcattcccgttcatgttttgcttctctctcagactgccttcctgcttctgggctaacctgttccagccaggctcctcatgtgacctcgcagttgagaagcccattatcgtggggcatccttttgcctacagcccctggttagggcactttggacaggtcttgctattcagtgaacctttgtacatttcaaagaagactccatggctgctccagatgcccccttgctgggtgcaggtggggactgtccaatgcagagctggcgggacagagagttaagccacttcctgggtctccttcttgtgactgtctatgggtgcattgccttctgggttgtctcgatctgtgtttcaataaatgccgctgcaatgcaagagcgtgtggtcttgtgagcaacttctccactcccttcttgcctcatctccagatgaccaatcccagtccagccccatgcagtgtttccccagtcaccccccagaaactctgctgcttcctgtccacttccacagtctgattccactcagtcgccctcagtcccctcaggcctggactacagcccagctccccactaatgacctctttctccctgacccaccctgcgtactcccagcagccaaaactccatcccaaactcactgctctcaccctctcctgcctggctcaagtcacttcctggcacatgtgtgtgcttcttatgccaaatgcaggcttcctctgtcacctccttccccagctactcctcagccctgtccaacccctccatgcggtgctcatcctcccagtcatggactccaccccaaggagacaagtctaccctctgaggcagcccagagacactctctcctacataccccttgtggacacataggccatcccacatccctcctcccatttgcctttgctcagggccctcctctgctccccaaagctaccaccctcacccctacaccccccagccctcccccgcccccatcatatagtgtctggaaccctgagaatctctggttttgtctctgcggatctgggccagggatgtcaacgggtgtgtctggatcaagctggaaattccataaggacaggaagtatctcctcctggctctgacctcccactgagtcccaggatggggctccaagatatgccaggcctgggatgtgctggatgaatgcaggcagctggtgcagcaggaggtagagacatccagtcctcttgccctcagctccatctccccattagctgtcaccgtcatcaagcaggtgtctgccagccccctgctgccccatcctgcagcctctttctctgagaggagaagatagggccttgtgcatcctcactttaggcccaaagggctgtagccccactggaggctgctggctgcttctgagtgcttaggctgctgctctgtttgaggtttgctggctgacacctggcgggcctcctccaggtctcttgcctgctgcctcctttttcccagctgtttgggccctgagggcatggtgacaatcacaataggccaactttcaatttaggggacatcattcacccacaggaaacgttaaatcccaggggctgaaacatcaggaaatggaaatttgagccccaattctgccaagactgccaggtctcggtgagtccttgggcaggaagtggctttcatgctttgcatgtcagtctggggtctatgagatgagtgggtagagtccttaccaggtctgctgcctcctatggttctgagatgctacagagagtctatgcttggggaaaacagcttcatgttaccatggatctgggctgagcaaaacaaaaatgccaaatctgatacccaaaaaataacggcaccatggattgaaaagtcaaacagccagaacctgggagataggaatgaattttttaatacatttccgtgctttgtgtgcaaataccattcaacagattcagctggccagaggtgccttttgcttatggggaggtaagcctctgccccagccctccttgcagccaacagcaaaaacccaccacagcaagctcttctggctcaaaggatgctggggctcctgcagctctctcctgatcaaagaactattcccctcggaatgcaaagggtacagtccaagggtaactaaggattaacattttattagaaagaaaaaattctgaagaagtcaagtgacctgaaattgagagatcgaggaaaagccagaagttcaagaggcccaaacaataaagtgggccatgggagtgatcccagatctctgccctgggctccttcctgcttagaaacatcacaaaccaagctaacaccagcatcagagaaaatcagacctgctgtctgtattcaattcttatgtaaatgttagtgatatccttccccacaaacaca

SEQ ID NO: 15550 - DNA, 37940 bp, Human
  misc_feature (1)...(37940): n = A,T,C or G
actcaagattaggcaaggaatgtgaaacaaaaaatgccaactatgtgccaggcagtatgctagatcctagggatactgcagtgagcaaggtaaatatggttccttggcctcagaactatagtccatacagagtgagataacccttaattatcagtgctcagaagtggagtcctatagggagtctcccaacctttttggcaccagggaccggtttcagggaagacaatctttccacaggagttggacagctggtttcagtatgattcaagctcattacatttcccattagattctcttaaggagtgagcaacctagatccttcacattcccagttcacaatagggtttgagctgtgagaagctaatatcacagctgatctgacaggagctcaggcggtactgctcactggcccaccgatcacctactgctgtgccgcccggttcctaacaggctgcagaccagtacaagggttggggacccctgttctaagaggatgcaaccagaaggctgcccagtctgcaagatcaaatgtttcctcaaagtaactttcaacgtataaccagaaagactgaaagacaaaaagtagttagcaaggccgggcacggtggcttacgcctgtaatccctgtactttgggaggctgagagagggcggatcacttgaggtcaggagtttgagaccagcttggccaacacagtgaaaccccatctctactaaaaattcaaaaattaaccgggcgtggtggctcatgctacttgggaggctgaggcaaaagaatcgctttaacccaggaggtggagattgcagtgaggttcatcctgggtcacagagctagactacgtctcaaaaaaaaaaaaaaaaaaaaaaaaaaaaagctaggttcctgagggacacaggaagtagtagaagttgtaaaggtcatgacgagatatgagtctgaagagcaggccattcaatgaaatacaacattcacatcaagtgaatcactcacatcgtcttggtgtggtggctcatgcctgtaatcccagcacttggggaggctgtggtgggaggattgcttgagcccaggagttccagaccagcttgggcaacacggcaagatccccgtctcaaaaaaaaaaaaaaatcactcacatcaagtgtacccaacagatatccattcccttcgtacatctgaacacatcttgatattaacggtcgcaagcaaaccctaatattttatatctctagaacaaatatagtatccccatttcacaatcgggaaaacagactcccagaagctaagtaacttgtttattgtcagacatctagtgagtcgcagagccagggaactgaccacgggcattttcaccccattacccttccagcttattgccgactgctcccgaagggagcgaaaaggacaggcaaagggtttcaccaaaccctttgtaatgggagattcttgccttcttacctttcctcacgtttgcttctctgccagaatgtcttcccgcactttccccagaacccaagttctcctaatcatctttcaagatccctttccctcaaccacagatgagccgtgcctatttctccttcaaatgactccctatggcttctagttggtagtcttttatttaccacctcatagtccttttatttatatcccataaatgatcgtccggccccgcaccgtgggaccaggacgctgcctcgaccatggcggtctcctggaaacaggctgctttgagccgaaactggtgaccgtttcccaaccccgtccaggagtccgacgcctcttttctccaggccaacttcaagtgaggtgtatcaactctatccgcacaaaatttcttgccacgagagcagaagattatgatctctgatgctgccttagggctgaagacactcccaactcggcgacgcttagcaatcatcgacttcctcctcctcttggctgcctcggagatcctgttccggggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagagtaagtgtcggggtgggcactggggcgggcccaggccggctggaggatgcggcctgtttccggcgcgcgagaccacctcgcgcgggaggcacgggaaggggagacccccgaaacccccccgtctattgtccgcccggctcgggccctagcgcccggaagacgcaggtctcactcctcggcttcaccaggccagcctggggtccctggttgcttacagccacgtgtacttctctttttaccctccgcgggaagcgagggaaggttttaaagagaccgcagctcccggagtccatttcaaactgttttcttatttgactcctttgctgctttatttcacaaatattccaaagtgcctccttttcttcttcgtcttgagcgcagtgatcaggactctattgctgagggagcttgttctctttggccgctaaagggggaggaacctgcttgggacacgtagtttagaggctggtgctaaccaggtggaagctgtacgggttctacggggcgagaggaaagggctggatctggatgtcaggcctgtcattcccatagatgagatctcttcagtgttattaagttaggaaatatgtgtgtggaagcaccaacacttgaaataatgtcggaagaaaagtttggcctgtttttttgccctgtaagggatgatttcggtttttaccgcctttggtgtgaggtttaattcatcatattcttttgttccttactacatacctggaatatggccatgctgcttaatgttctcggtggtgcgcagttcttctctactgaagatacagcctgtgcatgttagatttggaaatgtaattaccaaggcagggcttagctgttcagagtagcagtaacctaaaaggtgtgtcagtaacatgcaaagctatctaagtaattttcaacactctagtactgggttaacgtgaaaagtagtgattgtgcccacagtgcacttttggtgatttcagacattgaggaaaatagctacgaattagaattatttgatccctaaatttgtttgaattaactctagccttccaaccagtactgtatacttagtatagtattttgcaggaattctttaatcagcaaagattgtcaacttgtttaccagtatgttttcttaattggtagaaattcttgtgattctttgagaattggacttctgtagttgcacaggagcaagagtaactatgatcctggtcattttaacaccgaacagttgttagcgttgaaacttgccacctgagttcttccttatactttggtcatcttagttgaaaaggggaaattttaatgatttttggaaacgttgccagcaagataaattgcctttgtattatactttataagatttttccaaaatattcatttcatattgtcagtaaccttattaaataggtaatgcttttctaatcattttgtagctaagaaaactgagatttggctgttaagtgatatgcccaatacctcaaagcatttagtggcaagcttgcaccaaacctaggtcatttgcttccaaattctacctgaactttttccctgtgaagtaatgaactatgtagaatgtagcatgcatttcaagatgaaatatctggagaaattgcttctttcttctttatttcactgcacttttttggtacatgtatattgggaatctttatctcattgaaaatttaatctataactctccttattgtcacttcttaagttaaaagcaaagattagttgttttctgggtttgttttgttttgttgctgtttcttccagttgttctgaccaattatttctgttgcaataaaagtagaaatttagctttcggagagacagggtgggaaaatttagtaaaaatgtgaaaaggaaatggatttaaaaatgacttttcctaaaattgttctctagtactacagatcaacaaagatgacgtaactgccctgcattgtaaagtggtatgccttatccagaatggaagtttcaaggaagctttgaatgtcatcaatactcacaccaaagtgttagccaagtaagtgattcagttagttgcttgtacagttattagaaacacttactatagctataatctcttccatgttttttcccaactatttgctgattttttttaacgtttttttccttcctttttttccccccttttgcttgtcaataatgtttctgaactggaaggaatactagtaacttctgtttttttcagccttagagagtttttttttttttttttaaccactgtgtttcctttgaaccgctaaggaggtgaaccatagagagttgtggggcataattatgagtcgttggaggatgtagcaagaataactcagtcgaagtttctttactgttatacctaggctccaaaaaaatatgtattgaaattaagtttgaagcatattaatgggatactggtttataaggtgcagaacaatatatattatacttccttttacaagaggaggaggatataaaaatttatatatgcatttgcctgtatttgcaaaacaaacagtataaagagaaacaatgaatagtcatttgtgggaggcctaagagggcggatcacgaggtcaggggtttgagaccagaccgagcaatatggtgaaaccccatgtctactgaagatacaaaaaattagctgggtatggtggtgtgcacctgtattcccagttacttgggaggctgaggcaggagaatcacttgaacccaggaggcagaggctgcagtgagctgagatcgtgccattgcactccagcctgggtgacggggagactccgtctcaaaaaaaaaaaaaagtcatttgtaggaggtaataggaacaggttagatttgggtagcagtgggaataaagcctcttagtgtatctctttttctttttatatttgaggcgtataaatgtgttagagattaaaaattaattgtaaactttattaaaaataaaagggaaatagaggcaatgctgcttttctcctattaaatatgtttgctaaaattcagtctcttgattttgggctattttgtgagaaaagagacattttcaaaaacattttgtcaatgagtcttggataaaagttttttttttttttttttgggaggagtcttgctctgtcgcccaggctggtggaacctccaccttccgggttcacgcgattctcctgcctcagcctcccaagtagctgtgattacagatgtgcaccaccacgcccagctaatttttgtaattttagtagagacagggttttgccgtgttggccaggctggtcttgaactcctcacctcaagtgatctgcccaccttggcttcccaaagtgctgggattacaggcatgagccaccacacctggctcaaaaataaattttttgttaggtaagtaaataaaggacattagcctttgctttgataaatatttttcctcatggattatggttgaaacatcaacaatgaggtatcacattaatgtagatgaatttttaagtgtgtgtatgttagtagtgtttaccagttgtttgattacaggtacttcttttaagatttctagttactgtttctttgctaatcatttgtttcttaaacaagtttaaagaaatatggcttattgttttgttaatgaatttaagaaacttctaaaacaacccatttaacatccttcagattatctttgtatctaagacaattacttatttagcagatgaatgatttccttcttaaatgtttatttcaaaaggccaataattttaataacaatatccatgaaagagaggctagggaagttgatatatgcttaattatatgtttgattgatatacatttacaagctatctgatatttagacaagtctctaacctttgtcagttttctcatctgttatcaggactaaatccagtgtttagagtggtgttgtatataatgggtgcattgcattgttagataataatcagatactgtttttttttccttcttcagtaactctctctcctttgaaaaggcatattgcgagtacaggctgaacagaattgagaatgccttgaagacaatagaaagtgccaaccagcagacagacaaactgaaggagctttatggacaagtggtaattactgcttttaaatacatgttgacagtgatactgagtgagcatgactacctctagcaaggagcagggttgaggaaacccagcccatcctgatgctccacaaaactgaccaccaaaccagtccttaaggtttgaacataattcctcttcttgatcttcatacaaacagttgcatatataatgtgctatgaacaaatgacttcctcaggtaatcagaaaatcaaagaaaatgaactaatctgtttaattttgacttttgagttagaaagatgaagcacattgagcttgtatattaaacagatttgaaatactatttcactaatattttactctaaggatgtcatgatagataagaatttagatgattctagcccatgaaattgtgaaaatattttaaagtattttgagacataaaattaaccctaatgtaaaatagggctgttaatgacaagaggacagaaatgtgtatcttacagctagcaaaaccctcttaaagtttttctttttttttttttttttttaatggagtctctctgtttcccaggctggagtgcagtggcactatctcggctcactgcagcctctgactcccaggttcaagcgattctcctgcctcagccttccaagtagctgtgattacaggcatgtgccaactcgtgcagctaatttttatattttttagtagagatggggttatgccatgttgcctaggctcgtctcaaactcccagcatcaagtgatttgcctgccttgacctcccaaagtactgggattacaggtgtaagccaccatgcctggcctcctcttaaagacttttaaatgtcaatttagggcaaataatgttgtattgaatgtattgtcctcaggaggtagtatggatttaataatacaaatgagttgaagatagatttggacaaattcatggattgtaggtctataaaaaacttttaaggtaaactggataactttagggtaaattctagcattttgaggttaaggacatcagcctgtgtcatacataatggactaattgacctagagtggcagttgttgttctttgagcacaacttgaatgaaatcagtaggaattctattgtgtctgcttgagactcacctgtgtgatagctggtttctgagaaagataaaatgaagattatagcgaactcctaggaaacattaagtctttttcttaacatttaattttgttcctattttagtaatcattttgtgttgtggaaaaatattttcattgtaattttagatctaggtaacagggttacctagacctatagaaaggtgttctttcacaacctatttaggcactttactaatttcaagaagaaaggtaaagaaaatcacttttcgcacttggggaggccaaggcgggcggatcatgaggtcaggagatcgagaccatcctggctaacatgatgaaaccccatctctactaaaaaatacaaaaaattagccaggtgtggtggcgggcgcctggtcccagctactcgggaggctgaggcgggagaatggcatgaacctgggaggcggagcttgcagtgagccgagatcgcgccactgcactccagcctgggtgacagagcgagactccatctcaaaaaaaaaaaaagaaaatcagttttctgggtcgggtgcggtggctcacgcctgtaatcccagcactttgggaggctgaggtgggcggatcacttgaggttgggagtttgagactagcctgaccatggagaaaccccatctctactaaaaatacaaaattagccaggcatggtggcgcacgtctgtaatctcagctactcgggaggctgaggcaggagaatctcttgaaccagggaggtggaggttgcagtgagccaagatcgcgccattgctctccagtctaggcaacaagagcgaaactccgtctcaaaaaaaaaagaaaaagaaaagaaagaaaatgacttttctcaactgaatcctgcctacagaaccacaatatagtgaaaattcattttaaaagtattttcaaaaagtaatttatttgaaagtatgactagtacatggaactatttaaaaattataaaacataaacagttgattgttcatgttatgctgaactaggattcctacttagtggttccaaaaaaggtttgcatgatattaaagacataacaccatatttgtctctgattttttacttgctatttattattcagttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagtgagtatccttgtggtgtacccatacagtcatgaattattattcatatttagtatttaactggtattttgtcccctgacaggagaacctgggcctccaagaaggcacacatgagctgtgctacaacactgcatgtgcactgataggccaaggccagctgaaccaggccatgaaaatcctacaaaaagctgaaggttggaagtttgttaaacttatctgtaaatataatgtgcatataactttgtagagtatcttctaaaattgcatttgacttctgtgaaattattaaatggaagttattgatgcagtgacaatttctccaagttcctgtcgtctttctctctcttttttttttttatggagtgggacagaatcttaccctgttgcccaggctggagtacaatggcacgatctcggctcactgcaacctctgtctcccgagttcaagcaattctcctgcctcagcctcccgagtagctgggattataggtgcgcgtcaccacacccagctaatttttgtatgtttagtagaaatggggtttcaccatattggccaggctcatttcaccctccgcctcccaggttcaagcaattcttgtgcctcagcctcccaagtagctgggatcacaggcgcatgccagaaatgcccaactaatttttgtattttcagtagagatggttttcgccatgttggccaggctagtctcaaattcctgtcgtcaagtgatctgcctgccttggcctcctaaagtgctgggattacagccgtgagccactgtgcccagctgaagcttttaattaagaaaaaaattaatttattagagaactgtgtcaggtattaacgtgaacattttgactttgcttgtgcataaatttttccctggaagctataaaagtgatgtaggtactgcagtgatcactggggtggaaaaaaaggtgaaacaaagtctgttttactgttaaatattaggggttaaaatgagatcacagtttactgtcaaatgttgaaagttaaaataagaacaaaggttagagcctcatgagaagaaaaatctgtttaagaattataatttttttggctgagtgcagtggctcacgcctataatcccagcacttttgggaggccaaggcaggaggattgcttgagcctagcagttcaagaccagcctgggtaatatagtaagccttcgtttttacaaaaaaaaaatatatatgtggccgagtgtggtggtacacacctgtattcccagctactctggtggctgaggcagcagggcctaggagggcctaggaggttgaggctccagtgagctgaaatcataccactgtattccagcctgggtgacagagtgagacgctgtctcaaaaaaaaaaaaaaaaaagaattataatttcctgacctcaagtgacccacccaccttgaccacccgaagtgctgggattacaagtgtgagccactgcacctggcagaattataatttcttgatcatacccaatgaagaacattctcatacattgtgggtttgaatgtaagagtaatacagacttttcagtgagcagtttggtgatgtgtagcagattttaaatttacctaccctttgatccaataatttcacttctagaaacttgaggaaatgattagataaatttacgtatgtgtctgtgtgaatgttcattgaaggaatattcataagaacagaaatttagaaacagcataaagttctgtactattaaaggattggctaaattttaccataatcacaaagtaattacagtcactacaaccaataacattaaaaaagatacagtaatgtagatctatgtttattgtaacaaagatatccacaggatattgaatggggaagggaggtttcaaaatagtatgcaccgtgtctcactttcattttaaaatgcagctgtgcatttacataaaactaagccaggtatggtggctcacagctatagtcccagctacttgggaggcggaggtgggagggtcacttgagcccagaatttcaaggctgcagtgagctatgattaagccactgcactccagcctgggcaacagagtgagacctccaactttaaaaacaaacaaaaaaaatattaaaaaactaaataactgaaatgctagtagtgtttatctctgggtggtaggattgtttatttttatacttttctataattgatttttcgcaattaatatttactacatttgtattttttaatgcactttacaaatatttttagcacagacacaacaaatgaaagcaaagtgccaaagagctgggaaagtcaagagactgataatatatatgtagtatatttgatgctaatgtaaatttcacaactgcttgttactacgattatcttggaatcttctgcttaggaatttagatcttgctctttggaatagtgaaagaaatgggatttacccagcaatactacttttaaaacaatttttctcctgtagatctttgccgccgttcattatcagaagacactgtaagtattccatcattgttaaacctaaattttacacttctgactatgatagattactgaggcttcattgtactatttattgactttttttagaagatggcaattcattaagtaggaatcacactagaaaccaccctctagtatcagttatttgatgaagtctactagagtgagaaatcacaatacaaaaaattttgacataaccttaagcacttgattatacatttatataatgtaaatttattcccccattttaggatgtaggactaaggtctttgaggactggtctgctcctaggagttccatgtatatttcttatgtagtgacataattcaacattcccaatttacacttttggtttttctttttaagtgtaacaatatcttaaatacagttggtaagcacttccattatagagtccttatgttttttttttgttgtttgttttttaccaatctcttaccattttttggctcacaactaattagacaataattttctttaggaatttacgtttaccgtatctttctgagtattcaacatgatttacattgaaatatgtctcttttcacattcatagttctctctctctctctctctttttttttttttttttttttgagacaggatcttgctgtttcacccaggctggattgctgtgatatgatcataggtcactgtaacctcaaactcctgggctcaagcaatcctctcaccacagcctcctgagtagcaccaccatgcccagctaattattttcttctttgtagagatgggggtctcgctgtgttgacaagtttggcttatctcaaactccaggcctcaagcgaccctcccacctcagcctcctaaagcactgagattacaggcgtgaaccaccatgcccagcccatagttcttctctttaatatttttaagttttatcatttcctcatcaaacacaactgcataatgggtttggaaacaaacatatctgactcctggtcagcagatactcaccaggtgagagcaggagtgttgggtcattaaaggactgttgtctcctagtcttgagtattcattgtacagccttttcagaaggaaaggagaaatgtggattaatctggagcatcggttaagagagctactactttaattacagaatttgttcaattacaggattaaagtacagaattagttccagcttttgaagtttttttgtatggtgttaattggaattttctagtttttgaggtagagttatggtagaatagagagaaaagcatttttaaatgtgatttttatgagaaaattatgtttccagaatttagggatatcattataaaaagatatacttccatgcttgttttttacttacgttttttaattcttgggctttagaggatgataatgatcaataaatggtagtcctaaacttgttaccatgttcttctaggatctttttgccttttcttttttttttttttttctttagatacttcttagaagttgaagtctttttgctgttttcacttaaacttctctcttgctggctgtttctaaagaactgactctaagggaaaatttctgaaattatgtgtcttcaggattgtatctcttttgaatgtttgggtcatttggaaaatatgtagatcagtttggaaaatttatatgggaaaaacatttctttctcttaggatgggactgaggaagacccacaggcagaactggccatcattcatggtcagatggcttatattctgcagcttcagggtcgaacagaggaggctttgcaactttacaatcaaataataaaactaaagtgagttattaaaaggaagtgtcttttataggggatggggttctttttaaaggtttgtttggttttgactgttgcttgttgttcacagaccaacagatgtgggattactagctgtaattgcaaataacatcattaccattaacaaggtatggagtatttgtgctttccatagatatattttaccctgaaagctcatcaccctagttttagttttgttctaggatagcctaagtgttctttttaacatgatgaaaaaagtccagttgtagcaaaatcacaatggatagtattacttaactctcctaatgataatgatgctgcaaggtatactcaagtaataaaaccttttgtagtagaccctagactttaagatcctccccttttcccagcatctaatagtatagagactctctctttgtaagagatataaattattggggcttttaaacttttaagtatacgcatgttttatatgatttcttcgtctatggaatctgaatgtgaaagtgttctttatataattttctctcgggttttctttttttagggggtatggacaggtgctctttcttctcccccacaccccatcccatgtaaaatactataaatatatatataagcactcttaacttagagtactgtactaatgtcattagccaccattaggaacactcttttttgttttgttttttttgagaccgagtctcgctctgtcgcccggactggagtgcagtgacacgatctcggctcactgcaacctccgcctcccgcgttcacgccattctcctgcctcagcctcccaagtagctgggactacaggcacccgccaccatgcctgtctaatttttcgtatttttagtagagacggggtttcaccatgttagccaggatgttctcattctcccgacctcgtgatccgcccacctcagcctcccaaagtgctgggattacaggcgtgagccaccgtgcccggccaggaacactctaatggaaaaagctttatttttctttctttctttttttttttttttttgagactgtcacccaggctggagggcagtggtgcagacatgactcactatagccccagacagtcctcccaagtagctgggaccacaggtacacaccaccatgcccggctaatttaaaaaaaaatttgtagagacagagtcttgccatgttgcccaggctggtctttaaactcctgggctcaacaaatcctcctgcctcagcctcccaaattgctgggattccaggggtgagcgaccacacccagcctggaaaaacatttcaaggtcacaattgaaatccaagtcagtggaaagtaagaaaagtaacatttgaacatacaatttatcttgatataccatgtgatttttcaagtaccaccttatttcttcctctcaataatctttttaggtggtagtccttatctctgtaggagtataatctgagactaaaagtagttaagtaatttgtataaggtcatagcctacttcataagaggaaaaacttggattcagattctagtttctgacttcaaagctttccccttctactacttagtggttcttctctcctgtggcagaaatgtagtgtatctttggatgtagataatggcattaaaaggggtagtaatcatgggaggttgctgttggccattggtatggtatagatttccaaacattgatactagcctttgaatcttggcaaaaatatatacctgcctatgtttatgaattttgaaatgcttgtcaggacaaatttttttttcccccaagatggagtctctgttgcccaggctggagtgcagtggcacaatctcggcttactgcagcctccacctcccgggttcaagtgattctcatgcctcagccacccgagtagctgggactacagtcacgtgccaccacacccggctaatttttgtatttttagtagagatggggtttcaccatgttgggcaggctggtctcaaactcctgatctcaagtgatcctcctgcctcagcctcccaaagtgttgggattataggcatgagccaccacacccagccaggacaaattctttttatctgacatacataattgtaggggaagagagcatgtgagatactaaatatctcagtctgaacataacttatacactgaactttctttagtcagtgggtatttctgactttttcaaaatagtactggatgcaataggtaatgaaaaatacaaagcatcatcacatagtttaaaatctctttctggtgttgaaaaaaattgttcatgtttaaattttttgtccgtatactttataactatatatttaatactacatttggtgaacggaaggatctctggtttggcaagtttgagctgacccttgaaggaggactgtggtttgaaggttaagcaacagcacaaaaaaaagtacatatgaagaaatatttatgatttgtaggggaaaagtgagaacacagaagagggtatgtatttgctggatagtttaaaaagtagattagattgaactatatcagggccttggaaatcaagtttaagaaaagtctggcagtgacgtgcacaattaattgaagtattaaaattgcgacatgagagaaccagctagaaaatacggtttctttaggattgatttatatgaaaggcagtttcttgctgtacattaaagtagtttcaaattggtttggagctcgacagtaagaaaaagtagaatttattttagatttttttcgcttcctttttgtctttaaactggtagaagacctggtttaaaaaagcacagtggtatcatgtatttgcaagtaaatacattgttttacaaagctagagtattgtgcacaaagtagatactcacatgctcagtttgtgcttctcaggatgcaatcagtgtgacttagttttctccctttttttggagatgtatgtgactttcaataattcttaataggactttctttgggcagataacactgtgcccccacatgggaattttagaaattgagcttctttatgcttttgcttggctaagaagaaggggctttaggaaaggaaaaacagtagatatgttacatgagtattttctgctaaaaaaaaaatgggttcaaaagtggtacagatatgtttctgaggtttcatgattgccttacagagtcactacaggcatacctcattttattgtgctttactttattacactttgtaagtttttcacatattgaaggtttgtggcaactctgtgttgagcatatctgttggctcctttttttttttttttttttttaagatggagtctcgctctcttgcccaggctggagtgcagtggtgggatctcagctcactgcaacctcccaggttcaagcagtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgaatcacgaggtcagaagatcgagaccatcctggctaacacggtgaaaccccatctctactaaaaatacaaaaaaaaaaaaattagccaggcatggtggcgggcacctgtagtcccagctactcgggagactgaggcaggagaatggcgtgaacccgtgaggcggagctggtagtgagctgagactgtgccactgctctccagcctgggtgacagagcgagactccatctcaaaaaaaaaaaaggtatgtacttgttttcagacataatgctgttgcacacttaatagacaacaatatagtgtaaacatagcttttatatgcactgggaaaccaaaaaatctgtgactccttctattgtaatatttgctttattgcggtagtctggaaccaaacacgaaatatctccaagatatttctgtattttgaagaggagtgagttactttttatttatcatctaaattctagagggcatagcttgtagaaattgccaagttaggtatttttgtagtcctaatacacttcaatttgtgctgtccctttttttccttcaaaaagctcaaaacaagcaattaatagtggaaaaataaaacaaatcttgttctccatttctttaaagcagttcacttgttaagcctttttatacctaggaagcctcctttgagaaggctttaaaaggagtgggggtagattctgggataactatatgtacatgagtagatttgaattgcagagattcaaaaagagtagatttgaattacttctgtgaatcaggataaatttatatgcatcttattagcttaggcaccccaatcaggtagatagattcaagctctcctgctgtatctatataaagttaatagaaaaaggaataagttgaaatctgagattctgttaatgatagataaacttttctttgttaggaccaaaatgtctttgactccaagaagaaagtgaaattaaccaatgcggaaggagtagagtttaagctttccaagaaacaactacaagctatagaatttaacaaagctttacttgctatgtacacaaaccaggtgggtaattacctttggtgtcatggctaaaccttttgtaatatggtatatgaggagtaatagggatattagtctaatctttttatagtttttgtttgtattttgtcttcaactcataaatatatttttttgccttcctcaaaatattatatatattattggctgggcacaatggctcatgcctgtaatcctagcactttgggaggttgaagtgggcggaatgcctgagttcaagagttcgagaccagcctgagcaacatggtgaaaccctgtctctacatggtggtgtatgcctgtagtcccagctactctggagactgaggcacaagaattgtttgcagtgagctgagattgtgccacttcactccagcctgggcaacagagagagactgtctccaaaaagaaaaaaaaaaaagaaagaatattatgtgtcatagattttatttattaaacaagtaatttgcccaatttcttataagggtgtagggttgacaccttttaaggggaagaaaacagtattcacacctttaaatgagataactttctcattaccttatttctaatctgaattaagataaaatcatcaaagatgctagccatgattatagatttaagacccatctttcatttttgctgtgtataatcacatcaagttataaatgttaaggaagtcaattctaactccagtaagcattctaattctaattttatactgttttagagcagaagttttagtgggagacagagaagcagtaatttttttttttttttttttttttttgagatggagtctcgctctgtcgcccaggctggagtgcagtggtgccatctcggctcgctgcaacctctgcctcctgggttcacgctattctcctgcctcaccctcccgagtagctgggactacaggcgcccagcaccacgcctggctaatttacttgtatttttagtagagacggggtttcaccatgttagccaggatggtcttgatctcctgacctcgtgatctgcccacctcagcctctcaaagtcctgggattacaggcatgagccaccacgcccggccgagagacagtaatgtttttattatttagaactgagtcaagttattcttaataatgtagcaaaaaatacatatatgcattttgttgtttttgaagcaaatgcttatatttgatgtgtttgatttttttaaacagttctagaatttaggcatccaagtgaatgtttagaatttctcctttactaaagactcttagagctcatagattaaattcaataaatggaaaccattttcttacaagaaaaaattgagaatagatactgtaaactgattctcttaccctaggcagttctttggttaatatttgtttcaactgattttcccatgtttcttttctttctggtcatttagtgtttaatttcattaaccagtttatttttcttgtgggggttggatatcttctaggctgaacaatgccgcaaaatatctgccagtttacagtcccaaagtcccgagcatctcttacctgtgttaatccaagctgcccagctctgccgtgaaaagcagcacacaaaagcaatagagctgcttcaggtaaaataattacttgaatgaggtgtcagacatttgcagctttgtttcattttcattgtgttgtaataacctactagcatgtaaatttaatgggaaaactaatcagaaatgtaccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaattatggagatactgactttgtttttatcaacccaaaccagctattatattgcatatttaaatttcttgaatataaactacattggaaagttggacaggtacaattaggatcatcctgacagacaaaattgcctaacagggacactcagtgaagagacaccgccccttctctccccacagcaaaaaaaaaaaaaaaaaaaaatctatttagtaatctttattatagttgaccctttgtattcttgagttttgcatccaagaattcaaccagccatggattaaaaacattttgtgggggtcgccaggcgtagtggctgacgtctgtaatcccagcactttgggaggcccaatcaggcagatcatctgaggtcaggagttcaagaccagcctggccaacatgttgaaaccccatctctactaaaaatacaaaaaattagcctggcatggtggcgcattcctgtaattccaactacgtgggaggctgaggcaggagaatcacttgaacctggcaggcggagttgcagtgagccgagatcacgccactgcactccagcctgggtgacagagcaagactccgcctcagaaaaaaaaagcacattttgaggttggaaatgtatgactgcctctgtactgaacatatacaaactttaaaaatcattactccctagataatataacaactatacacataggatttacattgtattaggtattataagtaacctagcaatgatttaaaatgtataggagcatgtatgtaggttatacgcaaatactatacttttatataagggacttgagcatccttgggttttggaatcgggggtggttctggaagtaataccctgtggctgagggatgatggatttctctgttagtgacttacagaaaacttgacttcattgcacttacttttagagcatacctttaagaaaaaaagtgagtgttgaataaaaatttccccaagttaagattttgacctgcagccagaagtttaatgttttaaaactggatttaaaatcttatgtagctaagtaattgtaatgtatacaattagttgtgtaaattaaatgtgatttttttcccccaaactaaaaaaatttaggaattttcagatcagcatccagaaaatgcagctgaaattaagctgaccatggcacagttgaaaatttctcaaggtattatggttttcatcatgattaaaatattttaatgaaaacatgtttggaatgattaagcagttgtgaactatgtgattttaagtttttttgtgtaatagtaaagcataataattactgtttcaaacatgcagctagattgtatgatctccaacagatttagtagtgaggtagttgccccttttcgtggattattcctaaattattagaatgattcttaatctatgccttgaaagttctgaagcaaaggattcctctcttccaaaagaccatacatactactcaaattgcctgagtatgtcacatgcagaaatgcttatgtccgtcacttggtaatatttgtacgactactttgcatcatagttttcagaatttcttagcttggcccttcatccttacttcattttacactttgccacctatgtctttgggcttggggaaaggtaatagaatttaacgagaactgatgtgtttgaatcttaaaactgccaatgtttttgtctgtggttttcatctaactttgaatatctagagccatgttgcccagtttggtagtcactagccacatacagctattttaagtttaaattagttaaatgaaattttaaattcagttctttgattatgctagccacatcttagaagcttagtagctatatgcagccattggctacaatattggacagcacagatataggacatttatatcatcacaaaaagttctgtcgaacagctctggtatagaatgtggattttcaatggtggtgacaattcttcacaaaaatcttaaatattacagtggctgaaatgaaaattttatgagttgaaggaggggagttggcagttagggaaaaaatgtttaaaatgtccttagtagggcaataatgaaaataaggttgagacacactgctgatctccctcttatccaattctcacatttctttgctttccttgtctctttttccttctcctcagccctgtcttctcttccttgccctttacttgatctttcctcctatgtttagtttattttttcaaggattatttattatcttgaaattactgacaatctgtcatggttttttgtttgtttttaaagactgggaattttgagttattgaggtttgcagtgaatacaaaatcagaatttaacaccataggaaattttccattgcactcatgtctacagtaacatatttcaaggcctttagggaaggacccccaccttcaagttacagcccaaaaaagaagaaatagaactcaacagactgggagctgggagacttcttttctggtagcagctctgccattaactttctttgtgagcttaagcaaggtatattatttctttagaactcaatttccttatctctaaatgaacagagttcaccatccccaagaccccaaagtttatatgtttagcgatgttacaaaacatgagttatggttgctttcctaaggaaaagtagtgggaggaagtaaaatttcttgtatttttttttcataatatgtgttcttctatgtaatgctgattttgtttattctcctaaggtaatatttctaaagcatgtctaatattgagaagcatagaggagttaaagcataaaccaggcatggtgagttttaaaaattacaaaattgaaaagtagttgaattgataatttgtatgtctaatgtgtattcactttatttatatgtcgaatgtgtattcactttaaggtaggagtagtaattataatagtaatagttgtctggtataaatttaatttcattctctgctctggtattggtttcttattcagtcaaatgtgccaggcactatttaggccttatagtatcactgaaaaccaacctcaaataatctcagatctgtataggaatttcttagcctatatcattttcgtcagtgtgatttctttaaattagaacaatttcataattgtggccaacaaatttagtttttagttttctgattattcaaatattgcaggtttcaatcattaatacagctgtgaaagcatcttttccatagtagaaactaattctgtagtggtagtatgtgcatcttttggacaggggctgttttattcatgtttgcattctcatggcctctgtgcagttggcactcagtaaatgtaatatggtagtgctttcccttaaagattcatattttaaggatcgtgctataattactttaccttagagtcaaatacagtatatgactgaaaataaaatgtttctaatatttaatatatgaccaccttttacctttcaaggaatgtatccatttcatttaggttgctgactttattggcataaaagttcttcattttatttctttattgtccttttaatatctatagaacctctctcattcctgatattggttattcatgtatttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgcattagttaccatgtatagccatgaagaagatattgatagtgccattgaggtcttcacacaagctatccagtggtatcaaaaccatcaggtaaataaatggagtaaaatgttatgagagcatgtttttacataaaaataaagatggagtagtgaaaaaattcaggcaaacaagtattacacgtcactattttaaaagtggaatactatttagattatcaaatgcatttttttagtataccagatccaaattaagttattagaaataagcaatggctgcaaaatagaaaaatagcacatttatatttattgaagctccttgctgtatgtgtacatgcatttgtgtatgtaatctcaagaaataataatagtacatgattgcatatttaagagatcgtcttaaatggctagagagcccatgggtggtagtaattagtacaacagtaatacatggaatagttgtttatcatgtctctatctagtaggaatatcttaatttccagtatggatctctgcatgggcagtatccaacttaaaattatacatacgctgtgcaggtggcatttatactgttagtactgttagcagtggaggggtatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttcctctacatgtgtggatgattttgttgtttcaggcattcagtgaaacttaagatgagggatctaatgcataggtgtatttcttaaaggtctaatgaatataactgcatgcacttgctagatatttaacttgaaactttttttttctttttattgaaactgtagccaaaatctcctgctcatttgtccttgataagagaagctgcaaacttcaaactcaaatatgggcggaagaaggaggcaattagtgacctacaacagctgtggaagtaagctctgaaacgtggagttgtagaaataacacatttattgttgctacttgatatgagggagttacttgtttatattactttctccagttttataaacagttcaataattttcttatttcttcttttagacaaaatccaaaagatattcacaccctggcacagcttatttctgcttactcacttgtagatccagagaaagccaaagcgtatccttttgattgttattccttacagctcctcagtagcacaatagatctcttctgatatctgtgttttgaccagagctttttcaattgtaaactgcaactaacaaatcctccttttaactagtaaaaccaaaaaatgagaatttattgatcagtgtgactgaaaaatgcggcgatagatccaacttagggttcagtttcatccagaagcaaaaatgaagtcaaaagggtatggcctcttttcctccaggttcaagatcagcagcaaggtaaagaaaaagcatattttatgtgggtacttttgcatgattctgaaatgttattttcagattcaactacttaggtcacttgcttatctcaaatagttacctgataagcgaatttggtgcccttattgagcttggatcatatgtgctactctaaatcagagtgtgttcccaaaactgaggtgggttggtggatgctaagcagtcacaagtcataaacttgatagttgttttggaatagagtttgtattaagccaccaccttgctccacatcactgtgttaaggaatagagaattagattatgactcctcatgttctcctttcagaatactgtatgtactatataattgatatgacttgttattgtatagaagatttaggaacattttttgcttttgttgaaggtcatcaagaaaagacagtcttccagtgtcaatagatacattggcaaacatatatatctatataaatgtgtgtgtttgtgtatattatgttcctgaactcctgttctatcacagtcttagtaaacacttgccatcgtcagatagtatgtctctaaaagtagatgttgaggctcttgaaaattctgctggtgctacatacattcggaagaagggtggaaaagttactggagatagtcaaccaaaggaacaagggtaatatttttcattgtaacgttctctaatgctgattttaaattagacaaggaataaaaaatacattctcatagaaatttcatgtgaataaagttctagttctctttgttccttttccatttctctcactgtgcccagctctttgtccttatttccttcccttttccctcagcccaaaattaacctctggtattaatttaatctattattccagaagtttttctttgtgtttacacacacagatggtttacaaatattttctttaaattggtttatttattactattttttttttatttgtttgtttgttgagacagagtcttgctctgtctcccaggctggagtacagtggcacagtcttggctcagtgcagcctccgcctcccgggttcaagcaattctgcctcagcctcccgagtagctgggactacaggctaatttttgtgcatttagtagagacagggtttcacccttttgaccaggttcgtcttgaactcctgacctcaagtgatctgcccacctcggcctcccaaagtgctgggcaccacgcccagttattttttacagaaggaggattgtattgtacttagtgtttcccaacttacttttatttaatgagttttagagatctttccacgtactaaaatgtggacctatttcatcctttttatgcataacactccataggctggatgtgccttcctttaccttttagttattgttgtacatttagtacatcatttagtatatgatttcttttgctgatttgaagaaaaggttagtcggcttcatctacttaaaagaagtcagattttgacttgtttcttccatcgtcatcttaaaaatatagttagcagagacctacagtaaaatgttttaagattttacttttgactcaggatgaatagagcatggaaaagataaaacatttccttagctttgtgacttttataagtttttgctacttcctccttttttgaatgccttttgaaatctaaatttttccctaacttaaaaaaaactcagcaacaatgactgatttctttctaacaaactctgcatttcataaaaagcattgttgttctcataataacttccaaaacttttaataaggaattggagtctcaaagaggttacattgttccgaattccatttcatcttacaattataaattcagtctgggttcttaaatggattttcaattaaagtatgtttactatttttttcttccccaaacagggttgagtaactactaaggacacgcagttccttctttagcctggcatagtggctctgtgttccagttactgggaggctgaggcgggatgattgcctgagcccaggagtttgaggctccagtgagcagtgattgcatcactgcaccccagcctgagtgacagagcaagacccccatctctaaaaataataagtttttaaaagtttttttaaataatctttgtttcttttgtttgtttgttttcttttttgagacggagtcttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagtagctgggactacaggtgcctgccatcacgcctggctaatttttgtatttttagtagacagggtttcaccatgtcgatcaggctggtacttgaactcctgacctcaggtgatccacccgcctcagcctcccaaagtgctgggattacaggcatgagccaccaagcctggcttgctttctcttttttgcttagacaatcattaagatatacattgactttttaagcttttaagtttcagcacagtattttcattatgcattattaatgctctttattttatcttattagaagttagtattttgttatactaacttggatgcaaaggtttagtttcctttaacaatacactatgtgataggtttatgctaggtgttgaccagaaaataaatcatggtacttgctctcaaaagaacttgagccctgacatggtggtggctcatgcctgtaatcccagcactttgggaggccaaggcaggcggattacttgaggtcaggagttcgaaaccagcctggacaacatggtgaaacccccatctctactaaaaatacaaaaattagccgggcgtagtgacacatgtctataatcccagctatttgggaggctgaggcaggagaatcacttgaacccaggaggtggaggttgcagtgagccaagatctcaccactgcactccagcctgggtgaccgaatgagactctgtctaaaaaaaaggaacttgaatctagcagaaggaaatatatttaaacagtaattgcaataaagattgcacctgttgtgattgtacagggcatagaggagtacaccggagggaatagtcacttcttcctgaggacagtgggaagttaggaaaggcttcatggagaagatgattgtgttgactctgaggaagatgaggacgaggtaggcaaagggtgagctaaggcagagaaataagaaatagcagagaacccttgggaaattttagtatggctgtggagtataatttgtagggagacaatttagaatactattgcacactgggtaagagatgaaacactcaagtaagatacagtatgttgcatttcttatttggggtatcctgagagaacgttcacaattgaatgacttgtagaatgaatttttggtaggaattgttgtctcatctttttagttcactgtttcatatttctcgagttatatcacataagaatatatagagagatgtatttttatgtttttctcttttcactagagctttcagaatgctttttttttttttttgagacggagtcttgctccatcgctcaggctggagtgcagtggcgcaatctcgctcactgcagcctctgcctccctggttcaagtgattctcctgcctcagcctcccaagtagctgagattacaggcacgcactgccacacccaactaatttttgtatttttagtagagacggggttttactatgttgtccaggctggtctggaactcctgacctcaggtgatccacctgccttggcctcccatcgtgctgggattacagacgtgagccactgttcccagccactttcagaatgcttgacaattattttgaagtgttaatttttatgccctttttagtgccttttttggtcaatgtacttaatatagattttacttacataaaaaaattaataaactcacaggtttaaaatacaaaagataaaaaagtgtaagagtaagtaaaaagtcttccatccgtgtctacccacctccctcccagggccataaccaacgtaacttgttttgaatctccttccagagatattctttgcatgtatcttacctacacatgttcttctggcaaaaaatttattctctaaagtcttgccaaacatagagtaacttaccaagggattctaggtagtcatgcttgtgcaaattactttttacatagacttaatgtgtgccactgaaaaacttttttcagtgtaaacagaatctgttttcgaattgtcacctctgttttctaaactactttccaaaaattatagtatctgaagcttaattgactttaacctgaatcaaatcttaactaatttgttagctttggtaagctgataccaagtcttaaaccatgtttatgataagtgcccaactaactcttatagagcacttacttaatgctctataaatattttatcacaaagatggtaatgatttttttttctctttgtagacagggagatttgaaaaagaagaaaaagaaaaagaagggtaaggcattaaaaaagtctttataaattttctccaaaataaatgtttgattttagccctatatagaaatatttggacataaatatactgccctcccttgtatctttgaaaactttttatcttgactatagctaacatttaattttattctattactttaaagatcgcaattcactagtttgcctaaattcaaatcgttgctccctcttttactctgtgactgtggacaggctatttaatatacctgccagagtttttcatatgtaaaatggaatatgatagtatatatccttgtagtattagatactacatgtaaagttcttagagtggtgcctggcacaaaagtaagcacttacacattttgatgtttctgctacacataactacaaaattccatcaaactagcttaagaaaatttactgtttataaagttggcagtctagaggaatgttagcatcaaggttggttgactcagtatttttacctctttgttctgctctccacaaaacagaatcccattagagtcatatgatgtatattgtaaacagtcagggccacatacttgtcatttatatccatcacaacaaagaagccctctccagacttggcaagtatttctcattaatctgattgggccaagcaggtcagtgtccagccttgaattattaaccagggaaataatgtgcattgattggcttggagtgtggctttaatctctggaaaaattgggtggcattaccgtgcttgattttacctagtcagatgttatccttggagccacccaagttcctgaggttttgaggaatctatcatataaatcaggttatttcttgattttgctctctgccgtcttaggatacaggtttcccaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctataaatttctaatggtactgcccagattaaattgctttccacaaagggctataccagtatacacttcccctagtatagtgttggtgagtgcttctcaccatttcaccaacactggggtattactgcaagtctgatagagttttttacccttctcatttttaattagtgagggtgaacatctgttcagaagatgaatgactttcctttctcctagcctaccttaattataactgagtccatttttctttgagtggtttacatagtgatcagcaagaattctttctatattaaggatttttttccactcctctattatatagtttgtattttaaattttttcttagaaatatattttttactaaatgaagattttaacatttttttatagatgtatctgtgaagtttttttctttatggtctctgaatttttttgtcatgctgagaaatgaggccttttcccccttcaataaaattcaacaccccttcatgctaaaaactctcaataaactacgtattgatggaatgtatctcaaaataataataactatttatgacaagcccacagccaatatcatactgaatgagcaaaagctggaagcattccctttgaaaaccggcacaagacaaggatgccctctctcaccactcccattcaacataatgttggaagttctggccagggcaatcaggcaagagaaagaaataaaggatattcaaacaaaaaggaagtcaggttgtctctgtttgcagatgacatgattgtatatttagaaaaccccatcgtctcagcccaaaatctccttaagctgataagcaacttcagcaaagtctcaggacacaaaatcaatgtgcaaaaatcacaagctttcctgtacaccaatagtagacaagcagagagccaaatcatgagtgaactcccgttcacaattgctacaaaagaataaaatacctaggcatacaactaacaagggatgtgaaggacctcttcaaggagaactacaaaccactgcttaaggaaatgagagaggacacaaatggaagaacattccatgctcatggataggaagaatcaatatcgtgaaaatggccatactgcctaaagtaatttatagattcaatgctatctccatcaagctgccattgactttcttcacagaattagaaaaaaactactttaaatttcatatggaaccaaaaaagaacccatatagccaagacagtcctaagcagagaacaaagctggacgcatcatgctacctgacttcaaactattgttacaaggctacagtaaccaaaacagaatggtacgggtaccaaaacagatctgtagaccaatggaacagaatagaggcctcagaaataacaccacacatctacaaccatctgatctttgacaaacctgacaaaagcaatggggaaaggattctagccatatgcagaaaacaaactggaccccttccttacaccttatacaaaaattaactcaagatggattaaagacttaaacataagacctaaaaccataaaaaccctagaagaaaacctaggcaataccattcaggacataggcatgggcaagaacttcatgactaaaaccccaaaagcaatggcaacaaaagccaaaactgacaaatgggatctaattaaactaaagagcttctgcacagcaaaagaagctatcatcagagtaaacagccaacttacagaatgggagaaaatttttgcagtccatctgacaaagggctaatatccagaatcaacaaagaacttcaacaaatttacaagaaaaaaccccatcaaaaagtgggcaaaggatatgaacagacacttctcaaaactgccatttatgtggccaagaaacatgaaaaaaagctcatcatcactggtgattagagaaatgcaaatcaaaacaacaatgaaataccatctcataccagttagaatggcgatcattaaaaagtcaggaaacaacagatgctggagaggatgtggagaaataggaacactttaacattgttggtgggagtgtaaattagtttagccattgtggaagacagtgtggcaattcctcaaggacctagaaccagaaataccatttaacccagcagtcgcattactggatatatacccaaaggattataaatcattctgctataaagacacatgcacacttatgtttattgcagcagtattcacattagcaaagattggaaccaacccaaatgcccatcaatgatagagtggataaagaagatgtggcacatagacaccatcaatactatgcagccataaaaaacgatgagttcatatcctttgcagggacatggatgaagctttaaaaccatcagtctcagcaaactaacacaggaacagaaaaccaaacaccgcgtgttctcactcataagtgggagttgaacaatgagaacacatggacacagggaggggaatatcacacaccaggcctgtcggggggcggtgggaggctaggggagggatagcattgggagaaatacctaatgtagatgacgggttgatgggtgcagcaaaccaccatggcacatgtatacctatgtaacaaacctgcacgttctgcgcatgtatcccagaacttaaagtataataatttaaaaaaaaagaccatttcgcctgctagattatacaaactaaactttctcaaataaattcatttccattttaatgttatttattcccaggcttagagacatcgtttaaacaaactatcttgaaaatattatgacacatctctcatttctttataatcgttatgcaggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactgtaagttattgctccacaattgagggcacttagaacatacgttgtttctagattgactcaaggctattagtgagaatttgttaatataaagtatgagaaatgtgatgtatctttgataaatgtttatactacacttatgcaaatgaaagaaaatatattgcctttttagactagtttttcctttagtttttacaattcagtcaaatagttttaagtatttacaatataatcaaatatatattgtgaaatatatatagtaaaaactattataaaaactaaaagtctcaaggcaactaaatacactgagtcattcaactaaataaatatctagataaacagatgtaaataaataatatgactagaaagaagtgttagaagtattaatacgttttacatggtggatgacaggttattttaaaaaattttttctggccgggcgcagtggctcacgcctgtaatcccagcactttgggaggccaaagcaggcagatcatttgaggttgctagttcgagaatagcttggccaatatggtgaaaccctgtctctactaaaaatacaaaaattagccgggtgtggtagtgcgcacctgtaatcccagctactcgggtggttgaggcaggagaatcacgtgaacccagaaggatcacgtgaacccaggaggtggatggaggttgcagtgagctgagatggtgccactgcattccagcctgagggacagagcaagactctgtctcaaaaaaataaaattttttattttctacgctttctaaaacttggcatgtgtaccatgttttacttttcttcaataaaaacagtgaaaatgttattcaaaagaaaagtcgatagggagttggggagcttaccttaaaagaagtagaaaatgtgtgggagattgttaagtgtgataagtaaaacccatgtacatacatttttatactcttccttcgttgaatatatgagtgaccaaaaatgatctgatgatttcagggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggattaaggtgttttgggtgttggcattttatggaggacttcctggttagtataaccaagaattttcttttaagctgagtatcaaaattgtgtgtactgtccctcttagcaaacccataaaactaatctaatgggattgagagaaccccgtgtaaacttactgaaaattcatcttggtgtgtg

SEQ ID NO: 15551 - DNA, 24214 bp, Human
  misc_feature (1)...(24214): n = A,T,C or G
ccacaatactaggccttatcaataccagctcacattcctttccttatttgaagggactaactttttagctcattacagacaccccttcccctttcctgtccgctttcttttaagtacccaccttagctaaaaaaaatcaaatgtttagccaaccgggattagtttagattatacgacccgaccccagccaatgggaaaaagatacaggggcaggacttgcgtcaaaaatagactcctgcccctttgttcaggtgtgctctcaaggcgactggccaaaaaggcacccctctgcgcaaaaataaaattgctttgctaaaaatcctttgttcaagtgttcaatttccttaagattttaaaagttattcataacaataggctcctgtttcagtatttcctggtgcggcgtaccacacctacagcggtcgagtcacgccaggcactgccaagacgccgaaaagttctcccgcagcaggccggaggtgaccgacggcgcgcaggccccagcgagcgctgcatgctgggatccgtaggccggggcggcggatgtttgcgcagcttccttgagatgccaccgcccgctgcgccgcgcagaaacggggagcgcagcgcacccgcggcctgcgtcactcggtcagtgcagtcgttctaaaatcgaggcggaccctgctttcttgcctggagtcacttagagatgatgactaaaggataaattcagagtcctccaaatggcgtccagtgtccatttcatcacgatttggaacctgtagtagccttatcgcttaacacttcctaattattattattattattttctttttgagaaagggcattgctctgtcgcctatgctggagtaatccagcgacataatcccggctcactgcagcctctatctcccgtgttcagcgatccttcttcctcagcatcccgagtagatgggaccaaaaggcacgcatcaccacaccaggctattttttcccctctattttttgttgagacccgttgggaggcgcggggaggggggtctccctatgtcgcccagactggtctcaaactcctggaacttaagttatcgtcctacctcggcccgttaaagtgttgggattacaggcctgagccaccgggccccaacattaattattcttcaagcctattctggaccgggcgcggtggctcacgcctgtaatcccagcactttggcgggnnnnnnnnnnnnnnnnnnnnggtgaaaccacatctctactgaaaatacaaatattagccgggcgtggtggcacgcacctgtaatcccagctactcgggggctgaagcagcagaatcgcttgaacctgcgaggcggaggttgcaatgagccgagatcgcgccactgcactccagcctgggtgacaagagcaagactccgtctctcacacacacacacacacacacacacacacaaagactattctggtctctgcctccgggatggcggctcgctttggacctctcttctgtgcttctactgccctctcttacaattctctaataattataatcatggcgagtgcttaccatatattccaatctatttacttccacaagctcattaattctcaccctaaccctctgagatggttactattatttcctctctgcagctgagggaattttgggctagggacgttatgtaagttgagccacgctacgctaaaagttccacactcaattctagcgtctcggctctggactaccaagttccggagcaagcagacagaccacctctttacgttcccgtaggccacgctccgggggcggggctccagtgaggatactgcatcccatggtgccttgcgcgccagcgcagccattggtccggctactctgtctctttttcaaattgaggcgccgagtcgttgcttagtttctggggattcgggcggagacgagattagtgatttggcggctccgactggcgcgggacaaacgccacggccagagtaccgggtagagagcggggacgccgacctgcgtgcgtcggtcctccaggccacgccagcgcccgagagggaccagggagactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcaggtagggagagggctgacaggattccgagcgctgcggcttcgctgctgggccccctactgcgcggtccagggagagggattttatttgcatttcctgagggtcccagtttcttggttctccgcgttctgttcaataaaaatgacacccggttgctgtgtgtatgtggtttttaggagaaaataacatgtttgatttgatcactgttccatactgaaaagtgcgttcttatgtttaaactatagtcaataaagatgtaggtgtcacttttatatgctacttcatgtagtttgtcagtttggaagtaagactgaatacctattttgcagatggttaagcacttacgttggtattattacctctaaaaagcaatcaatcactgttctctttattctagatgcaatattttctgcatccctactaaacaagtaaacatctctgtctttaaacattaaaaattaataaagtgagtttatgttttttaaaagatcaagacaagttaagctagtgtaaatttctgattgtgctgcagttttccctttcatctgcgtgtttgttcatagaccaaactaaacggatatttcgagataaagggatgtggaggggtgttcggccctcccctgactggtttccaaataacttcccaattttaaaataagctagaaactgctgcttagttagaattgatttattcaactttttagaggctctccacagtttactgagtatgtgtgttttgtgtgtccgtttttgtggctgttaacagttgctgttgcaacttttctgtaaaccccaaagtattctaaaattaaaaggttattttttagaaaaacttgtatcaacaaactttcttaggctattgtttactcagccctggtaacttgaattgtggatatcgaaggtgatgactaggtttctaaacaaggtgtcagagaggaaattgggtggcaatcttaagtctagccagtgacacttactagttgttgtactctggggcttctgttagtagttagttgtttgaagatttttatttaaaaatgcagtgcatataacaagtgcaaattttaaaattattttggttgtttaataaaaccaggcaatattaccttttccgtatgcatttatttaatttcttttttaatgttagttacaaaatatttcagacttacaaaaagttattaagaacaatgtaataaacatttgtatattcatcacccagattaagaaacaaaacaatcattgctggagccccccttttccctctccatcccttttcctccagccactgttaaccattatcttgaacttgatgtttatgatccgtatacatttcaagtcttagaagagatttactttatcaccaatgaatagaatagttctttgcttgtgtctaatatttacaataatttttgtgtaaagagattttttttttcagattagcctttttctttcaaatagccttcctggtgcgtctgtcattaagcattaagctttagtaaataggcaacttatgagttgcgaggtcctcaggggttggtaagccttttctgtaaagggcccagagaaataaatatttattttatttaaatactttaggctttgcagatcacatgtggtttatcagttttttttgagacggagtctcgctctcttaggccgtagtgcagtggtgcaatctcagctcactgcaacctccgcctcccggattcaagcaattttcccacttcagcctctcaggtagctgggattacaggcgcacaccgccatgcctggctaatttttgtatttttagtagagatggggtttcaccatgttggccaggctggtctcgaactcctgacctcagagaatccacccaccttggcctcccaaagtgctgggattataggcgtgagctactgtacccctttacatgtggtttctgtcacattattttctgatctttttttttttaagaacactttaaaactgtaaaaatcattcttaaatctgtcagggcaggggccaggtttgacccacaggttaaagtttacagatccctacataatgcgctactggttctctttcttatgtccctcctattccatcccctatttttttcccaatttaaaaagtcattttcaaacacacataatataaaatttaacatcttaaccacttttaagtgtacagttcagtgatattaaatacataatattctgcaacaattactaccatccatctccataactcttttcatcatgaaaaactgaaactctatacacattaaacaataactccccatttccctctcccatcaacccgacacctaccattcgactgtcttatgattttgactactctaagtacttcataaagtggagtcataatacagtatttatccttttgtgacttgctcattccacttaggcataatgtcctccaggttggaccatgttgtagcaaatgtcagggttttcttcctttttaaggctgcatagtatttattatatgtatataccacattttgcttgtcccttcatatgtcaatggatacttgagttacttctttttttgttgttgttgtttttgagaccgagtctcgctctgttgcccaggctggagtgcagtggcgcggtcttggctcacactgcaagctccatctcccgggttcacgccattctcctgcctcagcctcccaaggagctgggactacaggcgcctgccatctctcccggctaattttttgtatttttagtagagacggggtttcaccatattagccaggatggtctccatctcctgaccttgtgatctgcccgccttggcctccctaagagccgggattacaggcgtgagctacggagcccggccttgagttacttcttacttttagctattatgaataatgttgctatgaatatgggttttcaattcttttgggtatttacccagaattgtaattgctggatcatatgataattctattttaaagtttttgaggaaccgacaaactattttccacagtggctggaccattttacattcctaccaacagtgcataagggttccaatttctccacatcctcaccaacgtttattttctgtttcttttttttttttcaagtagccatccattgggtgtgaggtgctatctcattgtagttttgatttgtatttccctaatgattaatgatgttgagcatcttttcatgtgtttactggccattttgtgtatctttggagaaatgtctgtttaagtcctttgcccatttttaaattggtttgcttttttgttgttgagttttaggaattttctatatattttggatattttcagatacataaacggcaaaaattttttccccattactgtgggttgcctttttactcattgataccgtgtggtcttttcctttctttttctttttggaaccagtgcatggcctctttgttgattctgtgtttggccccagtgcagcctgttctgtgctatgtgtctgcagtgctgaaaccaggcctacccagcaccatacagaagtccaggctgtagataccaatgcatgggtcacatttgatacccaaatctgtgtgttcctggatctccaaaccaaagtttccagtatctgagaagttgttctttcttgattcacactcctgcatctttagacctttcttcagggtttcttctgctttggccctttgtgcagtgggtggcaatcttcacttctcctgatgccaaaggatctgacaatgtatttgactttggagaacacaggggtctggcctatgagctgctccaacaccttggctgctggggtcagtcatctccagtctcctccatacagatgttgagacagaaaatcgttctgtcacccaggctggagtgcagtggcacagtctcggctcactgtaacctctgcctgtcaggttcaagcaattcttatgcttcagcctcccaagtatctgggattacaggtgtgcaccaccatgcctggctaattttttgtatttttagtagagatggggtttcgccttgttggccaggctggtcttgaactactggcctcaagtgatccacccattttggcctcccaaagtgctgggattatgagtgtgagccctcatctggccagagttctcttttttttaccttgatcttgcactatgatggagaaaaggaagataaagtctttttttttcccttgggtttgtttgtttgtttgtttgtttgttttttgagacggaattttgctctcgttgcctaggctggagtgcattggtacgatcttggcttactgcaacctccgcctcctgggttcaagccattttcctgcctcagcctctagagtagctgggattacaggcatgcgccaccacgcctggctaattttgtatttttagtagagatggggtttcaccatgttggtcaggctggtcttgatctcctgatctcaggtgatccgtccaccctggcctcccaaagtactgggattacaggcgtgagcccgtgcctgggctattttttttttctcccctttaaatatagtatcttgctttattgcccagacttgttgtgaactcctggactcaaatagtcctcctacctcagccttccaggtagctgggatcacagggatgctgtcttttgatacacaaacattttaaatttttatgaagtccagtttgtctttttgtttttgttccctgtatctttggtgttatatccaagaaatcattgccaaatccattgttgtgaagcttttgccttatgttttcttctaagagttttatagctttaggtcttacatacatttttgatccattttgagttaatatttgtatattgtgttagataagggtccaacctcattcttttgcatatggatatttagtttcccagcaccatttggtgaaaagcttgtctttttctgattgaatggtcttggcaaccttattaaaaatcatttgctcatatgtaagagggcttatttctaagtgctgttatgttccattggtctataagtctgtctttatgtcagtaccacatggttttgattattgcagctttgtagtaagttttgaaatcaggaagtgtgagtcctccagctttgttctttttcaagattgttttggctatctggactcccttgggattccatatgaatttgaggatgaatttttctatttttgtaaaacacgtcattgggattttaatagggattacattgaatctatagatcactttgggtagtattggcatcttaacaatattaagtctttcagttcatgaacaagggatgtgtttccatttatttatgccccttaatttctgccagcagtttttttttgtttgtttttgttttgagatggagtttcgctcttgttgtccaggctggagtgcagtggcacaatcttagctcattgcaacctccacctcccgagttcaagtgattctcctgcctcagcctcctgagtagctgggattacaggtatgtggcaccacgaccagctaatttttgtatttttactagagacaaagtttcaccatgttggtcaggctggtcacgaactcttgacctcaggtgatccacccaccttggcctcccaaagtgctgggattataggcgtgagccactgcgcctggcctcagcagtgttttatagttttcattttataagtctttcacctccttggttaaattaattactaatattttattctttttggtgctattttaaattgagttgtttttgtaatttcctttttagattgttcattcttagtgtataaaaatgtaactggaggctggacgcagtggctctcacctgttatcccagcactttgggaggcaaggtgggcctcccaactcctgatcacgagatcaggagttcaaggccagcctggccaacatagtgaaaccctgtctctactaaaaatacaaaaattagccatgcatcgtggcgcgtgcctgtagtcccagctacttaggaggctgaggcaggagaatcgcttgaacctggaaggtggaggttgtggtgagccaagatcgtgccactgtactccagcctgggcaacagagtgagactctgtctcaaaaaaaaaaaaaaagaaaaaagaaacgtcgctggattttgcttgttgactttctatccagctactttgctgaattcacttattagttctaacagtttttttttgtgtgtgtgtaattttagagttttcttttctttttttttttttgagatggagtctcgctttgttgccaggctggagtgcagtggcgcgatctcggctcactgcaacctctacctcccaggttcaagcaattctcctgcctcagcctcccgagtagctgggactacaggcacacgctacgacgcccagctaatttttgtatttttagtagagacggggtttcaccatgttggccaggatggtctcgatctcttgacctcgtgatccacctgcctcagcctcccaaagttctgggattacagccgtgagccactgtgcctggcttttttttttttttaattaactattgaacttctgtttattattattattattatttatttatttattattttttgagatgaaatctcggtctgttgcccaggcgggagtgcagtggtgtgatctcggctcactgcaacctccgcctcccgggttcaagcaattctgtgcctcagcctccggagtagctgggattataggcgctcgccaccatgcccggccaatttttgtatttttagtagagatagggtttcatcatgttggtcaggctggtcttgaactcctgacctcgtgatccgcccgcttcggcctcccaaagtgttgggattacaggcgtgagccactgcacttggccttatttttattatttttttcatcaacttttaagttctggggtacatgtgcatgatgtgcaggtttatcacataggtaaacctgtgccatcacagtttgctgcacagatcaacccatcacctagctattaagcccagcatccactagctattcttcttgatgctctagctccttttgccccactgaattttagggttttctttcttttctatttttttttcttttgagacagactctcgctctgtcaccaggctggagtgcagtggcacaatcttggctcattgcaacctctgcctcctgggttcaagcgattctcctgcctcagcctcccgagtagctgggactacaggcatgcgcccatgcctagctaagtttttgtagttttagtagagacagggtttcactatgttggcaaggctggtctcaaactcctgacctcaagtccccttggggttcctgaagtactgggattataggtgtgagccaccacgcccggccagattttctatataaaagatcatataatctgcagacagataattttactttttccttttctttctttttttctttttttgagatggagtctcgctctgtcgcccaggctggagcgcggtggcgccatctctgcttactgttacctctgcctcctgggttcaagcagttctctgcctcagcctcccaagtagctgggattacatgcacatgccaccacgcccagctaatttttgtatttttagtagagatgggagttcatcatcttggctaggctggtcttgaactcctgacctcgtgatccatccgccttggcctcccaaagtgctgggattacaggcatgagccaccgctcttggccctcaaccttttccttttcaatttggatgccttttatttttatttttcttccttttttttttgagatggagtctcgctctgttgcccaggctggaatgcagtggtgcaatctctgctcactgcaacctacgcctcctgggttcaaacgattctcctgcctcagccttccgagtagcttgtactacaggcatgtgccaccataaacagctaattttttttttttctcgtatttttagtagagacggggtttcgccgttttagccaggctggtctcgatctcctgacctcgcgatccgcctgcctcagccttccaaagtgctgggattacaggcgtgagccaccatgcccggcccttgtttttctttcttgcctaattactctagctagaacttacagtattatgtcgaatggaagtggcaaaagtgggcattgggcatccttgtcttgctcctgttcttttatttgttagtttgtttgagatcctcctgcctcagtttcctgagtagctgggactatagacacactactacacccagctaattaaaaaaataattttttttttttttttagagatggggtctcgctatgtttcccatgctgatcctgaactcctggcttcgggtgatcctctactcttaccctcccatagtgctgtgattacaggcatgaaccactgtgctggccctgttcttgtttttagaggaacattcttcagtctttgaccatcaattatgtttgctgtgggtttttcatatgttgcttttattttgttgaggtagtttcactctattcctagtttgttgagcatttttatgactaatgggttttgaattttgtcacatgcttttcctgcatcgattgacatgattctgtggtttccttcattctgttaatgtggtatattacattgatcaatttttacatgttggaccatccctgtattccaggaataaatcccacttggtcatggtgtataatccttgtgctgctcagttcaatgtgttggtattttgttgaggatttttttttatcagtgttcataagggatagtgatctgtagttttcttgtagttgcctttgtctggctttggtatcagggtaatgcttgcctcacaaaatgagttgggaagtgttctctcctttgccagattttttctgggaaaagattgagaagaactggtattagatcttcttgaaatgttttatagaattcacctatgaaactatcagatctagggcttttctttgtcaggagatttttggttagtgagtccatctctttactggttatagctccattcagaatttccatttctttgtgatttagtctttgtaagtattgtgtttctaggaatttgttcagctgggttatccgatttgttggcatacaattgttgaaaatactctttcaacaataagagagaagacacaaataactagttcttttgtttccagttccttaagttgtaaagttagggtgttgatatgagatctttcttgctttttaatgtaagcattcatagctataaatttcccccttagcactgcttttgctgtgtcccgtaagttttggtatgttgtattttcattttcattaatctctaaaattttctaattttccttgtgatgtctttgaaccctggttacttaaacacacacacacacacacgtgtgtgtgtgtgtgtgtgtgtgtgtgtgtggttttttgtttgttttgagactgagtttcgctcttgttgcccaggctggggtgcaatggcgcgatctcggctcactgcaacctctgcctcccggttcaagcgattctcctgtctcagcctccagagtagctgggattacaggcgcctgccaccacgcctggctaatttcacacacacatttaaaaaatacatctacctgcttttacttcagaatctttgcaatttctgttctctctgcctgaaaattttttccaccaaaatatctacagggcctggctcccttgctttttaggttctgcttaaatatcacctgcgtagaagcattccctaactaccctaaaatagcaaccaactatcttccaccctcaacacttcctatcccccttaaactgctttcttttcttttctttttttttttttttttttgagacagagtctcgctctgttgcccaggcctggagtgcagtggcgcattcttggctcaccgcaacctccacttcagcctcccaagtagctgggactgtaggtggctgccaccatgcctggctaatttttttttttttgagatggagtctcactctttcacccaggctggagtgtagtggcacagtctcggctcactgcagcctccatctcccaggttcaagtgatttctggctaatttttgtatttttagtagagatgaggtttcaccatattggccagggctagtttcgaacttctgacctcaagtgatctgcccaccttggcctcccaaagtgctaggattacaggtgtgagccactgtgcctggcctaatttttgtatttttaatagtgatgggtttttactatgttggccaggctgatctcaaactcctgacctcaagtgattcacccacctcagcttcccaaagtgctgagattacaggcgtgagccactgtgcctggcctgctttattttcatttctaatttatcagcatctaatatatttattcattttatagtcatctcttccttcaactaagttaaaagctccctgagcacaggattttggtgtttttttctttcctttaactttgtattgttcattgctgtatctccagtgtctagaaaattacctatcacatagtaagtacttgatgaatatttgtggaatgagttaatttagcacttctccacaggataggacttaggtttttttaatcctcaatctcccttccctcaccattttgattgtttgaatttttatataactatggtgaagccaacaaattgatggatttgttagtgtgagcagccgaaactttgcaatttctaataagttagagaagtctgggtaggaaactaatgacttggcagtactctttcttagagtacacatagtccctaaagcttctctgagaattttgataactttgaggaatgtgtgatctgtatgaatttcctatcacttagtcctgacaatgtgaatggtattcatttggtaacttaattttatacgtccaggcaagatactagtttaggggatgccaaaaataatagactaattggaaaagctttagccacatgagagcaattcactccacttgatgctcttggcctacctcagtataagttggttctaccttagttttgttgaagttttaataatactgtacattcatgttggttatatgcattgtgtaagttttagtatagttggcaaatgaaagcattaccagatactacctgggagttaagtttcctaggatcacagatttggtcttctgatcacttggaagtatacttagagtgggctgtgccaggggaagttgaggtatccttcttaaataagtagcaacttggtttatctagtgataagggggaaataatttcctgtttggcactttctccaaaatatatgatactcaatgggaaaaatgaactcaggtcaagattatgtctctccctttggcccagacatgtattgagtatataattgtcttattgatgctactctgtggactgtgatattagttttcccataattcctcttaggatgacatttattaggcaatgtagtttaacagatatttaagaacctactgtgtgctaagcatggtagttgttgctggggaaacagtaaactagacagtatttctttctgtagtgatctgaggtttagtgggtaacacattaaaaaaaaaagataagagaggtgatgtttagaaaaggtgtataaagggtgctgtaggaatatatagcagacatttaatgtggtcttggttggagcaggtgggggaggcacataggatagaaaggacttcctgaggaaataatcatttcaactaaatacctactcaggcatttccgtagaatgaggactcttgatccagtcggcagtgtagaccttctgtgtctattcactcatttaaaaatggggctaataatattaccaacctcacagtgttgtgtggacaaactgagtgagcacaatgcaaagcacttgaaacaataagtacctggcacatagtaagtactcaacttattagtcattatttttatgtactttttattttgtgccaggtatctactggcagattagtattttgaacacaaatttgacatgtttttttctactacatcataacctaatttgatcggatttttttttttttttttttttgagacggagtttcgctcttgttgcccaggctggagtgcaatggcgcgatcttggctcaccgcaacctccacctcccaggttcaagcaattctcctgcctcagcctcccgagtagcagggattacaggcatgcaccaccatgcccagctacttttgtatttttaatagagacagagtttctgcatgttggtcaggctggtctcgaactcccgacctcaggtgatccgcctgcctcggcctcccaaagtgctgggattacaggcgtgagccactgcgcccagccttgatcagattttaagaataggagaaatggaattctgaaaaataagtttggcatttttacaagttaaaacctgttagtggctgggcacagtgtctcacttctgtaatactagcaccttgggaagctgaggtgggataatcacttgagcccggaagtttgagaccagcctgtgcaacacagcaagaccccatctctaccatcaaaacaaaacaaatctattcgtatctgctctaagaagctgccagaattgtaatgtcttaacatatctttgaacatttaaaaaattatatttgtgaaacttgagacacttataattttactgtctgctttagcaatatcacttagtcctgatttaatctccatcaccaacaatgtggtcaaaatttcgcatttttcttgacaaatgtagttagtgaaaatgtcattgataacctgagaactaagagctcttgaatgactttgtgtatttctttttatagaccatttaatttggcagagcggaaagctagcgcccattcaatagtagaatgtgatcctgtacgaaaagaagttagtgtacgaactggaggattggctgacaagagctcaaggaaaacatacacttttgatatggtaacatatggtgcaatttctttattatccactaatgtaaaataattttaatatacatattttacctggaaaatggtgtatacttagaaatttcagttgtctctgaattgtcagatggcttctagtgggctgaattatgaattagttaacatacgaaaaacaaaattattaaaatgagtaattttgaggttgatttttttttttttaatttttttcgttaggtgtttggagcatctactaaacagattgatgtttaccgaagtgttgtttgtccaattctggatgaagttattatgggctataattgcactatctttgcgtaagtaaaagggtgttttttctgatttatgaaaaagcttaaatgcttgtgttttttgttgttgtttgtttgttttttgagacggagtttcactcttgttgcccaggctggagtgcaatggcgcgatctcggctcactgcagcctctgcctcctgggttcaagcaattctcctgtttcagcctcccaagtagctgggattacagctgcctgccaccatgcccgctaatttttgtatttttagtagagacgtggtttcactgtgttggccaggctggtctcgaactccggacctcaggtgatccgcccacctcggcctcccaaagtgttgggattataggcttgagccactgtgcctggcttgttttttgtttttctagtctatcactaagagtcatatgggtgcatgtttctttttgatttaacacttgttaatctttacaggtatggccaaactggcactggaaaaacttttacaatggaaggtgaaaggtcacctaatgaagagtatacctgggaagaggtatttattgtttataacatacttttatctctaatgtgactgaaatttaactgtataaaacttgtttgagggcctctgtcttggaatagagatcagagtacctatgtcaaaatgaacttaggataaaccactactacagtaaaattaaagtgcatggtatgactcctgtttaagaaacagcctcaatggaagaggaaggaccaatatatatggcacagttatatgataaaagaggagtctatttatgacagaatggttggagcagaatattgtagaaaagttggaatatgagtgaagcttgaaggcagggagggctttgtattgaaggaatgggtctcagaaagttagcatggccaggggaagtatagtactttattcatgatgatcctaagtgttcaagaaattaagatgaatgtattgtttaatattgcagaaagcatatactatgttttacaaagatttccatgaatttaagtgagtttaataactaagagagagaaccaatactggaagaaagttgaaagaagaccaagacaagttgaactagagctgaagtgttaaaacttttaaaaaaaagtttagttttaaatttagtaatgtgtttaaatttaaatgagtttaataactagttaattggtcgggcacggtggctcatgcctgtaatcctagcactttgggaggctgaggcgggcagatcacctgaggtcagcagttcgagaccagcctggccaacatggtgaaacccggtctctactaaaaatacaaaaattagctgggtgtggtggtgcatacgtgtaatcccagctacctgagaacgagactctgtctcaaaaaaaaacaaaaaaacaaaaaaccaaaaaactagttaatttaaaaaaaaaaagaattttttttaatttttttttttttttttaaattttaaagtgatggggtcccactgtgttccccaggccagtcttgaactcttgggcttcaggagtcctcccacttcagcctcctgagtagctgggattagaggcacatactaccttgcccagctaattttccaaattattgacagttgggtagaacctttcttctagtggttacataattgagtcattaacttactttacatatatagataataaagttatgaaattgttaccataggagatatggaataggcttaaagcatagtttcgctgggcagaattattgaacttggcgttttttttttgagacggagtctcgctctgtcgcccaggctggagtacagtggctcgatcttggctcactgcaacctccacctcccgggttcaagtgattctcctgcctcagcctcctgagtagctgggactacaggtacataccaccaagtccggctaatttttgtatttttagtagagatggggtttcaccgtgttggccgggatggtcttgatctcctgaccttgtgatccacctgccttgacctcccaaagtgctgggattataggcgtgagccaccgtgcctggccgaacttggctttttaagtagataggttccattggtttctatgtaatgctcagggatgaagatggctaagaagtgtgacaggtttatggagggtgtgaagactactgtagaacagactgttgtaaatgacttctctaacattaggttagttgtttctttttttgttttgttttaacttgctttgccatacttatgtttaaatatattataaaggaggcccatgtattttaactgccacagtaaatggcattcttcctttatattagtccttattataatttcaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaaggtaattcagtctttgagaatgaaatgtctctgaattttaatgtgtgaggctttgagaagtcagagagagagagagagagagagagagagagagagagagtgtgtgtgtgtgtgtgtgtgtgtgtgtgtgtgtgtgtgttttaaccaatctaatggatgttcttttggtattttggtcagagaggagtgataattaaaggtttagaagaaattacagtacacaacaaggatgaagtctatcaaattttagaaaagggggcagcaaaaaggacaactgcagctactctgatgaatgcatactctaggtaagaaagccatagtctcttccctagccccattttcttttaagaagaattaggaacttggagaaagtcaaattggggtgggtcagggtatgtgggtcacgtacctagagtttgtgttataaggaggggtcattggtaattggcttgagatttatatggaaggaaccaatattggaagaatgttgaaaggagaacaaagataagttgaaccatagctgaagtattaaacttttttttcttttttgagacgaattttcgctcttgttacccaggctggagtgcagtggcgcgatcttgactcactgcaacctctgcccaccgggttgaagcaattctcctgcctcagcctcttgagtagctgggattacaggtgtctgccactacgcccagctaatttttgtatttttggtagagatgtggtttcaccatgttggccaggctggtctcgaactcctgacctcaggtgaaccacctgccttggcctcccaaagtgctgagattacacgtgtgagccacggcgcccggcctaaacttttttaaagtagaagaatccttttattctagtaacatgatatatggaagcccaggataaaatgtggctgctatagttgattttggaatgggacgctctgaggcttacctccttagccttatgaaggggtccctgaggcacttttgtggagccccctactgatattagaatatagtttgaaaacccttgcattgaataaggattagaagttaggtcttttaaaatggctttattttagtgtgggagacagatggtcactaacactggctttcatggggtgaaagggatgatttttttcgctctaaatatcttttaccgaaatataaaattcctttttaaaaaattgtttattttcctctcttaccactctattcattgagatataaaatccctgtcataaatttacgtaagttagaaactccttttttcttgtaaagacccgtacaggacaaattccaaattctacagatatagtttactaaaacagaagtggtttttttgtgtgtgtgtgtggtctttaaacctcagaatgtaatagaaaaagcaatggattgcaattagatatttgcgtgtagtctcagtttcgcggttaattcagtatgtgactttttgtaaataagtgaatttatctgcttatcagtttctctgagctacaaaattattgttaggattagaagtcttatttcttttctggcttgtagttgaaaatttctataaaatgccataacaattacagttgcaactctaaaaaagtttgcatttaaagaaagaagaaaaatataacataaaagtgattaagatcatggaattttggatgatttcaaaattttaattaaattttcacttaatggctttccaataaaatggaaattttattctgtggttgattataacttaatttcatgtagaattttgagaactgaactaaagactaggtaaaatttctttaggtacatttcactaaagtataaaatttctatttttccttttttcttgtatgtagacttgtataaaggtcactttttatgaaggtatgtgacaaagaggagaagctaattaattcagttttcccaaattagagctaacttcaatgcttatttgtattaattgcctaatctggattaggaatgggtagataatggtagaaaaacatgagatgaatagtattattattattattattatttttgagacagagcctctctctgtcccccaggctggagtgaagtgatgcgatctcggctcactgcaagctctgcctcccgggttcacgccattctcctgcctcagcctcctgagtagctgggactacaggtgcccaccaccacgcctggctaattttttgtatttttagtagagacggggtttcactgtgttagccaggttggtctcgatctcctgacctcgtgatccgtccacctcggcttcccaaagtgattacaggcgtgaggcaccatgcccggtggagatgaatattataattcagatctatagtttacatttatgtttttccttaggtcttcctccttttctgtaattttaaataatttaaataattttataaaaatgatacttggctgggcgcgatggctgacgcttgtaatcccagcactttcggaggccaaggtgggtggatcacttgaggtccggagttcaagaccagcctggccaacgtggtgaaaccccgtctctactaaaaatacaaaaattagcttggtgtggtggcgtgtgcctgtaatcccagatactcggtaggctgaggcaggagaactgcttgaacccaggaggcagaagtttcagtgagctgagatcatgccattgcactctagcctgggcaataagtctcaaataaataaataattaaaaaagatacttaattttttttttaagtaacatgaaagtacaaagaagaaaattgaaacttaccagattctctgtcaattgtcagtgatattaacaaacataataatgttcaccaaatgccattggatacagaaagaatgtctttggtcatctgtataattttttttccccctaagataaaaagcacagtatttgttttgttttttgtttttttgtttgcttgtttgtttttttgtgatttttttttttgagacagcgtctcactttgtcacccaggctggagtgcagtaactcaatcatggcttactgcagccttgacctcctgggctaaagtgatcctcccacctgagcctccagggtagctggaactgtaggagcgtgccaccacgcccagctaatttttaaatttttttgtagagatgatggtcccactatgttgcccaggctggtttcgaactcctgagttaaagtgaccctcctaccttggcctcccaaagtgttgggattacaggcatgagctaccacccctggcctgaatatcagtatttagcataaggtagacttttgaacattttataatctagcagtgattatcttgtagtgttttagtaatcatgctgtttactatttctgctgttaggggataggagtcatctatttctgatgacagtctcaaagcagagaagtgtacttgtgcatgtacacaacagctgacatggatgggaaggtggaagagtaaactaatgccttacctggtaccatttgaatttatggtaatgacatatttcaaatggttcttatgaatagaagatgattacaagccatctcttcttgacataccaggcaactgtttcgaccccacccacatccagctttcagaggtgcctcaggattctaagtcttttagagagcttcttattgatgcctcttttgcaggcagtagatatgagaaaacaaaatcctaatcactgttctatctatctcctatcttccaaaatattcttgatatctcctgtctgatgttatctttctctactcatgtggatttagatcttctttcctgttttcagtatttcagaagcagcaaatgctattttacattataatgactgggcaacttgatattgttttctagtcgttcccactcagttttctctgttacaatacatatgaaagaaactacgattgatggagaagagcttgttaaaatcggaaagttgaacttggtaagcatccaccttaatactactgtttcactcttaaacaccttatagagcagcttgaaattttgtccttgagacaaaatttttgtggtcactgggtgattagctttgtagtgggagaagaaatttgttaattacagaaaaaattattttgctggcgatttaatacattatgtatcctgtgagaatgaaagtctttgaatccaaatccaatagactcactttttatttttatttttaaaattaaaggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggtaagccctttgaaaggaagctgcaagtgtagtagctgtaattcttatttggctattatatattttaaaagttcatttactaggatggacacagtgactcacacctgtaaacccagcactttggaagtccaaggtgggcggatcacttgagcttaggagtgcctgggcaacatgccgaaaccctgtctctaccaaaaatacaaaaaattagctgggtttggtggtgtacaactgtggtcccagctacttggggggctgaggtgggaggatcacttaagcctgggaggcagaagttgcattaagctgagatcatgcaactacactccagcctgggtggcagagggagaccccatctcaaaaaaaaaaaagtatgtgtataaaaaaaaagaaaagtatgtgtatacacacacacacacacacacacacacacacacacacacacacacatatagtagggaaaaaaagttcatttagtagcttcatttttttttttttgagacaaatcccactcttgtcccccagactggagtgcgatgacgcgatctcggctcactgcaacctccacctcccaggttcaagcgattctcctgcctcagcctcccaagtagctgggattacaggcacctgccaccacgcccacctaatttttgtatttttagtagagacgtggtttcaccttgttggccaggctggtctcaaacccctgacctcaggtgagccgcccgcctttgtctcccaaagttctaggattacacgcgtgtgccactactcagcctagcttcgttcattctatgctataatgtaaaagaatctggacattgcatatgaatatatacaggaggacactcctgaagaagttatctttttccttcctggcagagtttttaaccttaaaaagccagtttcttaatggctttttccacacagtcttcaaagaaaattgctgtggtcattagcagtgggtggtgtatggagatttaattgaggacttagaagcaggccaagtgaatgctcgctagtgtggtagaggctgcttagagaacactgaagatggcgttggatgtgtgagaacagagaggaaaaccaagaaaagtaacaaagatggtaaaatgtacgcttattttattgctatcatctgccttaagtggaaattttatttatttattaatttttttacttttagaggtagagtctcatactgttgccaaggccgcagtacagtagcatgatcatggctcactgcaacttaaattcctggactcaagtgattcccccaaccacagcctcctcctgagtagctagtactacaagtgtgagccaccaggcctggctaagttttgttttgttttgttttaaatagagacagaggtctcactatgttgcccaggctggtcttgaactcctgggctcaagggatcctcctacctcagcctcccaaaatgctgcgattataggcatgagccacctcacttgacctaaatggattttaaaaagcttttttaggccaggcacggtggcttacgcctgtaatcccagcactttgggaggctgaggtgagtggatcatctgagctcaggagttcaagaccagcctgagcaacatggtgaaaccccatctctactaaaaaatacaaaaaattagctgggcatggtggtgcgcgcctgtaatcccaactactcaggaggctgaggcgggagagttgcttgaacccaggaggtggagattgtagtgagccgagattgcgccattgcactcaagcctgggtgacagagtgagactctgtctcaaaaaaacaaaaaagcttttttaaggtgtccaactgcccctt

SEQ ID NO: 15552 - DNA, 4758 bp, Human
tagaacattttaaatgcaaataaaacaaaataaatgttaaaatttagtaatatttattaaattttctccaagtgcacgaaattacaaatgtaacaacctaattccctagtggcctaataaccctatttcccagacctcttctcattacaaggaaaaactcatatgcagatagttctaaaggtatgaagtgaaaagataaagatttttcttccttgctgcatcctcaccccatcagcattattccccagggtaactactattaatagatagtaattctacccaaaggaaaaaatcatatgcatataacagcatcatatgtatacctttctagtaacttacaaaacaaatgataatatcatatcctttcttatgtgtattgctcttttcactaaatgtatctgtgatatgtgtctatatcagctgattgtcctttttgatggctgaataatattccatcttgtccacgtgatagtattacttgacaagctccctgctgatggacatttgtctttgttactatgatagtaatataatcaacatttatatatgttttgtatgtatctataatacacatgcacatacacatgcatatttctgcagggatagccatagtaaataactagtaacggtattgcaagttaaaggaacaatctcattgcttgaaattttaaattttgaaatacactgccaattttcatggtctctccttgtaagctagtttgggctttctcacagcatgacaggctcagggcagtcagaccatcctggccaaagagcagagtgccacagaccacaactgcttctaatcagccatcttcccaaagccttctcttttttctattaataactttgtatgagattccatcttaatacttttctgttgtttggtcttgtaagagcttatttttcctgaaccgggaagtggttcagggcggtttttctaacttcacagagctccctcttctgttagcttttgtgaaatggtcaaaaacatagcagcctgccttctgagttctccatcccaccctggttgggccttctctatccttgtctctgttgtttatatcctgctgaagtgtgattccacttgtggcagtttctcctctgtgtaggatcaaaagggctgtggctggttggtttgaaaatttcttataccctagactattccagtgcctttcagaagtttccaaggccctctcacactaatctattatcatattgggcaaaactccttgcagtttcagctactattccctgattgacttttcagtaaatctatctctcagtctttcagtatccaaagaagattggttctaggaccaccatcccgctgcctccacagataccaaaatcagaggatgctcaattccctcttataaaacgttgcagtatttgcatataatctgcacatgtatttctgtatattttaaatcatccctagattacttataatacctgatacaatataaatgctaaatagctgtaacactgtatctttaaaatttacattattttttgttgttgtattattatttttattgtatttttaaaaaatattttccatctacagtcagtagaatccacggatacagaacctatggataggaaggaccaactgtatcttttagtgttttgaggttcttgaattctcaggtcgtttgctttcctttgctttctcccaagtcttgttttacaatttgctttagtcattcactgaaactttaaaaaacattagaaaacctcacagtttgtaaatctttttccctattatatatatcataagataggagcttaaataaagagttttagaaactactaaaatgtaaatgacataggaaaactgaaagggagaagtgaaagtgggaaattcctctgaatagagagaggaccatctcatataaataggccatacccatggagaaaggacattctaactgcaacctttcgaagcctttgctctggcacaacaggtagtaggcgacactgttcgtgttgtcaacatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgaagatctcctagcctgtgcctctgggactggacaattgcttcaagcattcttcaaccagcagatgctgtttaagtgactgatggctaatgtactgcatatgaaaggacactagaagattttgaaatttttattaaattatgagttatttttatttatttaaattttattttggaaaataaattatttttggtgcaaaagtcaacatggcagttttaatttcgatttgatttatataaccatccatattataaaattgccaagtacctattagttgttctttttaaaatatacctgcaaagtagtatactttctggcccctgcctttaaggaatttaaaattcaagaaagccatgtggaatatataaggtaagagacaataaggggacctgaaccttatgggggaataaatatggcatgaactgctgtgggattaaaagagaaaaggaaagctggagggtctggaactaaacctggggttcccattcctcctactgtgtgctccagattctctcatcataaagttagaattgagctggccatcaggaatagccagaggaatatgtcagcttttgtgttctccctaaccttcccacgttatttgggggatactttgctcctcgaaagatttttaaataattatgtgccccccaccatccctgcaagcttaagggtgagaagtcccatttacttccatgacactattaagcagcaatctctttattctgctcatcatgggacagccaagatgtgtgggtatcttaggggagctgtgggtccctgtctgctggcatggcacaggcatcagaggaagaagaacctttttataccctagccatctggttagttttctccctagtttttcaaaaaactaagcctgcttccagtccccactgccttgttcatacagaattccaggaatgtcctgtccagttttctgttgctctgcattgcggacgccacatagttcctaaagccaaatgaaagaggtgcagcagtttaagtccagtttcaaaccaagcaaaaagccaggaaacataggagaaagggaagtttaggtgggatagagagggcattaatttttcccagggcttacaccgggaaaaaatcaagcttttctaggagctctttgggcacctggtcagcatggactgactggttaggtttttgtctttgtaccaaaactcgggaacttgggttatagtggctattactgccattagcagttgctgtttactgagaaattctaatgaaataggcactgtgctgagatcccacatagataatcggatttaatcttctccacaagcacccctcaggtaggcacaagtacattattgccattttacaggagaggaaactaaatctcaaagaaatttagtaactgcccatggtcacataatgatttcattcagtctctagtgaatggagattttaaaaagaagttcaaagagaagcatcataaaagtctttatttgtatctaggcattttttcctagagcagtaaagaaatctgaattccttttaaaagaagcagctttcaggagaagtaatctgttcattaagagttccagagaagctactattgtgtagacaatgaactcagggctcccccttccagttcaaagtggataacacacacacgggctatgcaaacaagaaatgtcatcatggggggcctgctgccattgactcaaaccagtcaagcccccctcaagcttcatccttcccccagctctccacccctgctctgccaaaagcccttctgtagccgaactcctctttttcctggagtcaaggacaagatcagcaagtagcaatgcggagtccaggcagtgtctagagcagccaagaggaaactaaagaaatctctctcagcaatgggcccctattgtccactgctttctctgagctgaactgctaaactggcccagaaactggcaagttcttgaaaagacctgctctacctccgtgttggggcaagaatgacaggagagaggccacttctgcagaattagaaatactgtatcacagcttagcatgtcaacccatccagaatgccaaaaataagtccataaccagtagaagataagtaacaattaaaattaattccaataaaaatgaaggcaactagcccaaaggtgcacatttgcatgtgctgaaccgatgactaggcatgaggaataaagtaaaataa

SEQ ID NO: 15553 - DNA, 193555 bp, Human
  misc_feature (1)...(193555): n = A,T,C or G
acattatctttattatataactctattaaaagttagggaagtgtcctctgaaattatcaattctcttgtttcttactagaaatataagaagaaaaaaactgaccttctaagtttacttatccaatagtggagagcttggtgcaatgaacactgacccattttccagagagaatattgtactctcaaaaatttctctttcttgtgtataaactcttgcagttggtatatttgcaagatggggttcggtaaatctgaaaacacactgtggaccaggagtaattacttttcttccagcccatacttacgtgttaccttgacctacatcccttctactattttgcttctgttctttcccaccccttaacctccactatgttggtcaggctggtctcaaactcccaacctcagatgatccgtctgcctcggcctctcaaagtgctggcattacacatgtgagccacgacgcccggccacttgtgttatctttttgttcccattagttaggatgcaaaaagtgacaacttttgctttctatgaaaatgaaatgagaaagaaagatatctggtgtctggcatgctatgtaaaacaattgtctacttatttatgttattatatttacatcctattatgcgcatctaggacaaagatagtttcctttagtttgctaggaatcagcaaagaacctctgaaggcaccttggaaatttgaactttcatgcaaaaaatttttaatcaaatcgaggatgttttttcaattgtgtattctcattgcatatgatactactcccaaggatgtagaagttagttcttgggagtgggaacaaatcttacatatttaaatggtttgtggcccttcaaagctcaacctatttaacaaaatcttattccttagtttttttttttttctctccattgggttttcttgtgtatcacatgagaagcactgacattgagttcatggaagatacacaaaaggtataaaagttcagcattacaaacctatggcaaatgggtagctgtgattggagtactttccaagatgtattagatctcaaagtcatatcatgagaggtgtcctctgcatacatatggtttgtcactggccatcttatagatattgcttatgtttgatccttagcatttctgtctgtgttgtgggctttgaaatgaaatataaataatttatattttaacaattctactgaagttgttcaacacatctatatttaggtcaagaattgaagaaaaaattcttcacactctctaggtgagtatctagcagctagtgaagttaaaaattttctcacatgcaacaaaattaaaagttaagtataataaaaataaatgataaaaatattttaaattattaagtctttatcagtttcaaataattcataaacattcattacttagctgtataatgtttatctagaaacattagataatgtttataatttgttaaatttcttatgtaatttaatacattacaatttatatcagtaaataaactatattgaagcccacaagcaaatttagttataaagttaagttaaatttgaatagcgtttaaatttaacttttatcttaaaattttcatttggttatttttaaacttgcattgaataaaatgattaaactttgtactttttgagtatagagatatacatatagtacacaaatagatagatattatatctgtgttattaaattttcacggtgggttcaattaggaaaaaaaatctaaaaagtctctgggaacaagatgggggagacaataatgaaaaacaaaatggttgagaaacacggctctaaactcatgtaaagagttcaagaaggaaagcaaaaacagaaatggaaagtggtccagaagcattaagaaagtggaaatcagtatgttccctatttaaggcatctgcaggaagcaaagccttcagagaacctagagcccaaggttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaacatgaaacaattcttattgactcatataccaggtcacgctttcatgaattctgccatttcaaagactctcacttctgctataactatgaccatgctgataaactgatttatctatttaaatatttatttagctattcataagatttaaattatttttgttcatataacatcatgtgcatctttacactgtggttagtgtaataaaacatgttccttatatctactcaattcattattttatgttgttcattaaacttttactataggaacttcctgtatgtgttcattctttaatacaaaattcctagcctgactgtgcaacctgatgagagaataaagggtataatttatttactcatcattattatatgagagatgtaagtaaaaatgacctttctctaaaccaggttgtatgttgtactcaagttataaaggtgaatacaataaatctacttcctactctcttgcatgtttgatttttgtatggaataaaactaaaaatagtaatcatacttagtatcagttatcctgaatactataaggagaaaaaggaatgaacaatgatttctttcggcaggaggtaaactgaaacatgtgaggaaataaaaataaacagatatcctctataagttgactgatacaacatgtggtagaaactgtctattgccagttggatatgtgagtttgcaaattataaggaatgcaattgctgggagttcatatgtggcaagcaaaatcccagaaatgaaagtgctcatgtgtggagagagtgtagacagagaaaaggacttaaacgtgattctaaggaccttccacctttaaagggaaggaagagaagagccacaaaggaaacagagggatggacaaatagagacaatggtgattaatatggtctggaactgtgtctctgcctaaatctcaggcagaccagcctctagaatgtatgtgtgtgtgtgtgtgtgtgtgtatgtgtgtgtgtgtgtatatatatacgtacatatatatatatacgtatatatatgtatatatatacacacacacacacatacacacacacactatatatatattttatatatagtgtatatatataaaacatatgtatatatgcttattttcttattttataaatatatggttattattttcttaattagtgcatatatatcagaaaagggactgggtgcagtggctcatgtttgtaatctcagcactttggaagccaaggtgggtggatcacttgagttcaggggttcaagaccagcctggacaatatggtgaaaccctgtctctactaaaaaccaaaaatttggccaggcatggtgttgggtagctgtgatcccatctattcgggaggctgaggcaggagaatcacttgaaccccggaggcagagatggcgcctctgcactacagcccctgggcaatagaacaatactccgtccccaaaaaaaaaaaaaaaaaaaaagaaaagaaaagaaaaaaaagaaaatgagaaaacagaaaagggaatgttctcttctctcctcaatctccataacacataagaatctaaaacgcagaattcttggagtattctggagaaaactgaaaaatagtcacccttcgtactgaagataagtctgatgtgtatattcagtcaggatacggtatcttacaggaaaatctggaagagtttattttcttaaacctaagtgaaatatacataccattcatttgctgattccgatacccagcacagttctttccttcttccccagcttttctggatctcattttcactcctattgaggctcaaaaataataccccaaagtgaagttctcagaagcagcttcagaagcaaagtttctctctggccttctcctgccctgctgtttgtcacgcctcatctcctgagggagacccttttccccaaagccagccataaaatctgaaaatatgactctaactttccctcacctttgtgtgtaagaactgaactggccataaagaaattctctcacctgccttgtttgattgtagatactaagacccccattccaaaaagagctctgccacatacccaagaggaaggaatggtgtatggaggggccaagaagtatctgaccagaaaggccttgttgggtttcccctactcagaatattagcattagatgatgccctttttgtctaatcacatttctacacagctggccattcttcatggaacataagcataaaaatggatagttttttcctgtactttgggtcttcattttgaaggcttccgtagttatataaacctgtgattaaataaatgtgttatgcttctctcttgttaagctgtcttttgttttaggcgtgtgagctgtgacccttttgataggaaggaaagagatcacactatttctacccctatagttgtggtgatgaagatgggatgcctgaagcacctgactcacctactgatgaggtccaggtaaaatgctgataaagagcttgccagtaaaggtaagaatttttaccaagttcagttctgaatttctgcttgtagtgtctggtcaagaactaaaggtaaaaatttatctttatttcttcctttccaaatgcaggtcatcaggagaagatcatttgtttgaattgttctcttgtgtaaatttggatttatgggacccatgtgttattgatcctttcccttcaatagacagctgtcgttttgctgttttgtgtcctgagaacctgacttggcttgctgcctatcaggatgcccttcggtgtgtgcaggaggccaaaccaaaagttggaggcgcccattaaaagtttacatattgactattgccagctctcgaggtgtctaaatatttctttcttgcggcgatctttagaggtggctctgaattttgagaggactgcatcttggcatttctttgaagatgtcttatgcatccttggtgaagtcaaaaaaggcttggttttggtactgagtcacttggtaggtgtctttgttttaaaagaaaagagaaaaaagaaagtttcaaacattagaaatatgggttgtttgttcttgccgaaatccggtaaggggttttaaagtaattttaagagctctgtattcaattattagcttaatttaaagtgggtatcaaggctaccattttttaagggtctttctgattttctccttgggatcttgtttatcccatggaaacattttttctgtaaacttaagcctttttaaattatatatttgaatcctctgtttgcttcctttcttgtaggcaggatttttgcttaaaaaaatgtaaaacttcattggccttttgaagaagcttaagatctccccagtctggctcctctaagacttgttcttctatttacttctgccattttcagtcgttcatctagctctctcttatcattgacaagcccctgcctctgcatttggtggtcagtggatggaaaattactaagcagaaacatcagagttctggctaccacataaagggttgtagagaatacttctagaaagcctgggactcctcgaagaatgcaaataaaaaagagagagagagagaaagtagccacagatgccccactacatagagtttcctgtcttcctcatgaagccccaagagtcatgggtaggtccttctcatgtctggagctctgctctcccttgccgtgagttccctgatctctttggcttttggggtatcaagggtaacttcacactgtgagagagccacctacctgccaagaccagagacagtgggaaagtctgttctttgtataagtctgtctccttccagcacctttttcttcagagctaaaaagaggaactttcctggaaacaactgacccaaatactggaatgagcccatttctttaattttcatatcttagagagggaaaatactcccagcttcaggcaggacatgtcctctttggacaatgtgcaaccctggggagagaaaaggtcaggatgtgtcccctgcttccagcctgtgcagcctcccagggtctcctgactcatccctccctctacttactgcaggtcacatggaggtgagagccatcccatctgactgtggcacttcaagggaaatcaggaaaactctcctgtttgaaggcacattaactcttttgagtaagttgtcagttttacaaatttattcctcctatcagataatttctgtcaactttataattgagaaagttttcactctccctttgaataaggaatgagcttgcatcaattccaccttgattcaatagagagaccactgacataaataaaggaacttcagagaatgcagtgattgccacaggtgtcaacagggtagaatagagaggcatcttggcaacattgcaactaaggaagtaataagaaaatgtgtgtgaattgtgcaggtgtcaattgctcagctagcagggcaagggttcaatttagcagggatctgtcagctgtctgactcaggttagaggtccaactattagattatttctcttctattcccgagttagagggccatagttcacatattaaaccatttttcctttcctcctccaccacttatagggaaccagtttaggggcaggacaatgggaacattttttgattcacttggttctgtcttttgtgaccgccaaattagccattcaaatattagaaccccttctattcttgggtaactgattacatttttaaggtaatttttcattatatttatattatagtttatactatgtttatattaaaagttgtgatttggcatcatattgtcaccctgccctgataaatctctatagccatatctcgtttcatatctcagagtttttaagttgttatatataatctacagtactggggaacccagcagcaggtctcgagatacctaggcgagggcgtggtggggacactgagtgctgggccgctggccctgccctcgtcccactgaggagacaggtttactgctcccaggcccacctccacccaggaacatctagtccacctgagaaaaggtgtggggaggcagggatcagtgcccagtgcccagagagacatggcgaggtatcaccatgaagcaccctctggagatagtcatgtttttcaagcctcagaagcaagagtgtgcgtgtggccttacttccacccttcctgccaggtgagtcatgagctgtaggggtgtagaccctctgatgtccagtctggcatcaaaatgcagtaaatgaagggagtcctgcctatacctctatgtccattgagctgataaagaatgcaggagctcatctgtgactctgtttagaagcttcgaagttctgagtccttcaggaagagactgcaccaggcacaggactctcatttgttcaaacaatgaaagtgcacatcatgcactggaataagctggaagagccagcagcagcctgagaacgtggaaggaggacagagatgtttaaagcatagacatcagtgtcaggtactcaggagacggaataataccaacgagcagcattaagtcaactgttcagatcattcctatcagaaggagagaagattaaagtggatgctgagaacagagttctgttgagctgtggccaacatcagtgtccatggcatgggtaacagggacaccacagcagcctgcagagtacagcgagggatgagggttaacccacttccagatgcaaacttttgttttctccctagaacctagcacgtcatcacagtgcagggaaaattattcatgggaccaatgcagtccaagggatctcttaaattctgctcacaatgcagcctcctttaaagaccaacaatacgaagacaattcttgaacagaagggtcgcaggaagaccctccaataacgtcatttcattctatgtcatttccttgtaacattgatgagagaagaaactgactccccaccagggccttgtctgtgtggagtttgcacattctccccacgtctgcatgagttttctccaggtacttcagtttcctcctgcatcccaaatatgtgcgcgttaagttaattggtttgtctaaatttctccagtctcagtgagtgtgtgtgtgtgtgtgagtgtgtgtgtgtgtgtgtgtgtgtgtttgaatgtgccctgtgattaaataacttcctgtccagtgggggtttccaccttacaccctgatctgtgaggataggttcctgccacccttgaccctgaaatggaataagtgcattggaaaatgaataaatgaatgaatgagtacaaatgattgcaaaacaaaaattcacaaagcatatgacacttatacagatgcacaacaatgcatgaaagtgctcagcgagcccaccatatttgtttctgtttgctttggaactgcttggttgtaagaggtgttccttacaattttcactttgtaaacatttattttttgataaaactttctactactatgacaggaaaatatcatttattataatgccaaccatagacaaccatacacagccaaagacaaccatactaagcaatgtggctgagtttgtagttaaagccagacttgccttggcaagcagccctttaaaagcattcgttttgtgttgcagttgtagcagtgagacagcaaaatacctaacataacgaactccattttgtttatggggcctacacccattcctgcacatagattgggattattttagagcactgagataatgtgcaaaaacaacagtcatgtagtttttaaaactaactctggtattcaagaagaaggatgtaaacaactatgttttgttaaagactgtaggagcattgtgacctgaccaagaacaaataattttccaaactccttggaccctcgctggtgcccagatgtctactgttgaaggtctcctcttaatcctgacgccctcctcttctgctagcccttaacataaaaagagcctaaaattggttctgtcttaagatggtatttatgatgctagtccaccatcttctcagtttgctggctttcctaatgaacctgcttcccccgaccccagcaactatcatctcttgagtttggttttcgaggggtgagcagctgcacctgggttcagttacactgtccaggaatacctgaagctgagtaatttataaagaaaaaaatgtttatttggctcacaattcttctggctggaagactgggcaactagtgaaagcctcaggctgcttagatgctatatagtttagatgtttggtggggacaacttagatctctatagtttacatagtaagcagaggttgatggttattagtgaatgagcctctctagtgtttttcttcttctaggatatattcattcaggttcatgtggttatgcttccctgggcactcaagattcgattaatatggacaaggccctttctttcattaatttattttatttttggagacagagtcttgctctgtcgccctggctggagtgcagtggcacaatcttggctcgctgtagcctctgcctcttgggttcaagcgattctcatgcttcagcctcccaagtagctgggattacagacatgcctcaccacacttggctaatttttttttttttttttttgtatttttagtagagacggggtttcaccatgttggccaggctggtcttgaactcctgagcccaagtgatccatctgcctctgcctcccaaagtgctgggcatctggtgaaagccttaggctgcttagatgctatacagtttagatgtttggtggggacatcttacatctctatagtttacatgtttgatggggaggctgacctgtgagtcctgaaggagcaaaaaatcagagcatgtactgctgggctgtcctggaaattgttcattgctttttctttattcttaatacataaaaaaactcaagagtaaaaaaataaattggcttccaggagtttgtagttgatgggttaatagagttgttttagtatatttttgaatacatcactaattattttttcacttgatgatggctcatgcctgtaatctcagcactttgggaggctgaggcagatcactagaggccagaagttcgagaccagcctggccaatatggtgaaatcctgtctctactaaaaatacaaaaattagctgggcatggtggcaggtgcctgtgatcccagctacttaggaggctgaggtatgagaatcgcttgaacccaggctgtggaggttgcagtgagccaagatgtcgccattgcctgagcgacagagtgagactctgtctcaaaaaaggaaaaaaaaaaaaaaggaatatatttagtctacttttccttagaacttaaaggcagttaattcaattcacttacaccacaccccctgttgctctatacagcacgagcaaatgtttggcattcaaaatgaatctcagaatcctttgtcatctcaccctctctgctgtattgattttatgccctggtctctccttggttgataaattcatatctatccccccttcctttaatgggtccttccagtcaagccattataatgattctccctaaggtttcgaccttgcattattggtgtggtcagaatagttcatccctgcagatttatatttctctcccaatagttttataaaagagtataatccaaatagtgttattgagaggacagagatagtattttcaaaacatcataaaacagcctggcacagtggctgatgcctgtaatcccagcatattaggaggctgaggcaggaggattgcttgagcccaggaggtcaagaccagtctagacaacatggtgaaacctggtctctacaaaaaattagccatatgtggtcatgcctgcttgtggtcccagttactcaggaggctgaggtagaagtattgcttgagcccaggaggtcaagctgcagtaagcagggatcacaccactgcactccagcctgggtgacagagtgacacccagtctcaaaaaggaaaatcttaaaacagtggatggtccctattaggcctgcaataaatgttggtgttatcatttttgatattatcatccagattaaaatagaatcttttgggatcatccaattctcttccattaattcctggtttctcaaggctatgttttcattgcctgagtaaatttattaactaggtggagtctttaggcaaggctaatatgcattatcctgccagacaactttgttggttgtctagcgactgcagcctgcttacaggcttttgggaattgattggtgtgacttctcccttctgtctagagctgatcacatgtgaattatatgaaagaaagtcaagtagctggtcttggaaagctgaattcagtccattgacccaggaattgcttttcttagaacctctggcagatgcagccatttttctgcctttgtgcacctcaacattggcgttatgttttcactctgccagaggctctagtcctcaatttttgctgcattgaattttgctaacttacactttgcaattagtcaggggaaagtcacttcccttctttcactttcatgacagtcagaatggcttctgttttctttctgcctacaaacaactgtcaagtactactttctagaaaagttgaaacaagagacaagaaaaccacaaaatctggaaattataaagaaaaccactgcggctcttttgcctttcttttatttccctttgtttgtgtgacttcatagtgaattagaatgtaatgtggtagcagcaagacaaactttgcccagtaaaccactacgttaaaaaggcgttctaaaaattcatttgttgttgaggtttaaatttaaaatgaagaatcacaaatcaatcagtaaaggaaagatggctatgactgtttaacatgatagcatgggagctcactgccctgcacgatcaaagtttcacatagacagaggagcaaagaactttaacagatcacgctgaactggtgaacaactgagggtcaccattttctgtaatatgagcctctgaagagaaacattacctttgagtcttttgtgcctagctcagaaatttcaagcataaaactgttccatagtttaaaagagttgaagatagcaaaacagttgaagaataaaagctgtacttggcaaagttaaaattatttaactactaaagataaaataatcacaataggataattcctttacctacttagacaaaacaaacctttgcaatcagccttctaggggtgttgagacttttggtacctaggatctgggtcaggagatgagggggtcaccactgggagcaaatactccttcacacaaaactctaggggcaagagcaagggtcaggggcatttattattttggcaacaaagaagcaaggccctccttgggaaaagagttccaaaatcatcaggatttgatgagcctacacttacggaataacttgatgtgataaataccttgtgagtgatgtgatactaaggaaataacattattttgatattaaaatttccacacccacatgcacctgaaaaaaaataatgaaattcctcttaggggtattggtaaagcctgagaagtgctatatttctccagtaacaaaataatggactgggtcgggtagctcacacctgtaatcccagcactttgggaggctaggcgggcggatcacttgagctcaagagttccagaccagcttggccaacatggtgaaaccccgtctctattaaaacacacacacacacacacacacacacacacaaacacacacacacaaacacacacacacacacacacaaaattagccaggtgtggtggggcatgtctgtaatcccagcacttggaaggctgaggcatgagaatagcttgaacccgagaggtagaggttacagtgagccgagattgtgccactgcactccagcctgggtgacagagcaagactctgtctccaaaaataaaataaattaatgaaagaaagggccttgaccatattaatcgaatcttgagtgcccagggaagcacaaccacatgaacctgaatgaatatatcctagaagaagaaaagcactagagaagctcattcactaataaactaattccattagtctatatgtctgtttttattcaagtgccatgctgccttaattattgtagcatcataatatgtttcaaaattaggaaatatgagacctcttgctttgtttttctttatcaagattgtttcagcaacccagagaccatgacgtttaggatatattttttctatgtctgttaaaaatgcctctgtgattttgatagagattgcattgaatctgtataacactttggagagcatgcagattttaacaatattaagtcttccaacccatgatggatacaagtaaatgtcttcccatttatttttgtcatctttaattttttcagtagtatttggtagtttctagtgtccatgtctttcacatcctaggttaagtttattcctaaatattttatgttttttgatgctattgtaaattagagtattttcttaatttcctattaagattatccactgttagtatatagaaatgccgctgatttttgtttattgattttgtatactgcaactttgctcaattcatttataagttatctctctcttttctctctgtctccctctctctctctctctctctctctctctgtgtgtgtgtgtgtgtgtgtgtgtgtgtgtgtgtgtaatctttaggtttttctacatataagaatatgtcatctgccaacagagatcatttcactttttcctttataatttggatgcttgttatttatttttgttgcctaaatactctggccaggatttgaaatactagttgtaagagcacattcttgcctttttcctgaacttagaataaaaacgtgtaatttttcacagttgagcatgatgtttactgtgggattttcatataatagcccttatcatgttgagttaatgtccttctagtcctagtttgttgagtgttttttttttaatcatgaaaggatattgaattttatcaaatggtttttcagcatcaactgaggtgatcatggtttttcctcccttcattctgttcatgtaggttactacattgatttatttctgtgttgaaccattcttatattccaggaataaatcacatgtagccatgttatataatcgttttaatgtgctgttaaatttggtttgcaagtattatgctgaaggtttttgcatcaatattcatcagagatattggtttgtagtagttttcatatcatgtccttcactgaattttatgtcaggttaatgcaagattcataaattagtttggaagtgttccctcctcttcaatcttatggaatagtttgagaaagatcctgttaattttttgaagttttgatagaattctctagtgaagccatctggcccagggcttttcttttttcagggatttttaattatttattcaatcccttataggtctattgcaaatttttatttctttatgattcagtcttggtaagttgtatgtttctaggaattcatcaatttttttctaggttatacaatttgctgaagcataattttcatagttttatgaccttttatttctgtggcatcagctgtagtgtctcctcttatattcttgattttgttatatgagtatactcttttttaaaaaataatctagtaagggtttgttgattttgctgtacttttcaaaacatcaaccctagttttagtgattttttttataattgctcttctattctctattttatttatctttgctccagctttattgtttccttccttctgctagattaggggtttatttatttatttgcgcttctttttttagttacttaaggtgtacaataaggttgttgtattagtctgttttcatgctcctgataaagacatacttgagactgggaaatttacaaaagaaagaggtttattggacttacagttccacatggctagagaggcctcacaaacatggtggaaggcaaggaggagcaagtcacatcttacatggatggcagcaagcaaagagagagattgtgcagagaaactcccatttttaaaactgtcagatcctatgagacctgttcactatcagatcacatcttgtgagacccatttaaaactatcagatcttgtgagaccgattcatctatcagatcagatcttgtgagactcatttaaaactatcagatttgggagacccattcactatcatgagaacagcatgggaaagacctgcccctataatttgattatctcccaccaggtccctcccacaacatgtgggaactatgagagctacaagatgagattggggtggggacacagaacaaaactatatcagttgttgatttgaactctcttctttataagcttttatgtctgtaaatttctcacttagccctgctttcacttcattgtataagttttggtatatttggttttttagtttattattttctaatttctattgtgttccttcttaaatttttctcatttagacatacaaatgttttatttctgtctctgtgcattgggatgtgaaatcagacgacttttactttctaggaaagtgaaatgagaaagaaagacacctggtgttatgaggactatatagaaacattgtacatttcagttgtttttgtcatatttacatactcttattgacatgaaatgaagatgaaaataaaacatgtccaggagtggcaaaacaaatttgcatagcaaaatatcacatgaaaagggaatatacataagtccccagcacaatccaggtaaacaaataaaaatgttccagcagggcatggtggctcaagcctgtaatcccagcactttgggaggctgaggcaggcacaccacttgagttcaggagttcgagaccagcctggccaacatggtgaaaccttgtctctaccaaaattagccaggtgtggtggcatacgcctgtattacctacttgagaggctgagtcatgagaattgcttgaactcaggaggcagacattgctgtgagctgagatcttgccactgcactccagcctgagagacacagcaagaatccatctcaaaaaaaaaaaaaaaaaaaaggttccttttccagtgtttgatagactaagaataatagcttaagcaggacggtcctgcattcaaaagctatgatgattaggttaaactctaaaatccaataaaaatgtgttgactggattaccttataaaagttattaatttttgcaagatacatttttggaaagaaagttcatttactatggaaattcctgtagccatttcagaactctgagcattttaatgatataaagagtctaagttaattaatgatataaagagtttaagtaaatcactaaaaataataaatactaaaatgcatttagtttatttaaaaaactgatcctatctcatctctatcctcatatagacatgttgattttatactgttgtcatctaaatatcatcaaatgatttaaagcctagatctctgggtgatggaaaaatgaagtcccaacaatttatagttcacacacacattctgggaagttggccttattaaacaacggcaggaaagttagaagattgatgacttggggatcacaggggtactacccacaaaatgtagtgtaatttgttgtctgattgctgtaagctgtgtgaatcagggagagtttgagtttggacatttggctcgatattatgacaccaggctggttaatttatattataaaatgtagagggcaatttagacatgaggtcataatatagtttaatatagtgctacgcaaaggctgaaaattatgttgtgcttgcatttgaattcccagtgccgtatataccttaaaggaattagatatccagtgggtttggcaatacattctataatcattattgacacttagtaagagtagagtggaaatattagccattgtctgttataatcctaacaaatatggccatgatggaaacaaaatagcttggtcacccatgaatgccttctagtataaagagaaagtatgataaattgcttcagcaaaaactatttcttgaataagtacactaggcctggtactgaggataatgcagtcaacagaacagagtccagttactaaagagatgatttgccaaagatgattccatacttaccattttaagagagggaatctataggtctgaggcaacttaacttgctatgaaaaaaaaaaatcccagcgctcaggattggagttgtaagttaatgcttaacatgataatatttatccagttatgaatttaggacaaagatggtttctctttgtttaatagaattgacttggtttagaaactataaatatatgttgaggaatttgaactttaatgcaaaaatacaaaaaaaataaaattgatgatattttcaaagttgtgtatttctattggagatggtattgcccccaaggttgtagaaattagttcttgggggtgtgaacaactctcagatattacaatagtttgtggtcctccaaagctcaattcttacataatcttattctctagtgttcactttccttattgaattttcttgtgtatcgcacaagacatactgacattgaattcagtagaaacagacaaaatacatgcacaatcagtgttataaatctatggcgaatagatggcttactggaggactttctttccatcatttgctgtgattgcctttcttccagatgttgcttatgtttgagcttcagggattctgagtattaggtagactttgagaattaaatacaaatcatgtatatgttattatttaattctactaaatattttcaacacatcaacagttaatgtcaaatgctgaaaagaataaaatgctgacactctggatgaatatgtagcagctagtgaaattaaaaattagtttattttttaaagcaaaattaaaagttaagtacactaaaaatcaaacttaagaaaacaatttcattttttacctttaagaaacttatgcatgtcatcatgtttgtattattatgtatattactaatacattcttaatttgcaaatttgtttgagataatttatataaacaaatagagtgaattaaaagttgctgctcagagttaagttaaatgtcaaatttttaaaaatttaacttttagttaaattactttgccattcctaacagatcaagaaataataaaagtaaactttatgctttttcttttagtgtgcaaagtagacatacatacagtacataaggagatatacaatatatttgttattaaaatttaataaaaatttaatttcaattaagaaaaaaatttcttaaaagactctggaggcaggcaagagaagggagtgtcaataatgaccacatacacacacaaacacacacacaaaactggttgaaaaactactctatacccatgtagagagtaaataaatgaaagcaaaatcagacgtagaaagtaaattctgaaaatggaaactagtatgttccctatttaagacctacacataaagcaaggtcttcagagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaacctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgccattttaaagactcttgtttctgctataaccataccatgagttgaatcaaacgcgtcaagtattttcaagtgtgttaagcaacatcgtgttcagttgcacaggaactagtcccttacagatgactaagctgatggatctatttatctatttattaaatgtatatttatttgactataatatttaattttttgcccatataaatgcataaaatgtatacctttatattgttgataacataacaaaatatattttctatgtttagtcgatgtattattttgtttagtttattaaatatttactatagaaaacttcttggatttgtttattctctaaggagaaacaccaagccgattctccaacatgatttaaaaatgtatggttcaattcattgattcattgttattatactcaagttataagtacagtacaaatttacattctataagccagcttgtaagttgacttcaggttatagagatgaagatacaaatacacttcatgctgtcttttatctttctttgtgtagggaaaaaaacctaaaaacaagaataatcattaaatctgttagataaatgatataagaagaagaccaaaaaacagtattttttttcagcagagctggagtaaggcatatcaggaaacaaaaacaaaagcagcagatatcttctacagttgactggtagacacataagtgcaaatgtgcactggcaatttgatatttcagtctgcaattttcaagcaatgccgtgacctgaaactccaggaacagcagtggtcatgtgagaagtgtttacagaatgacaaaatgactgaaaatttcctcctgcaactttcaactttaaagggaggaaagagctacaatggaaacagatttggaatggccaaatattagaaggaaaagagagaatggtgataataataaatttaaaggactaaaactgcttagaagaattgatgcattcatgcaaaatatagagtagattgaaactgcctggtaatttgggcattggtgatcttagtggaagttgattggtagaatcaaccagttgactgatagacttaatcagtagaaaccatacaggagtaggtagaagagtaaataagagaagagaaggtaatggcaatatatagagaaaacaattttgagaagtttgccttcttgctgatggctgatgtgagacctagattcttgtcttgctagttttaagaatttaaacaagagacacacggcggtggagatgcagcatggagtaatttattgccaaaaaaaagaaaacgaatattttgaaatccaggtgcagaatagacagtacaccctgagacagacaggattcagggcaggctgctagtaaggatgagaaagtaaagactagtactagggagactccttttatgggaatcttccatgattatccataaggaggtgggaagaggcgttactagtaagcatgttcttggttgtcctctgggtgcacatgtgcagtaactgcatatgcttgttgtaacaccgtatgtctcattagcatcttaaatcttctacccacgggtttattctttactattataatgagcaaagggtcactctgaggacaggtaaaatcaaaatgtgcattctctctacaggggaactacagctttgcttgaatgagttcaattacaatgttaatgctaaagcttattgtggtgatggtatggtcaccaaggttgtgacatcctgatgatatggttacttccttgactacctatcctgcctcatcatgaaatgaaggagagaagtaaagtaggacctggaaaaggacatgaattaatttttatatgcatagctttccatttttggaaatatgtatgtctatagatagatttcatggatttgattattgaaaaatcatactagtataattaatatttattttaaattatgacatatcaaattatttataatgataacatcattattttggttaatactatcttgactgtcagtaaactgctctatggattgaaatcatctactacagtagaaaaacagatggaattggtgaccttagtgaaggtgacttggtagaatttacaagcagaaactatattggagtaggtggaaaggttaaaaaaaaaaaaaaaagaaaaattcctattaccattttttggcctggggagtcactttccttctttcatgtttatcatattcagatttgcatttgtcttcctttctcttcaacatatccaaatgcaatgacaatttataaaaacattaatttggagaaagaataaaaggatgtattgaaaatgatagaaaataatgatatgagctctttatgtttccatttgtacttccctatgttggtatttaccttaagataaaatagaaagtaattcagaagcagccatacagcacttgaccagaaaaatatgaaaataaaaaaaagaatatatgaattgtttagacactgaaaccagtaaagaagagcagactaatttcatctagcagcattgctggacctcactgccttaaattttcaccttgagacagataataacaaaccatgaagttcagtagaaatgcactgactgactgatctagggacatttagtagttactacaatgtaatcttatttttcttttctatatttaattttattttattttaggttctgggatacatgtgcagaacatgcaggtttgtcacataggtaaatgtgtgccatgatggtttgctggacctatcaacccatcactaggtattaagcatcacatgcattagctatttatcctgatgctctccctccccatgccttccaatgttgtttcccttcctgtgtccatgtgttctcattgttcagctcccatatatgagtgagaaaatgtgatgtttaattttctgttcctgttaatttgctgaggataatggcttccagctccatccattgtccctgcaaaggacatgatctcattccttttcatggctacatagcattccatagggtatatgtaccatgtttctttatccaatctataatcaatgggcatttgagttgattctatgtatttgctattgtgaatagtgctgcaataaacaaacacatgcatgtatctttataacagaataacatatattcccttcggtatatatctagtaatgagattgctgggtcaaatggtatttctggttctagatccttgaggaatcaccacactgttttccacaatgattgaactaatttacattcccaccaacagtgtaaaagcattcctatttctccacagcttcgccagcatctgttatttcttgagatttttaataatcgccattctgactggggtgagatggtatctcattatggttttaatttgtataatgatcagtggtgttgagctttttttttcatgttttttggccatataaatgacttcttggagatgtgtctgttcataacctttgcccactttgtgacagggttgtttggcttttttttttcttttgaaattgatgtaagtcccttgtggattctggatattagacctttgtcagattgatagattgcaaaaaatttctcccactacataggttgtctgttcacttggatgatagtttcttttgctgtgcaaatgctctttagtttaattaggttccatttgtcaatttttgctttggttgcaactgcttttgatgttttcgtcatgaaattttttcccatacctatgtactgaatggcattgcctagattttcttcttgggttttttttttttttaattattttactttaagttctaggatacatgtgcagaacatgcaggtttgttacaagatgtacatatgccatggtgatttcctgcacctatcaacccatcatctacaataggtatttcttctaatgctatcccttctctaaccccctaccccctcgacaggccccagtgtgtgatgttcccctccctgtgtccatgtgttctcattgttcaactcccacttatgagtgagaacatgcagtgtttggttttctgttcctgtgttagtttgctgagaatgctttccagcttcatccatgtccctacaaaggacatgaactcattcttctttatggacgtgtagtattccatggcatgtatctgcctcattttctttatgcagtttatcattgatgggcatttgagttggttccaagttttcactattgtaaatagtgctgcaataaacatatgtgtgcatgtgtctttatagtagaatgatttataatcctttgggtatatacccagtaatgtgattgctggatcaaatggtatttctgattttagaactttgaggaatcactatactgtcttccacagtagttgaactaacttatactcccaccaacagcataaaaccattcctatttctccacatcctccccagcatctagggtttttatagttttgggttttacatttaagtctttaatccatcttgagttaatttttggataatgtgtaaggaaggggtccagttttcagttttctcatatggctagccagttttctcatttattgaagaggaaatcctttccccattgtttgtttttgtaaggtttgttgaagatcaaatggttgtagatgtctggccttatttctgagatctctattctgtttcattggtctatgtgtcatttttggtacaagtgccatgctgttttggttactgtagccttgcagtatagtttgatgtcaggtagcatgatgcctctagctttttcctttttgcataggattgtcttggctgcatgggctctttttggttccatataaattttaaactaggttttttctaattctgtgaagaatgtcaatggtagttcaatgggaacagaattgaatctgtaaattactttgagtagtattgccattttcatgatattgattcttcctaccatgagcatggaaagtttttccatttgtttgtgtcccctcttatttccttgaccagtggtttgtagttctccttgaagatgtcctccacatcccttgttagctgtattcctaggtattttattctctttgtagtaattgtgaatgggagttcattcatgatttgctctctgcttgtctacttttggtatatatgaatgcttgtaatttttgcacatcgatttttgtatcctaagactttgctgaagttgcttatcagcttaaggagcttttccgctgagacaatataggattatgtggtctgcaaacagtcaatttcacttcctctcttcctgtttgaataccatttatttatcttgcctgcttgccctggccagaactttcaatactatgctgaataggagtgatgagagagggcatccttgtcttatgctggttttcaaagggaatgcttccagcttttgcccattcagtatgatattagctttgggtttgtcagaaatggctcttattattttgagatatgttccatcaatacatagttcattgagagtttttaacatgaagggatgttgaattttataaaaggcctttcctgcatctattgagataatcatgtggtttctgtcgtcagttctgtttacatgatggattacatttattgatttgcatatgttgaaccagcactgcatcccaaggatgaagctgacttgatcatggtggataagctttttgatgtgctgctggatttggtttgcagtattttattgaggatattctcatcaatgttcatcagggatactggtctgaagttttctttttgtgttgtgtctctgccaggttttggtatcgagataatgctggcctcataaaacgagttagggagctggtaccattccttctgaaactattccaaagtaccattccttctgaaaccatcccaattttttttttttggaatttggagtggtgagagagggcacccttttcttatgctggttttcaaagagaatgcttccagcttttacccactcagtatgatattagctttgggtttgtcagaaatggcttttattattttgagatatgttccatgaatacacagtttattgagagtttttaacatgaaggtccaatttttttggaatagtttcagaaggaatggtaccagctcctctttgtacctctggtagaatttagttgtaaatccatctggtaataggctttctttttggttgataggctatttattactgcctccatttcagaacatgttattggtctgttcatggattcgacttctttctggtttagtcttgggagggtgtatgtattgagaaatttatccatttcttctagattttttagtttatttgcatagaggtgtttataatattctctgatggttgtttgtatttccgtggggtcagtggtggtatgccctttatcatttttttattgtgtctatttgattatcctctcttttcttctttattagtctagctagcagtgaattttattaaattttttcaaaaaacatctcctagagtcattggtttttgaaggttttgttgtgtctctatatccttcaatttcctttgattttagttatttcttgtcttctgctagcttttggatttgtttgctcttgcttttctatatcttttagttgtgatgttagaatgtcgatctgagatctttccagctttctaatgtggacatttagtgctataaatttccctctaaacactgctttagctgaattccagagattctgatatgttgtctctttattctcattggtttcaaagacacataaccatcagattctccaaggttgaaatgaaggaaaaaatgttaaaggcagccacagagaaaggccaggtgacctacaaagggaagcccatccgactaacagtggacctctcagcagaaaccctataggccagaagagaggggggccaatattcaacactcctaaggaaaagaatttccaacccagaatttcttatccggccaaactaagcttcataagtgaaggagaagtaaaatctttttcagacaagcaaatgttgagggaattcataaccaccaggcctgtcttgcaagcgctcctgaaggaaatactaaatatggaaaggaaaaaacagtaccagccactacataaacacactgaagtacaaagaccaaggacactataaagaaactgcatcaactaatctgcataataaccagttagcatcatgatgataggatcaaattcacacataaaaatattaaacttaaatgtaaatgggctagacgccccaattaaaagacacagactggcaaattggacagagtcaagacctatcagtgtgctgttcaagaaacccatctcacctgcaaagacacacagaggctcaaaataaagggatggaggaaaatttaccaagagaatgaaagcagaagaaagcaggggttgcaatgctaatttctgacaaaacagactttaaaccaacaaaggtaaaaaaaaaaaaaacaaggcaacgaagggcattacctaatggtaaagggatcaactcaacaagaagaactaagaattctaaatatacatgcacccaatacaggagcacccacattcataaaactagtttttagagacctacacggagacttagacttccacacaataatagtgggagactttaacagcccactgtcaatattagacagatcatcgagataattaacaaagatattcaggacttgaactcagttcggatcaggtgggcctgacagatgtctgcataactctccaccccaaatcaacagaatatacattcttctcagtgccacgtagcactgcctctaaaattgaccgcataattggaagcaaaacattcctcagcaaatgcaaaaaaactgaaatcataacaaacagtttctcagaccacagggcaatcaaattagaactcaagattaagaaactaactcaaacccacacaattacatggaaattgagcaacctgcttctgaaagactcctgggtaaataaagaaattaaggcagaaatcaagaagttctttgaaaccaatgagaacaatgtaatctgatggaagcaaaatcatcataaaatcccctgtggccagcttagaaacttaaagcataaaaagtattcagcaatttaatgaattgaattcaacgtagatataatccacatttggaaaaataaaattaattttgctattcaacataaaaattttgcaaaggataatttacccaacccctgcccacgctcacacactgaacataaatttttgctcctatcatctgaaggctatgaaaatattgacgttagtaccagatcaaaaaaagaggagatcactgctgacaacctagttcaatcacagcaacactctgctgtcttggccaattgactgtttgaaggacaaaagcaatcatcttccaataatgatgtgccaaaatttctcaattgtgatgagctgactcctgccagcacatttagagggagttagggagggttaaattggaagataggtggctgtgtgcacattaggccagagggtcagattaaagatgtggtctctaacttgaggggtaaggaggtgctggggaaagaataaaaatgttgtggttcttgggattaggattgatatacccacatctgacttactaccactgttcgtagaaagcagagacatcaattaggcaaggtaaagaaaagggcccaaatatcattttccattattctgaattaattattggaacacagatacatcaggaatgagagtactgggaaaagatgagaacatcattagacttagagaacaggcaaggcaggtcaggggagacagcagggcctagggcttctaaccaaaggtcacaaataatttatctgagtgtgagagaggtcttcagagtaaaatcccaaacattgtgattcagggttatgaattggctgatgaagggagttcagcacacttgaacaggacagcctttcaataccttttcatcagccacttccccatcccatctcaggtgaacctggggacaagcttctctcttgtgtagagccaacatggaaagcaatggcgagcccctggaaaaactttgatctgatatgtacacatagatagatatagataaatatagatatagataggtaaatatagattagatatcaggttaataatagctatttagatagatgaaatatatatatatgtattggcttggatcccactagtctttggaaatcttaagctatcccaggaattttttctagcacaattgttttttaaaaagcaactcatttttgaaagcataacacacagaatgaaagtatacacgtcttacgcacacagtgacatggttcctcacacactgaatacattgtgaaagtagcagcatgtcagaaacagtttgctcaggacttagaagcctctctagtgctctgtgccagtcagtacctaagtaagaccaactcttctgcctctgccctggggatagacactctcgcttctaacagcagtgattatttttgctaggtagtttcagccatttcgtatttattaatctgattgttacaataatcctatgagatcaatactattattcttcccatattacagacgaggaaactagggagcataatgttcatggtacttgccatggtcatattgctattaaatagcagagctggaatccaaaccaggaactctggctctagagtcataccctttagtcactaaattgtgctgtctaaaatagcatggcaagctcgatcaacagtctgaatcaatacaattagatgtgtttagagaaataaccactaaccaccacatagcactttgtagattgttctgcacataccttttgacttcctcctacttacggctcagaccctgtgagcaggcatctatctctgagggaaaaagacttgcccaaaggccacagctaaaaaggagaatatgtgagctgagaacagtttggggtctattattttcttcaccatttcacaaaggacaggagaaaatagaccaagaggatttcatgagtaatccttttctccagtgaggccagctaggcactctggacatggttggtgctaaacttgtaagaagtcctattcaggcccgtctctttactgaagatttatgtgttactcaacccctcagaatccttggggtacctgagttcttcactgcacttatgcaggtgataggaggtctgtctgtgacccagacagatgccacaggcaggtaagacaataattgaggaaatgagtgaagcacagtgagtagggcagacgctgtgagtttgggtctccaacagggtaacttgtgaagaagagaaagaaagaagaacctacccgatcctgatagcccccaaccttggggaaacatgatatccactgagtgcatgaagttttccatcagcacacctagactcaaatcctaactctgccaatcacttgtgcactctacgtggatcaccttttctctcagcgtcctgctttcttcattgataaagtaagcttgatagtattactatttacactgtaactggtggattaaaacatgtaacatattatttattttatagatggcacataataatagattttttctttccctgttctttcttaacactgatgaaagaaatcaaaaacaatgttttcttttaatgccttcttagtattgagtgctcttgtcaattctgcattcatgacaaacaacaaagtctaacttagatacattaaacacagagaaaagaacactgtacatacaggtagaaccagctatgaatcctatctctgcccctcaccattcactaaatggatgtcttcaagacatctcttatcaatactgatccgcagatcactcctcatatcatctctgctaagagagaaatttataaaatgttaccaaagtatgagtgggtttcatgactaggcagtagagaataggaaaccagtgaatcaataaactcacaacgtggtggtttgcagacattctctgcatggcagctaaatacacttccctagaagcatccccatctggtcagagatggcctttactacgatggccatccttgtccagccttacttaggtttcagtatttttgcacaattagcatccctggtgtacgaagaatgtgataaatgagctctctgagcagtcatctacactctctctgaagagtatttggattttatttatccacattaataaagagagcccatttgtttgaaagaaagaagtaggatttcaaacgcattttccataagttttagatgttctcaattgtctggcaataggagaaatgtaaaggaaaataacagttatatgtaaacaaaatcgagaaagttgcatcatagggaatatagctaacatctacataaagggtttatatatacttttaagaggggcgtataaaagcataattcataagaacaataaaaactacaattaatgccataaaatgaaatctaaatagaattaagaacagcaagtgaagcaaatggaaaggcattatagcccactagtactcaaaaactattaaacaattattcttgaaattttagattattaaataagcagtaagacaatatagcctatgaaataaagtattaattttatatgctttgtgccattatatccattccctgaaatcaatcctaaataaaagtttgtaaaaaggttacaaaattatatccgataatacaaacacacatttttctccaggtactaccttcttgctcttcttccactcacagataaacttctaaaagaagtttccatccactgtgtctccaacctctcctgctatttactctagtcaatatattccaatctggattttgccaaattaattctggcaaaccagtcctttcttttcctaaatgtaaaacgtcatgttttaaacacatttcttcccttaaacaccctcttatcacaattttctcctggttgtcctcctattttgctcctggatgtcctcctatcatttcattcacatgcccttttcaggttcctcactctgttcactacattaagatgtaaaggtcctcaagatccaggttttggtcttctgattcactactcaatttctaccagacctcatccatccttgggccttcaggaaaaaggtatagcccagctcccaaatgaacatctctagccatgcactctaaattccagaactgtgtatccaattttcaaggcttaaagtcttccagtttctgatgacaaaaaccacttttcttttgcctatggtttgagtttatgatagagttgaaattaattaattggttaatagttttatttctccctcagcaaaaagtttcaagagggctgaagctgtgtttcctttattcacttttctatcctgaaaagtcacatatcaagtgtttcatacagtgtgaatggaatgaatgaactgaacttcacttgaggttgcaaaaccaaccttggcattgatttattgagtaaggccaggtatggtggctcatgccagtaatcccagcagtgtgggaggctgaggtgggaggattgttgaggctaggagtttgaggctgtagtgagctatgaacctgccactgcactccagcttagtgacagagcaagaccttgtgtttgttttttttaaataaacaaatgcaaaatgatctgaaagtaaaactcgaaataataaagagaataattttcaaaatataaagtgaggggccaggcatggtggctcacgcctgtaatcccagcactttgggaggctgaggcaggcggatcacaaggtcaggagtttgagagcagactggccagcatggtgaaactctatctctactaaaaatacaaaaaattagctgggcatggtggcgcgcacctgtagtcccagctactcgggacgctaaggcaggagaattgcttgaccctgggaggcggaggttgcagtgagccgagatcgcaccactgtactccagcctgggtgacagagcgagactccgtcaaaacaaaacaaaacaaaacaaacaaacaaaatatacataaagtgaacactttttaatgtaattagcacagtgttaaaagtgaacatttcatacaagcaaaaatactgaatacaataaatgtagtagaatcaataattaagtacatgggtaaattaataatatcatccatggtgagctaatgcccctaagaactggatgctttatcatacagttgcttgacattaccaacaagtattgtgacaaatttgattcaatcatttcattatgcaggcagaaaagatagtcttttaaaataactaaacatatgggaatataatgaagagtgtctatagtaatcatttcatgaagacacaagtctgttcctaagctattaatcttacttgcaagtttgatgaaaaaaagaaggatctcatgatttcttgctccaacttcccatgtacagaggctctcttctttcttttccagatagagactgattccttggaagtagctcttcacagcattagggagttgtcatggcctgagagagcccttccacccctaactcattcaacaagcagggctccaggacttcccaatgctgataaaaattcagtgaataatttctccaggccagtttcattccaaccaacctcttgtgttgaataaggtgacaatctgctggagcaccttgtggaggacagtggtagtctaagccttctgaattttgctgccatcccttggaaacaatagaaaacattcaaaacagatgaactgcccatcaacagggcactggttaaataacttatgatgtaacaactcagaaggcaacaacagaattgtttaaaaatataaataagccctctacactaattcaggaagatcttgaagtgaaaaaaaaagatgcagaacagtgtacatggtatgctatcttttacataaaaacgaggcgagtgtaagaaaaacatgactacattcttactttgcatatgcataaagaactagaaggatttaaaagacagaaacttcaaaatttggaaaatggaagaaattgtgtcaaagtatacatttatttgtatgtcaaaatttaaatttaccactaattaaagaaatgcaagttaataaaatactcacaaagggaaaagtcagaagaagggaaagacacaaacattgttggtgataatattttggaaatattgtcttggatcagtattttactaaatattatccataacagggctaaaattttgctaccagattgtataagtttactaccgagtctataaaacaatggaggataagaaggtacacattcaggaacaaaccaatgggcaaaggaaactatagtatgtatagttattggaaaattatgtagccatttttaaaattgtggaaaacaaaggcatttcaagccaaaaatttagaatatatcatttacataataaagtaacaatctagtaaagacaaatattttgcgtttgaaattgtaacaaatttgaaaatatgaaccaaaattgtaactgaagtatctactacataatgtgggataacaattattgttttgtagaggaaaaaaaaaattaagcatccaggtttcctctcaatttatacaaatgccgcatttcactgttattcaaaaaaacagaagctaggaagcgtaaagctttgaaaaattatgcatttggggaacgtaagagctcagatatgcgaaaaacttatatcaaacgtgcagcataacacacttgcttgcacacattctgtcctatttggtcccacatacaaggcagctctaagaggccgggctggcgcccaccccacacagctccgcttccccaaccctcgccctcccgcctcccgggtacttcctcccccttccccacccccaccctcccgctgactgacgaggtctggaggccgcgcagccgcagtagccgctaaggccgctcccaccccgtggtatcctgggactaggcttttccggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtgccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgcatttgcttgcatttatttcttccctcaatctgttgtagttttacaaaggcaacgctgttcagttaatttttgagatcaaatttgtctttttttttttttgagacagggtctcactgttgtgcagtctggagtgcaatggcacgatgtgtgctcactgaaacctctgcctctcatgttcaggcgattctcccacctcagcctcccgattagctgggattacaggcatgtaccaccaagcccggctaattttgtatttttagtagagatggggttaggggataattttgatatggtttattttttatgtagtatttcagtgcttattctgacatatcaaggtgatactgccctgcctctattttgtacaggcttttccttttattgaaaaaaagtactttttattacatcttatgtctgaacctggtgcttcctattgaaataagtattgctttactaggtaaactgctctatctacatcccccacctccagcttcacccaccctgcctctcatttttttactttcccgtattctgcagttgacagttctcttggtaatcatacaggtagctgactaatgctatgctaatacaggttgagcagccctaatccaaaaatccaaattgctccaaaatttaaaactttttgagggccaacaggatgccacaagtagaaaattccacaccagagctcatgtgacaggttacactcaaaacacagtgaagacttgtttcatgcacaacattattaagactattataattaccttcagactacgtgtctgaaacgtgaaatataaccgaagttttaagtaatattgtttagacttgggtccctcccccaggatacgtcatgtacatgcaaatattccaaaatccaaaacacttctggtcccaagcatttcagataagggatattcaatctgtactgctcattaaacctggagtttcttatagagagaaattttaggtggttgaaatgattaaatggaaagagatttattttcataagctggtaattttttaaagaaagttcagactggaaaaatatttagaggataaaaactaaaagcacataaagcattatgttaacatttcttgttttagtttttcggaaagtattcaaaaattaacatttgttagcttttttgatatgtctattatagaacgtacaggaaaataaaagcaaactaatttatcagtgattccacatgttgaagataatttctattaatagtatattatatatatatatatacgtacatatgtgcaggcatttgtcaaatatttttcaagtatgccagaccttaggctaaaagctggataatgaaaataaatccaccttccaaagactcctattatcatgactttctcttattttttaaaaagctgtatatattaaaaaatcataaggtgtttttttctaattatcaaatgcacatgtatttagaaaaacagattccatttttattcagataaatccagacttaaatttctttcccacttgcttacagtaatatttatgtagttggcctgcaaagcaaacacatttcactcatgttcagatttttgtaatcaaaattattttgttctcactataaaggcagtaagctcctacaggacattttaaaactacataaatgtgccatccccagctcaaccgattataaacaactgccgaaagattgtggggtaagtttaactctctaaaacttcagctttgtcatacatctatcaggttgggtgtgatcattaataattctatttatatcagatttgtaaggaaataatataaagcgattagcataagatatgcacaaaagcagtgaatgatagttgttactaacaaagttgggattttataatttttgacttttgcttcagcttaatgattttcaggctattgttctttgaaagtgttcagcgtctatacaatatttcattccatgaacatgccaaattattccatttccttatgtgtagatatttaaatgtctaccataaattttcaccataataaagcaagatgtaatattcttacataaaactttgcccatagctactaccctatgataaatgctaagtaaaatcggaatcatgtagtgttagcttttttagggtcttaaaaaatatttccaggattataccatatgcatttttagcagaactgtgttcagtaactatttcaaaggaaatctttgcagttctagttatttcactgtttggatttacatatctttaattactagttataatttcttgtttattgagcatgtgtatttttcataaatcatttgctcctgtcttttgctttaattgtcctatttgctataaatacttttttatactctacttttttattcaatttaatatgatcaagtatgttcgtcttttttgtatgttgacctttcggtgatatttttgttttttttaatttggggtgtgtgtgtgtgtggtggtggtggtggttgttatatagtactgatgtggtattacttgttcttgatactatagctctatagctttgtgattactagttcttgacatgttagggtggcatttactgcttgtctcctgttcaagtagcttttctttctagttaaaatgagaatgagattttccttaaaattaataaacttacctttttatattgagattaatcattcatttttttttgagatggggtctcgctatgttgaccaggctgttcttgaactcctggtctccagtgatcctcctatttcagcctcccaaagggctagaattacaggtgtgagccactgcaactggctatattaagattaatctttattctctatttacagcaagtatttgcccacttgtgttctgtgagcaaagaaatcaagtgtttttcctttgtaacgtagcacaattagtttttttgtcattttaatgctttcttgaataatttttttatcattaggtggcataattatcccagtattttatgttgttattattgatacaactttctaccaaacttttggcataaaatctaatgtatttttcaaattacctaatttttccataaccactttttgaatatcttcatttccttgctgaatttttatgctttaaaaaaaatcataaaatcttatagtcaatcaatttagagtatttttcttcacttccaatgatcttttttcaagttaagttgtctttgatatatacgtgtgtgtgtgtgtgtgtttgtgtatttctgctttgaatgggatttcgttatgttatattctgaactcttggtagaagtaggaaatatgtggttttagcataatggttttctgtctaccgactctcattgattcttcagttttttgggtcaattctcatattttcaccttaactaaccattatctgcatattataaaagccaatttcatattattagtttaatgtgaaacattaaagcatggttcatacttccagcaaaattatagtagtgaccgaggaattgtgtcttatgcgtaattttaataggggtaattctagttttaggattcctttgttacaaggaaatatccttgatcttgttcacgaagttcctcattaattaggagtcttaaaaaattagggttgtgtatcttcattacaaatgatttctgtaccagctgatccaaatttttcttagtaccatccatgggctgaaagaaaggctatttcttcgctgtgtgatcagtgtgtcattaactacccatttcttcatttatttagtcaaatttattgagatgataatttaatttttctcatgtcaaatactgaaaaagagtctgttttttaattgttttcaactgttgggttagaaaggactcttacatattgctgagtgcattgtcaattggtttacagtttagaatgcaatttggcaaaagtagtaaaatgatctttcaagtttcataccttttggacagtaagtatatttctagaattaataagtgacagaaaataggccagaaatagtcatctcagcatgatactattatttgcttcctaataggaccacattagaccttccattaaaatacttttaaatggatttttaaagattcttcccaccttaattttgatactttatctgcatcctctagtattcaattgttgagcatatatttgaatggctggatgatgattagaataaaagacttagatattcattaaggatgactgaacacataactgttgaattgtgtacctgagccaaatgcactagtacacagaataggtcgttcctctgtaacagtctcagagcaactgctttccaggggctaatgttattctgccatctactggttaaaattaaaagtctttgtttagctagattacagaaaatatatctcctttatcaaaacaacagtaataacaaaacccagaaatttttatagcacatgtgaaagttcaaagttggcagcttatataaattacataagtgaatattaaaaacttttggtaatttttggggtacggtagatcaaagagaagaattattttttatattacttaaaaatacagatttaaatagctatgacctttattttatttataaattcatatacatttaattttaaaatctgcaacatttcatctggattctaagcattcatacccaatacttgctttttcctttgagtggattccccataccatttttatttttagtttttagcagacagcctcatcacaaagacatgtatagagtaaatcttttccacagcagaaaggacgtaatatgcattatatctggttataagtaaatatgacaacctcataatatttaagaaatttttatattggtttgctcatttgggtatgaggatcaaatcatgactgctatagccacataattttcacccggccagccagacacacatatgcataagcatatacatgtgtttgatgtaaaacagcttttggaccagctgatccagatttttcttagtgccacccatgggctcaaagaaagtctatttcttgactatgtgaacagtaagaatggcatcaactacccatttcctcattctccatgttattgtctcagaacaaaatattctcttacaccaagcattttttccctcaagatggatgtgtataacaacaagtgatctcttaatagtgcctcctgaaggatatcaagagtgcacatatcttttctacatagaactgaaggagcaagattagatttcgtgcaatcttagaacaagatgtgtataaagctgttgacagcaactaagtaacccaaacttcagaagtttcgttgtctagagccccttctccaattgtaagtccaaagagtatgtctagctctttactggtccatcttccaaaagactattacaatacagccttacaatctcttataatggaagtttatcattttttgcctcatttcacccaagtgccagtcaacagagtacatgtttgtatgtggtggggatgggaggcaggtctaacttctactgattcaaacagctttatcttacttagggagtatactttatcacttagaagtcaaaacattcttccagccaggaattagtgatccattaaaacttatttctaattcatgtcaaatcatgaaccaaaacatactcagtataaaaacctaatgtgagtcagtgtaatgtttatttcttcatactaagcagtgtttacttcaattttttattactctctccatctttctccagataagaaaatcacagatttcacaaaacctttcatatatgtatatacacatacttgaagacatcaattaactcaaagattaaggaaaaagagtttttgttttgattttgttttttgttgttgttgttattgtttgttttttgagatagagtttcactcttgtcacccaggctggagtgtagtggtgtgatcctggctcactgcaatctccgcctccccagttcaagcgattctcctgcctcagcctccggagtaactggcattacaggcgcctgccaccacccctggctaatttttgtatttttagtagagacggagtttcaccatgttagccaggctggtctcgaactcctgacctcagatgatccgcctgcctgggcctcccaaaagtgctgggattacaggcgtgagccaccgcccccagccagaaaaacaatttttaattttcaaggctggctctccattaataatctctcccatgccctggactagctatactttatcctgcaaggggaataagttatggattccattggtatgtctactttgttcacttcttgggctgcaatatctacacttcccattcacccttaccacttacttagtagatagtctagccacttgcaacaggttcatggctaccatttgggaatgcctataggagatcaaggagatccattgaaactcagcccccaaatccaaagtcactttccttttgatatctgtagtttcatcatctgtcataaccatgcctacttatcatctgtaaaacaccctttctacattaagggatactcacattatgaattctagttgtggttgttttaaaatatattcacaaattttctcatgctcgtttctttcctccttttgactatgtgttggatttagtgattcccatctaatgaatacaatgaaacaatggtgtttaaattatagactaggtcataaaaaattgtgtacttcctccatgtttatctctcttctatcacttcctctagtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaaccactgagtttttgattaattatgcatcaatggaaaaccagatcaccaatgcaggcaacataatgtaaatttcaagcctcccttgtagataggacatgggaacaaagaaagacttgccgatctggagcacctgcatgagcttttgatcctaatgtgtccacaagaagatataggctctacgtggtgtttctgtatttattggctgagttggtggctttctatagtgggaagttcaggttttaggaaaagaaatggcattagagaatggaagttccttctagttcttactagagcagcatcatcaacagtgggtttttatatctggacagttctctggtttaatttttgatatttttatctggaggcttagtctagagcttgtttctatggcatcccaaaaattcagcaggcaccacatcttaacacctctgtttagtcatcagtcttacattcagctttactctttactacaacgtaataaataccttccaaacctattacctatctcgttgggtacaataactatgtcctaatgggtccacttcccacctttctaaccagtatgtgcaagcaaatcccaacctagttttcaaagggcagctgtaagagcttttctaatatgtatttggtgacatcaattcactgcttaaaacatctcaatatttctaatgatcatttctgtgactcataatcccataattgcttgcaatgccttttacaatacaacacctgcttcctattctaacttctgctttctccctccctcccttctacttctacatagttctaaaccttcttcactgtttgctcctgcatgcgccctctggccgctacgcattcacatctgctgttccctgtttctgaccctttgagcatcacacatttacttggttaactcccacagatccttgagatgccagcttagcagttacttctcctggatgctttccctgacggaaacaagtgctacacgcttccagaatctgatactttccctgtcacagtcattagcattactttaattaaatgctcacttgcccacatcccaccagactggaagctctgtcattccctgaaagcagagaatgtgtctactttctttcattgtaactagcaccatccacagagccagcaaataaaaggtatttgctacttatttgaagtttcaaggtggatgattccgtatttcactttagtttctagttcatgcaactgctgaaactgaatcaacggtcatcagatatgacttatctaagaaacataagtaaaactgaattcacttcagctggtataatctatgtgaattgttcatctccttcatggccctaggattcctacctacctacttattgtttagagctgtcttctcaggaagagtgctccactgaagaaaataaagtctttatttaacttaccaatattttcacagtgacaagtaaattgcctggagcagagatatttaaaacgatttatgaataaatagacttaatgttccttttggatttgaaagcagattaaaggtttaagggcactttgtatctctttgagggtttgagtaagacctgacttttactgtaaagatttaagtacccgctccatcctcaccaaacaatagaaaccagaaggcaaagctgaccatatttataaacaataaattttgaaaatatagcaattatcattggataaattttaattattacaagctaaaaatgtaatttctccctattcaaaagtacaattttgccaggtgcagtgactcatgcctgcaaccccagcatttgggaagctaaggtgagtggataacttgaggtcaggagttcgagaccagcctggccaacatggcaaaaatccatctctactgaaaatacaaaaattagctgggcatggtggtgcatgcctgtaatcccagctacttgggaggctgaggcatgagaatcgcttgaacccgggaggcggagtttgcagtgaacagagattctgccactgcactccagcctgggtgacagagtgagactctgtcaaagacaaacaaacaaaaaagtacaatttcttattattgaaacacagtcttacaaaaatgactcaatatatcgataaatgaagcagaaaggaaagtctttgaattgaatgaatatttacaagctcgaagccacataattagtagatgagacccaattgactgatactgggtctaaatctaagtttcctttccaacctcctgggatttccgatgagcctattaacacagagaaagcatttattgattttcctttcttaatctgcagtctgacaatgtcccaggcacaacagatgtgttctttctttctcacatagagactgattgcttgtgaatactccttcacagccaggctggagtcctcctactcaaggtctctttgatttcctatacccaaacaggtctccagaaattctagctactgatcaagcccagtgaggaatttcagttctttgtgctgaaaacgttggagatctgctggatcatctcatgaagaacattggtggcctgagccttttggaatttggtgccatgcggctgctctaggggaaacttaaaaaacattcttgttcttcagacaggaagaaaagaaagattctcccaatttggtgcagaactttgaaggtcacctatttatggcagcccatggctctgggctaggccacagctaaagctgcagagagaactgcagaatatcatcctcagtgtcactagggaagaggttggccgggtcattggtgggatacagctggctaggccatttgagtctttacccacctgtctcagcactttcttgttgtgagattcttacataaccagattagggttttcagtttttgtacttatctcaactttatttctactttgttcactttctcttctatttatgggtctcagataatgtcatgacctcaacacttcttttgtattatgacaatggaaattaaacacactcagaaaatggcaaaactctcaatctaataggaaatacccatccaaatgaggctcaatgttgaaataacaacctatctgagtctcaatctatgtctcttttaaaattctaataagtatacttagaggtatgatcttggacatttttacttcttaaactgcactgaaatacatgtttcctcacctctctgcatttctcttttaagtggctaatacactaggtttgatttcttccacctttctttacaagagccacagcttataatctgtagataacggtggcattaatctccaatccccccggttgagtcgtccagttgttatagttctgtcactttcagtgacttacccgcatatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtccctcaaattgaaactctaggaaaggggactgtctgtaaaactgtgaaggagcagagcccaggttcccattgtcagagtagtgccttgcacagaggaaaaattgtacagcccccatgaagcttgttccagggaaccagtgtctcagcaagttgcgatagaaaatggctgctctgtgaatagtataaataaataaaataatccctttactcagattcagttagtttcaaatcaccattgatgattatttttaggcccaagtaaaacatattttgtaaaccattttcctagcctttacaactctctaactcaaccctaaaaaaaaaaaggtgatttgaaactaactgaatatagtattatataaagttacctatagatatatacagaatatacacttacatatttatatatacatatttaaatacaaataaataagtaaatattgtaatgtatttaataacatacaatatatgttatatgctatattgtatatgtgtatatataacatatcgtatatatgttattctatataaagtatatattgaagtatatatattaaaatatataaatgtatacatatttttacacattatatttacatatggatttttaaatgtacaaaaacatatataagatatataaatatatattcttttttttttgacaaaagtctcactcttttgttcaggctggactgcagtgctgctgtcatacctcactacatcctcgaactcctgggcccaagtgatcctcccaccttggcctcccaaatagctgagactataggtgtgcactaccacacctggctaattttttattttttggtagagatggtgtctccttctgttgaccaggctggtaaatcctggcctcaagcaatcttcctgccttggccttccaaagtactggcattatagacctgagccaccacgccaggcctatatattctttatgtatatttaaatacatatgcttaaattatgtatacttatatatttaataatatacaaatttaatatattttaatatgttaagtataatataataagcatatattaaattatatgagattgtaaaagtatataatacttaaagctgtatatacttaagtatacataattatatttacacatattaattacaaaatacataatctaaaaatgtaatgtatattaatataagtatataaacttattttatgttacataaaatttaagtatatacaagcatatatatacatatatatatttctggagggagggggattggaaatgggactaccttgattttcagccatggaaaaatcacaatactttgctgattctgatggctgccacactctcccttcccccctacttactggaggatcccattctttcatttctgtatgacattagtttcctccctccccagcgtagaaatcccagggtgctctcctcattcactcaccattaacctgcactgccattcatacagctgcttcctgttccattgtaatttctggctgtcaattttcccataagagtacaaagccatcagctgaaagcaaaagttgagtgagagttctaggtgtttcagaaacatccaaatcactggcctgtttttttttttttttttttttttacttccctcctggtgaatagttttggaaaagaaggaatatccccattacaataatgtaaccatccctgtggaaaaaggaaatagaatgcaagatccattttactctggaggccgttgaaatatttacagaggatgagagccacctactggcaaagacgtgcaccaagtctatggagggcaggcttttctgttctgtaaagaatatgtaacaaacctgcacgttgtgcacatgtaccctaaaacttaaagtatgataataacaaaataaaaataaaaaaataaaaaataagaaaaagaattctgttcccttgaaggagattttcgttcatttgtaaaaggccatctttctcggaaagaattaaccctaatattggaagaagcccattttcttagcttttgtatcacagagagagaaaacactcccagattcaggaagcacatgttctttgaacaatgggcagctatgtggagagagaaagggtcagaacgtgtcccttgcctccagcctcttgacttgtccctccctctatgttttgtgctagactgggaatcagtacaacctgccaatgtaggtgtagaactacaagggaaatcaagaaaaatctcctggttaaggtacattagctctttcttaacagtaagttgctaattttacacattcactccttaggtcatgtcccaactttataattaaaacattttctgttattttcaatgatgagtcaacttgcatcccttgtgctttttactcagtagtaaaagagagcaaagacatttgtaaaggaatcagaggatacaattcttgccaaatgatatcaagagaaggtatctatttgtgtagaatttgggaagtattaaagtgatctgcaaatagtgtaattgaagaagttaatcaggagtgtgtgtgagaattacttagatagtaggaagaggcttcaatttaggaggaatttcttattctttgctcaggttacagacccaacctttcagattgcacttttcaaatgggagaggagagaaactgggaaatgggagaggagagaaactgggaaattcagttatatttcacaatatgtctcttgtctctttcttttaccactgaatgtggggtactcagtttaggagcaggggaaaatattaaaaagtttaatatacctggttctctctcttcctttctctgtttgtatgattgtttaacgactttcaaatattaagtctcctttaattcttggttattttctatactgcttatttctttaatgtgattttcctttttgttgcttgtcatttcagtgggcaaaaattgtacgcatattatcatcttaccctgaaaaatctctgtggctataccctgatcatattcagaagttaattttttatatattctaaagtattggagaactgaggtgaagtggtggctgagctggcagcaaggggcattgtcataacctgcctcacacagttccctgcctgtgcagtgcccctggagaaggacacataaaaccttgtttctgccctgaatcccttggaggagatacaggaagtcgtggcacagtgccacctggagacagctaggttttgtgagatcaaggatccaaaatgaatatggtcatgcctggactctccctgcctggcaagttcagtactgcaaaggttaagtacttgaagttaaatactgctaggcacaaaaacatagtcaatagagagaatctttcccacgtgattatacccaacgtgttggtaaagaatgcagaagttcatctgtgcccctgttcaggtgcttctatgttctgattcctctaggaagagactacactaggctcaggactctcatttgttgaaaaaagcagagcccacattatgaaacatgaagaagaaaaggcaagcagcagctttagaacttggaaggaagagagagatacttaacacattgactggaagagcggcaggtcctcaggagatggagcaatacaaatgggagcactgaatcaactacttaagattattctgatcagagagaagattaaagtggatgctgaaaccacagagtgttcccatggagacatggccaacgtcagtgtccccaccatggataacactgataccacagcagcctgagagtattggaagggacaagggttactccagtgtccgttgcaaacttctgtttcctccctaggacccagcaagtcatcagagtgcagggaaagttaggcatagggccaatgcaatccgaggcatgtcataattcgggtcataatgcagcctgatttaaagataaaacaaatgaaacaacaattaaacaaaaaggatacagcagttatttgagtagaattaacagtaactgggtcagagacatcccagcaggactgatataaggtaatgtttgttttgaaaaatcacagtttctaatgacagcgaagatctttgccaaaatgtactagtttatttatttaacttagttatttggaaagaggacgttggtcggtcaattctcctttagctttttttccagtgggtgcattctgcactcagttggcacagttaaagttagaatttggacactttctgaggatgagggtccaaaaaacaagaaaagtacatccttcatttctgacaaaataataatgcttttatcattttatcaattaatgctgattttagtgatatatttatttcattgctacagttttattttatgatttgtaattgtatggggttagaaattaagtaaaatcaaccacagtaggcagctgggctgagtgtagaggtaaagccaaattctccttggtaagaagctcttcaaaacctttcacttctgtgcaggaagtgcataatattctctcatcttggtcatataaaaggtcttttcagcgctcaaaattcaactattggatggaaagacagaaaagagattcttctctggactctatcagtacacaagatgaatgtcggtctgggctggaggtgagaaacagtgttgtcatcatttggaataaaaacaacaggctggacagaagaaggtctcttgtggaattagtgaggtcctgaaggagataagacaggcctgatatggttgtaccatcagtagaataaaaattgctgggtgctttctgtatattcttaagctcacaaaaaagctcaagagttaaaaataaataagattccaagggtctacaactgatagattaatagttattttaccatattttattgcagaaatcattcattaaactttagactttgtttttcagttgggaggaaaaatccactcccttttaactttttaaacaatgttctacttagaatttagtcagtaagttccattgacttgtaacacatacctgttgcctttgttcatatctattcttcacttgtctaacagaccctttcacacaagccaattatctcaagtccccataaggttttcacgtttcattattggcatgttcagaatagtttatccctccagattgttattcttctccaaagtgttatataatgagtgtaatacaaataggtttattgaaagaatcaaattgattttttaaagtttcaattttttcatttttatatttttaattgacaaataataattgtatatattcatggactatatagtgatgcttcaatgctgataatagtgatcagatcagagtaattagcatatccatcatttcaaacatttatcatttctttgtgttgggaacagtcactgtcctccttctagctaataatatataatatattactgctacagtggtataaaatactagaccttagcctcttacatagctgtaattttgtatcctttaacaaatctccccctgtccatcccatcctcctacccctcccaggctacagtatcctctgttctacttttacttctattagatcaacgtttctttagcttccaagtaagagtgaaaacatgcagtatttaattttctgttcctggctcatttctctaaacataatgtccgccagttccatccatgttgccacaaatgacaggattttattcctttttatagctaaataatattccattgtgcaaatataccacattttctttatcaatttatttgttgttggggaatagattccatgtcttggctattggaaataatgttgcaataaacataagggtgcagatgcctcttagatataatgatttccttttctttggataaatgcctagtaccgggattgctgcaacatacggatgttctatttgtagttttttaaagaacctccacactgttctccatagtggctgtactagttaacattccaaccaatattgtgtaatagtttcattttctccacatccatgccagcatttgttattttttgttttttgttttgaaaatagccattctaactgaggtgggatgataattcattgtgatttcaatttgcatttccatgatgatagtgatgttgatcagtttttcacatatttgttggtcatttctatgtcttcttttgagaaatgtctgttcagatcatttgcccattgcataatcagattattattattattattttgctttgagatgtttgagttccttgtatattctagatattaaccccctgttgtatgactggttttgaaacattttctccattctgtaggttgttactctattgattgtttcttttgttttttgatataatctgatttgtttatttttgctttcgttgcctgtactattgtggtctgacttataaaatcttttcacagacttctcctatgttttctcctagtaattttaaagtttcaggtattagatttatgtctctcttccattttgagttttttttttttgtatagtgtgagaggagggggtctaatttcattcttgtgcatatgggtattcagttttcccagcaccatttattgaagatactatcctttcctcagtgagtattcttggcactttaattaaaaatcagttgttattgatatgtggattaattttcctgttatctattctgttgcatttgtctatgtgtctgtttttatgtcagtaccatggtgtgttgattactacagctttgtagtatattttgaggtccagtagtgtgatatcgccagtgtagttctttttgctcaggattgcttcagctattcagggtctttcatgattccatacaaattttagtatcttttttctatgaagattattattggcattttgatagggattgcattaaatctttagattgctttgggcagtatggacattttaacaatattaattatttcaacctatgagcatggaatgtttttctatttgtttgtatcctcttcaatttcttttatttgtgttttctagctttccttgcagaggtcttttacctccttggttaaatttattcctaggcattttattaatttttgtgtagctattgaaaatctggtaacttcttgatttattttttagctagtttgttttttgtgtgtagaaacactattgattctgtatgttaattttgtgtcttgaaatgttactgaaattgtttatcagttctaagagttttttagtaaattctttaggtttttctatatataagaaaatgtcgtctgcaaacagagacaatttgactccctcctttctaacctggatgccctgcacacaggtcctgtgactcaaaaaccaccccttgagctgcctctgtcaaattcatccttaggctggctgagcagctttctgcctatattctgggcctgagttactatttttaaagaccttagaatagtggatagtccataataagcattcaaagaaactcaataatatatttttatgttatgattattattgctacccagattaagagcagaatctttggggtcatctaacactctcttttaaattctaggttttcagaagcaatcttttcattgcctgagtggatttattaactaagtagagaactcagccaaggctaattatataccttatcctaccagagagggttggtgtcatactaactagggtctgattgtctgtctcttgagaggtgattggtgtcactgttcatttttctcctcggagccagtcacatgtggacatacaattagattaaaggaataagttctaatgtttgatagcagttgttaaagttaacaacaatgtattatatatttccaaatagctagaagagaggatctgaagtgttcacaacacaaagaaatgataaatgctcaaggcaatggatttcctaaatatcctgacttgatcatttacgacttatgcatgtttcaaaatagcacatatatcccataaatatgtacaaatattgtgtatcaatcaaaaattaaaaatgtgtactataatactatgcaaaaattaaaaatgtggattaactcacagaaaagtcagatggctggtcttgcaaagctgagggcagtttatagattcagcagtcactcttctctgagcctctggcagatgcaggcatttccctgcttttgtgtgcctccacattggccttcattcatcccctctgccagaggccctagctctcagttttgctgcattgtgtgtgactaacttacacttggcaatgtgtcagtagaaaggcacttctgtcctttcattttcatgacatttgcacttttttttttaaaccacaaatgacaatcaagttttgctttctaggaaagttgaaatgagaaaaaaaaaaatctgaaattatcgggggaaattcagcccccaatatttcatgtgggtccttttctattttccctaagtgttggctggtctgagaaataaagggaaagagtacaaaagagagaaattttaaagctgggtgtcccggggagacatcacatgttggcaggttccatgatgccccaaaagccgcaaaaccagcaagttttcattagtgattttcaaaaggggagggagtgtatgaatagggtatgggtcacagagatcacatgcttcacaaggtgatagaatatcacaaggcaaatggaggcagggcaagatcacaggaccggggtgaaattaaaattgctaatgaagttttgggcatgcattgtcattgataacattttatcaggagacagggtttgagagcagacaaccggtctgaccaaaatttattaggcaggaatttcctcgtcctaataggcctaggagtgctacgggagactggggcttattgcatcccttatctataaccgtaaaagacagacattcccaaagcggccatttcagaagcctccccctgggaatgcattctctttctcagggatgttccttgatgagaaaaagaattcagtgatatttctcctatttgcttttgaaaaaagagaaatatggctctgttccacccagcccacaggcagccagactttaaggttatctcccttgttccctgaacattgctgttatcctgttcttttttcaaggtgcccatatttcttattgtttaaacaatttgtgcagttaacacaatcatcacagggtcctgaggcgacattcatcctcagcttacgaagctgactggattaagagattaaagacaggcataggaaatcacaagagtttttattggggaagtgataagcgtctatgaaatcttcacaattcatgttcagagattgcagtaaagaccggcataagaaattataaaagtattaatttggggaactaataaatgtccatgaaatcttcacaatttatgttcttctgccatggcttcagccaatccctctgttcggggttcctgacttcccgcaacagaaatcatggaaatcatagaaaaaaagttgtggcccctttgcctgtcttttacttcccttaatttttgttacttcatcatgaatgagaatgtaatgcattaatggcaagacaaagcttgcccagaaatcactagtgcaaaaaagtacaaaaaattaaactaaaaaaacacatacaggtaaaagaaagaagcctatttcttcttgacagaatagcctggccctaactgccctacactgttagagcaaggcagagacccaggaacaaagaaccccaaagaaacactgactggatgaacaattgaaagtcactagtttctgtcatattagttgctaacaagagacaacatcaaccttgactcccctgtgaccagctcagaaaggtcaaacctaacaagtgttcaatagttttgagtattgaaaaatgaaagtgtgcgggcgcggtggctcacgcctgtaatcccagcactttgggaggccgaggcgggtggatcacgaggtcaggagattgacgctatcctggctaacatggtgaaaccctgtctctactaaaaatacaaaaaattagccgggcgtagtgcaggctactcgggaggctgagggaggagaatgatgtgaagctggaaggcagagcttgcagtgagccgagatcgtgccaccgcactccagcctaggtgacggagcgagactccgtctaaaaaaaaaaaaaaagaagaaaaatgaaagagttgactgattgactgataaaagctctaattgtcaaaataaaagttacttgcttgctaaagttaaaattatggcaattgaatacttcctttacctatttgtataaaaggaaacttgctatcaacatccgagcactgtgcacacatttgatccctgaggacacagaccctggacaggaggagatcaccattgagaagccaaatccttcacacaaacactctaagggcaagggcaaagatcttggagcattaattattttggctcaaagaaaaagacctttccctagtaaaggagttctaactttgtgcctcagagaatgaatctggaagagtttgggttgaggatattgtcactctagaggaaagggtgttactgactgtgataactgccttgtgagtgaggtggtgctggggggaaagaaaattaacaaattaacttaggattagaatctcgcagcccaaatgaccagagaagaatcgggattcttgatgggggtattatcacagcctgaggagcactatagacattgagtaagaaaatgatgggaagaaagggctgtttctacgttaatcctgacctgcggctccagtgaggcacaatcacatggaattgcatgaatgtatttttaaataaatagaaaaatcagagaggctcactaactaataatcgtcagcatctgctatgaatgaaacaatggacaaaacccaattctttcttctaaagggtttattgtcaaagctggtcggataaattctcaaatacagatacccagatggtagagagagcctatgtaatgcatgcagggtataatgcaacctaggatcagggctgaaaacttttcacctgacacagaaaagaagaatatttgtatgaaaaaagtatataagtatttacattcctacatacacttcagcctttatgacaatgactgttctcatttaattgataaatgtacatttagattggcacacctgaagtttactgtgcaaattctattgcaaaaattaagggtctcaattgatgttgtgtttttaagcctaatatgcaatatgtaaatgaaaacaaaaagtagacatatagagaaatgttcagaaaataaaaactagatgtcccctattgaaagccatgcatagaaataatgtcttcagagaacctaggttccaaagttcaaccagaccccagctcagccaggcctgcagaaccctcatttcccaatggccctcccaatggccatatttcttattgattttccatccacagatcctgtcattctgcttgttggttacaaatcccaggctgtctgtgtcatattcagagttgagcccagattgatctctctcccctattgtgatagttttgacatctgtcgcaatagtcctaaataaagtcttcattactgtaataccaagtgttagcataattttttctctaccagtttctcaacgtaagccagcacaatcatcacagtagcaaactctgctgacctacaacataaaaggcatcagccagctggaaagtcaggtaactcagaaccttttgtcattgcagtcctcctcctctaatgccctggactctctacatttctccagaagtgcttcccatttgcacacctccaatcctattaggcagcccttccagagggtttttttcctgatctctgagccttagcttattggtttatttctgatttagatcatatttatatcccgatcatggcttagtcttacttaggtttgcactaaactggtagaaatctaaagtattatggatatttgaataaatgagtagatatacatagggtttcaaagagttgcttatgatgaaccaagtattttacaaatacattcaagcttatggaaatacattctcaagaagaaaaaactagaatatagtgtgtaagtaaaatggggtctaatttaattgtaatgtaacatgttggcaaaagcaaatgggacgtttcagtaaaaaagaacagctgaagagaaagaccctgtcattacttaggcaggactctcctgggaaaacactgaccaatgcagaaatcagttcttatgaccagaaatattcccaaagaccatgtaagagctgaggatttagagtccaattttggggtttaaatagtagcctcaaattcaatacctcactgttcttctgttttttcttttgtaaataggaataatagtagaacctatcagtcttctttggtcactgatatctccagtgaataaatggtgggtaggtatatggtaggggttcagttaatacaaaaagaggatattcattattggtaaaatgagaatcaaatctgtaagttctaagaacaatatctgactgaaaataaacaccttcatcaatttacctgtctccttccttttttaaacattatcttcattattaaactttattaaattgggggaagtgtcctttaaaattgttaactcccttgattcctgtaaaaaacataataagggaaatattgatctcttgaatgtatttatacactaagggagaacttgagaattaacacttactcattatgcaaagagtacatggtactcttttaaaaattgccctttttttatgtacaaattcttgcgattggtgtgactccatgaaggctggattcagcaaagctgaaaacactgcgtggaccaggaatgattactcttttttttcagctcatacccatttgttccctttgatctacatatcttctacgattttgcttctcctcttccccattcctttatctccttctttactgggatgaatgtaggaaagttgcattttgtcatcctttttttcccagtgagatattgtctctctagaggatattgtcactctagagaaaagggtgttactgactgtgataactgccttgtgagtgagatggtgctggggaaaataaaactaacaaattaacttaggattagaatctcctagcccaagtgaccagaaaagaatcaggattcttttatcacatttagatacacatttgttttctttctatctccattctgtaggatttttaaaatcacatttagatatacatttttctttttgtctccattcttaaggattcaaaaagagacaacctttactttcaatgaaaatgaaaatgagaaagaaagatctctggtatcctgcatgctatgtaaacaattgtacaacccattcatgctatcacatttacattacactatggacatttaggacaaaaatggttttcttcagtttgaggagaatcaactagaattggaacctctgtgggttctttggaaatctgacctttcatgacaaataatatttttaaaatcaaattgatgacatttttctccattgcatatactcattaagtataatattgcttccaagaatgtaaaagttatttcttggggccctctaaagttcaactctgtctgacaaaactttattccttagtatttttttaattgagttcttgttgttgttgtttgtttgtttgcttgctttttgaggcggagtctcgctctgttgccaggctggagtgcagtggggtggtctcggctcactgcaacctccgactccctggttcaagcaattctcctgcctcagcctcccgagtagctgggattacaggcacgtgccaccacgcccagctaatttttgtatttttagtagagacgggctttcaccatgttgtccaggagggtcttgatctcctgaccttgtaatccacccacctcagcctcccaaagtgctgggattacagatgtgagccaccgcgcctggcctaatttggttttcttgtaacatcagaagcattgaccttgagttcatggaagatacacaaaaggtatacaagatcagtgctacaagcatatggcaaatgggtggctgttattggaggactttccaagatttattagatgtcaaagtcatatcatgtgaggtggcctctgtatacatatgagctgtcatttgctgtcttgtgtatgttgcttatatttgatcctgagcatttatgactgtgttttgagttttgaggtttcaataaaaatactttatcttttactatttaattctactaaagttgttcaacacatcaataattatgtcaagcactgaagagaaaaagttttttgacaatatctagatcaatatctagaagctagtgaattttttaaatttccctatgaagcaaaattgaaagtaccctaaaaataaatgttacaaataatttcaattttaatagtctttagctattttgaatttttaaatatttcattatactaggcaatattatatattttcataatttgttaatttacttatttaatctgacacactacaatttatataagtaaataaatcacattgttacttaaacaaattgaactatgaagttaaatatccataaattgtaaatttaattattaacttttaccttagaattttcatttgctcattcttaatccgggactgaataaattctattttacattctattacgctgcttttaaagcattaaagaagtacaatattctctctcgataatgggtactgtaatgtatatacatcagccaacacatagtatatctgtgttattaaaatttaatgggatttttagttagaaaaaaaatttctaaaaagcatatgtggcagaggaagatgaggtaataatgtaaaaataaataaactgagaaacactcctgtacatctatgtagaaagagcataaaagaaagcaaaaagagaagtagaaagtaacacaaggcattcagaaaatggaaactcgtatgtgacctttttaagatctgtgcacaaaacaaggtcttcagagaagagcccaaggttcagggtcactcaatctcaacagcccagaagcatctgcaacctccccaatggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttcaaatattaatttctgctatatccatgacttgagttgaatcaaaattttcaaacgtttcacacgtgttaagcaacacttctttagctccacagggacaaaatctttacagatgatcatgccaatctatctattctatctatttatctatctgtctgtcttctatctaatctatttaaatatttatttatttataagatttaaattattttaaattatgtttgttcaggtaatattacatccacctttactttgtggctaatataataaaatatgttctttatgttttgtcaactgattattttgctttgttcattagatttttactattaattgtttgtttattctttaaaatgaaactccaagcctgattgtataacttgattaaaaacagatggtacagttcagttacctatcattattttattcaaattttaagtaaaggaagatttttcttaagtgaacataataaatacaattcctgttcccttgtatctttgatttttgccagaaatttaacaacaataattatgattaatatgagttatgttaaatgctataatgtgagctaggaaaaaaaacagtgaattgctctcagcagaacgcagatagaggcacgtccagaaagaaaaataaaagcagagctagcctctctaaactgacttttaaacatgtaattgcgaatgtgcattgctagtcagatacatgagtttgcaatatccaaggaatacaatgtctggaggatcataactggcaaccaaatgcctaaaaatggaggctgtcatgtgaggagccaatgtagagaagaaaataagacttaaactagattctgaggaccttccaccattaaagagagggaagaggagagacacaaaggaaacagaggtggaataccttaaacattagaaggacaagagggaatgatgataaaaatgtatttagaaaataaatgtacttagaagaagaatcaatagacttatgggaaatgtggattaaaactgcccagaacatcagaaaaatagatggcggtggagatcttggtgagagctggattggcagaattaatcagtacaaaccatactggagtaggtggaagagtgaatcagagaagagaaatcagtgataaccatatgtaggaaataattgtgacatgtttgccatggaaatggaggggggaaataaggttggacttgaaaaagaatgtgtactattttttatctacatagtttttcttttttgaaaatagagttcgtggattcaatctattggcaagtcatgttaatatgtttaatattttatgtatttaaatcataatattatttgcataataatttattattattttgattaatactatgttacatgtcaggaaaaaatgacaaacttccctcatgaaataaaatgggaaactggatgagagaatctctttatacttttggccaaaaccagctgaaaatacgtgaaccaaagagaaattcagagtgcggcagagagttgcatataactcagtagtaagaggagatgtaataattattacagaaatcctgaatacaaagcttatacctcaggtgtaaataaaaataaagaattttacattgaaattacattctgcttacatgtaagcgtgatgttcagaaaaccacttaatctctctgagcctcagttttcttttgaaaatatactttctacattaaaaaagcaatacatatcactgttattttcttttaaacttttattttaggttcaggggtagatgtgtaggtttgctatatagataaattacatgtcacagacatttggagtatgaattatttcatcacctaggttataagcatagtacacaataggtagtttatcaattctcattctcatcccaccctccaccttcaagtaggcccctgtgtctgttgctcctttttttgtgtccatatatacttaatatttggctcccacttataagtgagaacatccagtatttgattttctgttcctgaattagtttgcttaggataatggcctccacctccatccaagttcccatagaagacaagatcttgttcttttttgactgcatagtattccatggtatatatgtactgcatttaggatttggctctcagcttgactgttgttggtgtatgggaatgctagtaatttttgtgcattgattttgtatcctgaaactttgctgaagttgtgtatcagctcgaggagcttttgggcagagaatatggggttttctatatagagaattataccatctgtgaacaaggataatttgacttctcttcctatttggatgtcctttatttctttctcttgcctgattactccagccaggacttccagtactatgttgaatagtactggtgagagaggacattcttgtcttgtgccagttttcaaggggaaagcttccaggtttgcctattcaatatgatgttgattgtgggtttgtcatagatggctcttattatattgaggtatattctttcaatacttagtttattgagaatttttaatgtgaagaggtgttgaattttatcaaaagccttttctgcatctattgagataataatatatttttctctttagttctgtttatttgatgaatcacatttattgatttgtgtattttgaaacaaccttgcatcccagagataaagcctatttaattgtggtgggttagctttttgatgtgctgtatttcatttgctagtatcttttttaaggatttttacatcagtgttcatcaaggatattgacctgaagttttccttttcttgttgtatctctggccagttttggtgtcaggatgatggtgaccacatagaataagttaggaaggagtgcttcctcctcaatttgttggaatcgtttcagtagaaatattaccaggtcttttttgtacatctggtagaatgtatctgtgaattcatctggtcttgcctttttctgatttgtaggctttgtattaccaattcaactttagaactcatttttgatctcttcagagattcagtctcttcctggttcagtcttgggagggtttatgtttccagaaatttatccatttcttttaggttttctagtttgtgtgcatggaagtgtttgtaatagtctctgagggtttggtatatatatttaagataattaggtcttcttgttgaattgagccctttatcattatgtaatgcccttccttgtcttttttgatctttgttaattttaagtgtgttttctctgaaattagaatagcaacacctgcatttttctattttccatttgcttcgttgattttttttccacccctttacgttgagcctgtgagtgtcattgcatgtaagatgggtcttttgaagatagcatattgttgggttttggttccttatctaacttgacactctctgccttttaattttacggcatttagcttgtttgcattcaaggctagtattggtaagtgtggatttgatcctgtcataatgttgttatatagttattattcagactccttcatgtgatttctttatagtgtcattggtctgtgtacttcctttccatatttagcactccctagagaaactctcgtaagtcagatttagtggtaaattcccttaacatttgcctgtctgtaaaggatcttatttctcctttgcttataaagtgcagtttggccagatataaaattcttggttaaaaattgttttctttaagacaactgaatattgttcctaatctcttctggtttatacagtttctgctgacaggtctgcttttagcctgacacagttccctttgtaggtgatgtgccccttctctctaggtgcctttagcattttttctttcatttagaccttggagaatctgatgactacgtgtgctagggaaagtctttttctgtagcatttcgcagggattctctgcatttcctgaatttgaatcttggcctcactagtgaggttgggaaaattttcatggacaacattttgaaatatgaatcaaactagaactcaggattaagaaactcactcaaaaccgctcaactacatggaaactgaacaagctgctcctgaatgactactgggtaaataatgaaatgaaggcagaaataacgatgttctttgaaaccaacaagaacaaagacacaacataccagaatctctgggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggaaatagagacacaaaaaatccttcaaaaaattgatgaatccaggagctggttttttgaaaagatcaacaaaattgatagactgctagcaagactaataaagaagaaaagagagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaccatcattctcagcaaactatagcaaggacaaaaaaccaaacaccgcatgttctcactcataggtgggaattgaacaatgagaacacatggacacaagaaggggaacattacacactggggactgttgtggggtgggggaaggggggagggatagcattaggagatatacctaatgctaaatgacgagttaatgggtgcagcacacaagcatggcacatgtatacatatgtaacaaacctgcacgttgtgcacatgtaccctaaaacttaaagtataataataataaaataaaaaatatataaatataataaaataaaatatcattatgctttacagagatagttcagttgacggcattaatcagcaacaaaatacaactttttaaggattaccagcaattttgtgaaaataattaagaataatagatcatagtaaaaatacatcctttagaaaaaaaaaagaaatatgttctccaagttgcttggtttctctctctgtctctcaggcatgccaataagtcatagattgggtctctttacataatcttatattccttggaagttttgtttattcttattgttttttctttatttgtctctgactgagttatttggaagagccagttttcaagctctgagagtctttcctcagcttggtcaattctgctgttaatacttgcaattgcattatgaaattcctgtacagtatttttcagctctatcaatcagtttgattctttcttatagtgaccatttcatctattagctcctgtatcgttttattgtaatccttagactccttggattggattgggtttcaactttcccctatatgtcgatgatcttcattcctatccatattctgaattctatttctgtcaattcagccatcttagcctggttaggaaccattgctgtagaactagtgtggatgtttgtaggtaagaagtcactctggttttctgagttgccagagttcttgaactggttctttctcatctttgtgggctgatggtccttcaatctttgaagttgctaacctttggattgcttttatttcttttatcctatgtaacattctttggggtttagttttgctataatgtgggttcagtcaattggcttaatctatggggatttaagtgggccaaggctcagcttaggagccctgaactgcatgatcctactgtgggtgtctactatcaggcctgaagcttcattctggggcccctggagattcgcaacctgccatgctgaaggggcctaatttgctcctgaaccactggtcagaacactctgataggtggtgccagccacagtgattcatagagtggtggcagtgggatccttcctcatttgcatgtgtcagcagcttgggaaggcaaatgctcattgactgcagtggggcactggtgagtgcaggggtgttggactccatgtaggcattcacagtggcagtggtggcagcacagtgcagaggctgcaggagctcagtttttttataaatataatgggttcaaatatttatatagttgttattcctaaatgaacacatatagtttaaagcactgtgtgtggtatccttcacagagtaaggatttaaaatatggcaggtatttttctattttccttcatccagctagagaagagaatattattcgtctttctataacattcttaggaactacgtcctccctttcagaaacccatctccaaaggaggcaaactaaaaacctagaattctgtcaaaaaatctggaggggttgaaaaattatccctccttatttcaaagaagtttgctatttgtattcagtcaggaaatggtggcttgtataaatacctgagagagaagaagcaccatctagattgaagtgcagaagatatatgatgtttattagctgattctggcacctggcacattccctttctggctctcagaattccagaatatacttccatataaagttagtctcctaaactgaagtgaaatatacatagcaacctttgctggttctgagacctggcacacttccccctttcctccctgtttttctggatcccatttttaactcccatatcacaataatttccttcctcttcttctagaaatccgcactgttctcttctcttcactcttcattaacctgcattgcctcttcatacagctgttctcagttctcttgtgggttttgtccaccaatttccccttaagagtacaaaaccacaaattaaagcagacgttgaatgaaagttctaggtttttcagaaactcttatatgaaaggctgtttttcttttcttataaatatttctggataagagggaatgtccctgttataatgatgtaacattagcttagcaaaaagaaaataaaaggctgttccattttactctgaggctattaaaacatttttaggtgaagagagccactgatgacgaaaatgcaccaagaccgcaaccaagtctgtggagaccaggcttttctgtttatgcagaagtctgtcttctggcaggagatttatctgcagagcaatgcgcattgcaagatcacaattcctaatacagcaaagacttttacaaaatttattaatttaacttagttaattcagaagaagaagacaatggcagtttagttccgtttcttctctttccagttggtgtactctgcactgagtaggctcatttagaatttgaacacttcctgaggattaggatccatgaaacaagaacattaaacctagataaataacaaatttgaatcattagtcattaatgtgagtatctaaaggtctgtcatataacagcttgtcacagttaatcatgaagctggtgattatgaaacctttaaagatcaaagacacattcaaataaaacctcatataaatggaaattccagctaagcctgttcaaagggttataatgagctcaaattactgtgattccatgtgaagcaagctacatgttgcactgatgatgctaggacaccacaccaactttttagatagccaccaagacacctggaccgggagtcctgccagagcattagggtggtttcacacactgactcaatgtgcagtctgggacctgtggaaaaggctccatgtgactctgtgtctgtgtgagtcatacatatttgtgcacataggcaggcaggtcaacatcttggcaatgacattgtattcttcccttaaatctataacttcaatctagtcatgagaaaataccatacaaattcaaatcagtggacattctacaaaataattgaccaattttaattaaaagtctcaagatcatgaaagactaggaaagactgggcacgtgttacagattaaaggagactaaagagataagacaactaagtgcaatgtgggatcctggattgattcttgaaacagaaaaataatattagtaaaagattgttgaaatctgaagcttagttagtaatactgtaccactataaatttctcagttttgataactgtgccacaattatgtatgttgtgtatattactgggatgaacaaaatatttttcaaatgcattcagacctatgaagtaaatacttaggaaaacaaaaagtaggatataacaagtgtaagtaaaataggacccaatttattcatgatgtaacatgactggcataagcaaatgagactttacagtgaagaaaaagaataatggctgaagagaaagagcctgtcattacttaggcaagactctactggaaaagcactgatcagtctagaaatcacatctggtttttatggccaaaatattcccagggagcatgtaagacctgacgattcagtcagattttctggattcagacagtggctccacaattcaatagctccctgcacttctgtcttttttttctataaatggatataataatagaaacttcactgtctgctttggtcactgtatgactcaggtgttttccattactcaggtgttttccagtgagacaaaatcagtggaattacattttatcatttattgtgatccctcaaatctttttaagttaaaaagcttttcagacttcgtaactgcacgagctaatccttcaaatacatcattagagggattagctcatgcagttatgaagtctgaaaagcccctcccatgccacatgccatctgtaagctggagaccctgggatgctggtagtgtggctcactcaaagtctgaagctccccacagaaccagagaagctgataatgtaactctcagtcccagaccaaagtcctgagaacctggtggcttctggtttaagccctagagtacacaggtaggggagcttggagttgttgtccaaggacaggggagaaagagttcatcccagttccagcagatagacccacagatagagtttttgttttctttggactgtagagcagattgcatggtgcctgcttacatggaggtcggatcttacccacctagagcactgataatctcccctggaaacaccttgggatacaccccaaaataatgcttgaccaggttgctaggtattcctaatgcagtcatgttgacacctaaaattaaccatcagacacaatgatatctacagtgattaaatggaactgagcactggtaagttttcaataaatatgaaaaatgtgggtgtttgaaatggggtaaaatgaggactgatttgtaagtgttacaacaatgcatggcttacaataaacaccttctagaatttagcgattttattcttcttattgacactctcctcattatttaactattgagttgagggaagcatcctttgaaattattcatttccttgcttcttgtgacagtgatgacaagaaaatgattactgttctgagtttattaatccactaagaaagaacttagtgcaattaacacccgttatccagagagaatactgtactctcaaaaatttaccatttgtgtgtaaactctgttgacttggttgatatgtcctcaactatgtgaaggctggatttctcaaatctgaaggccagcccctagaccaggaatgatgacttttccttgggcatatgcccatctactgcttttgacctacatccttgtccaatttcaattcctctctacctcatctcataatcacctcttggttaggcagaatttagccaagttatatttgtcatttttttcccagtggaataatgttgttttgttacatatttttaaaattaaaataaaatacagttaacataatatttaccatattaaccatttttaggtatacagttcaatagtgttaaatgtattcccgccattgtggaactaatctccatacttttccaacctgcaaaactgaaattctatgctcttttaacagcacctccacattccttctggctccctccacacctcagcacctggcaaccactattctactttctgtttctattaatttgatttctctagatacctcatacaagtggaataatataatatttgttattttgtgactggtttattcacttagcataatgtcctcaaagttcattcatgttgtagtatgtgtcagaatacaggtgaataatattttattatacatatatatcatattttgctgaataatataatgcagtataatattacattgtataaggttgaataatattctgtactatgtttaatagaatgcatataaggctgaataatattccattatatgcgtataccacattttatttatctattcatccatccattgacgagcacttgggtttcttccacctttggctatactgatgaaagcttttacaaacattatgtacaaatatatcttcaaacgcttatttaaaaaattcttaggacatatactcagaagtggaattgctggattatatggtaattctatttttaattttttgaggaacattgtgctgtttctcattgcaaccaggctgcacgatttcacattcccatcaacagggcacaagggtttcagtttcttcatatcattgccaactcttgtaatttatttctatctatacctatacaatatcaacatctatatcatctatttatatagtaaccccctgatggatgtgaagtgctatctcattgtgattttgatttgtattccctaacagttagtgaggttgagcatctttccatatgtaccttagtctgttagagctgctataacaagtaccaacaacctggtaatttacaaataagagaaatttatttctcacagttctggaagctggaaagtccaacatcaaggcccctgcagattctgagtccactaagggcccatttcttggctcaaatgatgatgtcttctcatggtatcctcacatgctggaaggaaatttggctctctggggtcccttttataagggggctgatcccattaatgagggatctgtcctcatggtttaatctcctgccaaaatgcccaccttctaataccatcacctcagtgttaggatttcagcataagaatttaggaggaacattcagaccatagaaatatactagttgaacatttgtatgtcttctttaaataaatgtctattcaaatcttttcccttttaaaattaagttaaatgctttttttttattatactttaagttttagggtacatgtgcacaacgtgcaggttagttacatatgtatacatgtgccatgttggtgtgctgaacccattaactcatcacgttgttgattgtagaagttccttatagattctggccattactccttattagatatattatttgcaaatactttcttccatttttaagattgctcttttaactcttttgattgtatctttgagacacagaagcttttaattttgatgtagtttcctttatctatttttacattagttgcctatgcttttggtatcatatccaataattccattgttaaatccattgttataaagctgttcttgtaggtttcttctaggagtttcatgttttcaggtattatgtttagatgtttaattcaattttaattactttttgtatgtaatgtaggagttcaacttaattcctttctatgtccataaccagtttttccaacactgtttgttaaaaagactattttttcccatggtgtacctgtcttagtgtgttttctgtatggggtaggagagagggcaaaggtgagagatttgttaatgaatgccttttatttctttcttttgaatcatccaaaaaatggataataaaatttatttgttttattaaaaactgattctttctgatatgtaccctgatatactcatgctggttctatactagtgtcacctaaatatcatcaaatgattgaagcttaggtttctcagttgtagaaaaacgatgtcccaactccttacatttcacacacacattctgtgaatttggtctctccttgacaaggccaaaaaaatgaaggattaatgatatggggaacaaagggctactaacctcaaaaaggtagcatggtatgttttctgattgctgtgagctgtgtgaactagggaaatgcttatctccttcatctagtgaatcaaccacagtaggcaagctgggctgagtctggcattaaagccagactttccttggtaagcagctctttaaaacccttcacttctgtgcaagaactgcataatattcttccattttagtcatcaaaggtctcttcagcactcaaaactcgactattggatggaaagatacagaagaggattctttactggactctatcagtacacacgattaattccagtctgagctggaggtaagaaacagtgctgtcatctttgggaatgagatcagcatgctggcctgaagaaggtctcctgataaattagtgaagtcctaaaggagataagtcagaccttacatggtggtactatcagtagaccaaaaattgttaggtgctttttgtttattcttaaactcacaaaatagctcaagggttaaaaataaataggcttccaagggtctacaagtgatagattaatatttattttaacatatttctctgcattaatccttagactttgtttttccattgggaggacagatctactcccttataatttttttttaaattgtctacttagaatctaaagtcagtcagttaaatttacttgtaacatctttgttgcccttgttcgtatctattccttggctgtttaacaggcccttttgcacaagccagtgatctcaaccctccgtaagggtttcaccttggattgctggcatgtttagaacagttcatccgtccagattttacacaatgagtgtaatacaaataaaggtttgttgaaaatgattgaattaattttttaaaatttctatttttctttttaataattgacagataattgtatctattaatggcaaacatagtgatgttttaatactcacgtagtgatcagatcagggtaattagcatatccatcatctcaaacatttatcatttctttgtgttgggaacagtcctccaagtgtcctccttctagctatttacagctatataatatgttactgtaaactagatcctacagtggtataaaacagtggtccccaaacctttttggcaccagagactgggtttgcagaaggcaattttcccacttccacaaactggggcgtggtggttttggaacaaaactgttccacctcagctcatcaggcattacttagattctcataaggagcacacaactagattcctggcatgcgctgttcacaatagggtttgatccatgagaatctgatgccatggctgatctgacagaaggcagagctcaggcagtaatgcttgctcgctcatggctcatctcctgctgcactgcactgtggcccagttcctaacaggccatggaccggtaccagtctatggcctgggggttggggactcctggtataaaacactagaccttaacttcctatctagctgtaatttcgtcctttatcacatttaccatttgccccaagaaatgagtgctggtcataagctgcactgttttctaaatgggaaattggttaacaaatttctcactgtcacttccttgcttctggtagcctctgtgttctactttttacttctatgaaatcaacttttttttgagcttccagatatgagttaaaacatgcagtatttaatgttctgctcctgcctcatttctctaaacataatgtcctcagttccattcatgttgccacaaatgacaggaattcattcttttcatggctgaatagtatttcattctttatatgtaccacattttgtttatccattcatctgttgttggcaaactaggttaatttcacatcttggctatcaggaagaatgcttcaataaacatggggatgcagatgtctcttatatataacgattttctttcctttggataaatgtccattcatgttactgcaaatgactgaatctcactctcttttatggctgaatagtactgtctttttcctcaggattctttgtctattagtggtcttttgtggttccataaaatttttagaatttgttcatttctatagaaaatgtcatcggtattttgttagggattgcattgcattgaatctgtagtttgctttcagtggtagtctcattttaacaatattaattcttccaagctgcgagtacgagatgtctttctacttgtttatatcctcttaaatttctttcattagtgttttgaaatttagcttctggagctctttaacttcctggtttagacatattactgggcgttttattacttttttatggctactgaaatcaggaagccttcttgattttttttccagctagtttttcatgtgcagagacaccactgatttttgtatgttaattttgtatcttgcaaagttactgaattcatttatcagttctaagggttattttggtagcatctttaggtttttctagatataagattatgtcacctgcaaacagagacaacttgacttcttcctttccaacctggacgccctgcacccaaatctttaggttttactataagtaaaattatgtcatctgcaaacagagacaatttgacttcctctttctaacttggatgccctgcacccaggtcttgggtctgcaaaacagccccttgggctacctatatcagattcaccagcaggctggctgagcagcaccgtgcctagtgctgggaccttagtgtcccagactttagaacactggatggtccatattaagcatgcaataaaactcagtgttacattaagagcagctattttttggcttacctaatcccccgtcttttaattctaggtgtctaaaagcaagcatttcattgcctgagtggatttgttaaccaggtagaatattcaggcaaggctaatatccattattctgccaaagagcatcctgagcaccctaaagatggagccattttcctgcctttgtgtgtgtcaacattggccttcattcgtccctgctgccagagtccctacttcccaattttgctgcattatattttgtgaacttacacttggtgattgtgtaggtggaaaatcacttctcttctttcactttaatgacaaaaaaactcaatatcactggtcattagagaaattcaaattaaaacacaatgaatactatttcacaccaatcagaatggctattattaagatgtcaaaaaataagtgctggtgaggttgcggagaaaagggaacaattattcactgtcggtgggaatgtaaattagttcagccgttgttgaaagcagtgtggcaatccctcaaagagctaaaagcagaactgtcattcaactgaggaatcccattactgagtatatacctagaggaatataaatcattctaccatagagacacatgcacgcaaatgctccttgcagcactattcacgatagcaaagacatggaatcaacctagatgtccatcaatgacagactggataaagaaaatgtggtacatatgcaccatggaatactatgcagccataaaaaagaacaagattatgtcttttgcgggaacatggatggagctggcggctattatccttagccaactaattcaggaacagaaaaccaaatactgcatgttctcacttataagtgggagctaaatgacaagaacttacgaacacaaagaagaaaacaatagacacttgggtatacttgagggtcgggggtgagaggaaggagaggagcagaaaagataactattgggtactgggcttaatacctgagcgatgaaaagatgtatacaacaaaccctcgtgacacgtgtttacctatgtagacatgtgttcacatgtatacccaaacctaaaataaaggttaaaaatgaaattaaaaaaagaaatactgcaaaaagaactaaaggacaatgatgtgtatatataacaaaaattttagctatgaatcatgttggaaaaaaaaacaatagtagacatcctttctaaggtgactggaaaacaatgtaagtgtagaaatctcattgacaattgagtatattggtctagaattaatgataaatgcacatgggtggaggtataaattgtgacttgtattgcatatctggtaatgagagcatgggaatgcagaaaatatttgtttgatggagtcatctgtagtctgtcaaactatctgataccagtgtcaggaggatataaggttacatctcactactttctcagttatattcacacttagtaaactgaggaagtgcttaggtaatggtaagaaagctagggaatattttgagcacacctgaaaccacctaatacaggaatatcttactgacagaagtaacctatgccctgccaaagggggttgagtcgggaagagttggatgtcaggacacatggctgtgtgcatattgtattgatcaagctagactttgtcacttcagaacatagggtgtcattagagacatgacaattacttttgaggtgagatggtgccatgaaaagatgaaaataatgctggttttggaatttaaattccctcacccattatacctgaaaataactaggatttgcacaatgaatattggcaccaactgaaagagtcattataccaataagaaaagagtggaagagagagccacctctactacaatcctggacacttgtcccaggtgcaggccttccagaagtgaaaactattgtgttcctgatttaaaagggaaacatggtaaaagatcttcagatagcttgaggaccaagattcacacactacacatgtagccaggccagtagcacctacaagattttcagtggcctcctccatctttataacaatggtgctagcaatgttcttaggcctccctgcagcattcatggctgtgaaccaccaaagagccaaggtttgatcagcaggggaatatttatgcttcagagacaatgaggagactttctttcctcctgtctaatgaacagatatgactttgtacttcctgggggcagtacaaaggaactggatggagccagttacagaaggctgaggccactgctttactccttgaggtgctgtagcaaatctttaatctcttcagtgcagaggatgccgttgctgctttgaatgagacacttggtggaaattcctccctgcatatcagcaccagcagaaagacttgaagacctattgaaatcaggagaaaacagtagaagaaatctctgagctaagtgaatacttcctgatggctatgaagaggtacttcaaggaaccagtctctatctaaaagaaaaggaatacaatgaggctgggcatggtggcttacccctgtaatctcagaactttgggaggccaaggtgggcagatcatttgaggtcaggagtttgagaccaccctgatcaacatagtgaaatcctgtctccactaaaactacaaaaataaataaataaataaataaaatagccgggtatgcggatgcacacctgtagtcccagctgctcgggaggctgaggcaggagaatcgcttgaacctggcaggtggaggtggcagtgagccaagatcacaccactgcactccagcctgggtgacagagcgagactctgtctcaaaaaaaaaaaaaaaaaaaaaaggaaagaaagaaagaaagaaaagaaaaaaatacaatgaatgtgcctaagttgttgtcagtaaaatataagacccagttgtctttatcataaatatgttaagaaaagccaaaatttagatgaccttgtgtttggcaatgactttagatagaacaacaaagacatgatccatgatctattagagaataaatttgtaaactggatttcattaaaattaaaaacttatgcttttcaaaagatgctgtcaagagaatatgaaaagctacatattgggagaaatatgttttcaaggacatatctgataaatggctgttatctcaaatacgcaaagagtggtacgtatacacaatggagtactataaagccataaaaagaatgagatcctgtcatttaaaacaacagattctgtataccaaggcaattttcacggtatacaatggcaaaaactttttgttcacctttaaagttacaggaaaacttgaggtaaaaataaatgaactataattctgtccatttgttaaaacctgtggaactatgcaccaaaaggtgtgaattttactgtatgtaaatttttaaaaactcaaccacattggcagtagataccaggattgaatctagatgatgacaaattaatgtaattgatgtatgacataaccactctgaaagtgacaaatactctgtctagccatgtggtgactagatactttaaggtgaaacacaaaagggttgtacacaaacactgtatgctagttggtagaattgtttctcacagaaattctagttagtagttccgaaacattatgtgtattattagacttgagtaaataggtaaaaatattgttactaacaaaaaccaagtatctcagagttggaaaaagaagtttcaaataatgaaaatggaaaggctagaattaaccttattgtgctggattagaatcaaagatatttgtatagtctcatgtttgctttagtctttacttagatataggtgtggacagaaataaatataggtatgtgtatataaaaaattagtatacgtatatgtactacttatattcctatctctgtcactgagaggacctaaaagcagtgacatcctagtactgctaagcacatgtagctctcagatcttgtcttctaaaataccaatctccaataaaaggcattaatacatcttggagaaatgactgattcttggtctgtgtcatggaaatacaaggatactggagtatcttgtggtgccagaagatgaagaagtatgcaaaaacaaaatgtataggtacatgtcaaaaggacacagaagccagccttaatgagcttccaatagccaaagctgggacaactagagtaacacaatagataatgatagtattttattatcacataaagaatggaataaatatccatgagtttatactaatataagtaatgagtaaataaatacatttattgggaagggaggccaactccatctttcaaaagcatttcaaataataaatgtacaaggaacgaggaaaatagaatatcatagtcagaacatcataaatataattgcaacaggcaagatctactgttgaatcataaaatcaataagcaaagccttgaagagaatgaggataactgcatatcctcaatgtatctccctccaaaagatttttaaattactgtgaagctttaacacatgtcaacaaagtctttgatacttctctttccatggggtggagcttaatttccctccttttgagtgtaagctcacattagtgacgtgttaccaatataaagagtatggaaaggaaaaatagcaactttgtattggagaaaacaggcatatccaaactttaccaagtgaataagtttaatatcagcagtaataaggcaacatattgatatatatctcctatatcacttgatgtgacaagattcactctattgtattcatcttttacatctataattttaatataataatgagaaaatgcactcacatccaaattgatgggcattctacaaaaataattgactaatattctttaaaaagtttcaaggtcatgaaagtcaggaaagactgagcgtgtatggcagattagagaagaataaagagaaatgacaatgaaatgcaatatgggatcctggagagattccttgaataggaaaaagacatcaataaaaaattgaggaaatctgagtgaagtctgaagtttaattagggttagtacaccaatcttgatttcttagttttgatagttgtgccatggctatgtaagctgttaaccttaggagaagtgagtgaagggaatagaggactctctgtactacatttacaactctgcatatctaaaattgtttcaaaataaaagttaaaaagtccaaaattcttatacagatgatttaaatttttactagtgtatttcattaattgaaatcatcattaaattcccatttttccataaaagatgtaaaatttcatatgccattttaagtgtttagaagatagttctgtctcttactctttatccctttagggttctgaaaggctctcttcttcaccaaatgttagtcaggctcctctgagctctctttttgaatagaccatgtcttggagtccactcttagttctgcctggtccagatgtagcaagaatcttcctaagtcagttttatgagaattcctgtaccctagatatctgactgccctggctttactttggcaaaaattctgttaagttgatttagcaaggattttcttagtgattttctatccatagactttctcattctgcttgttggctacaaatccaaggctgtctttgttatattcagaattgagttcagattgatctctctcccctattgtgatagttttggcatctgttgcaagagtcctaaattaagtcttccttaccgtaataccaagtgtcagcataatgtttttgtttaccagttcctcaaagtaagtcagcgcaatcaacacagcagcaaactcagctgacctacaacataaaaggcatcaaccagctgaaaagtcaggtgattcagaatcttttgtcatctcagtcctcctcctctaatgcactggacttccccatttccccagaagtgtttctatttccacacctttaatctccttagagagcccttccagatgagccttccctgaactctgcaccttaccttggtttagttctaatttagctcatttcaatatcctgatcatgacttagtcttaattaggattgcactaaacaggtagaaatctaaagcactatggatatttgaataactgagtagaaatatgtagggtttcaaacaattgcttatgaatatatttactgcaatgaaccaagtgtttgacaaatacattcaagcatataaaatataatctcaaggaaacaaaactagaatataatgtgtaagcaaaatgggacccaatttaattgtaatgtaacatgttggcatgatcaaatggggaatttcagtgaagaagactagtaaacagctgaagagaaagactctgtcattacctaggcaggactctactgggaaaatattgatcaatctagaaatcgctctagttcttatgaccagaaatattcctgggagcatgtaagaactgagggctcagtcagattttgggttcaaacaatggcttcataatttgatagttccttatacttctattttttattttgtaaataggaataacagtagaacctatcagtcttctttggtcactgatatctccagtgaattaatgggggtagacacatggtaggtgttcagttaatatgaaaaataagagtattcattattggtaaagggagcatcaattttgtaagtgctaagaacaatgtctgactaaaaataaacacattcaacaatttaggtatttggttccttttaatcactatttttattatcgaactttactaggttgcagaaagtgtcctttgacattatcaattcccttgtttcttgtaagagatgtgataagaaaaatattgatctcttgagtttatttatacactaagggagaacttggtacatcatcacttacctattatgcagagagtatattgtactctcaaatttttgccttttttatgtataaactcttgtggttggtgtgtgtcccatgactctctgtgaaggctggattcagcaaagctgaaaacacacccctgaccaggaatgattactattcttccagcccatgctcatttgctccctttgatctacatctcttccacaattttgcttctgctcttccccttcctttaatttccatcgtgactggaattaatgtaggtaaattctatttcatcattatttttttccattaagatattttttccttttaacattttaatcacatttagatacacgtttgttttcttcttgtctccattctttaggatgcaaaagtaacaacttttgttttcaatgaaaatgaaaattagaaacaaatatctctggtgtctggcatggcatgtaaaacaattgtacagcccatatatgttatcacatttacctcccatcatgaacatttaggacaaaaattgtttcatttagttagataagaatcaactagtattggaacctttgcaggttctttggaaatttgaattttaatgtacaaatttttttaatccaactgattttttctcaattgtgtagtctcattgggtatgatattgctctcaaaggaacaataagttaattcttgggagcaggaacaaatcttacctatttcaatggtttgtggccctttaaagctcaactctatctgaaaaaaaacttatcccttagcattttttaattgagtattcttgtgtatcacatgagaagcattgacattgagtccatggaagatacacaaaaggtatataagatcagtgctgcaaacctatggcaaatgggtgctgtgagtagaggacatttcaaggtttactagatgactaagtcatatcatgagaggtgtccactgcatacatatgtgctgtcatttgccatctcgtggatgttgcttatgtctgatccttagcaattctgaacgtgttgtgggctttgagaattaaaaatactttatattatattatttaattatactgatattgttcaacacatcattaattgtctcagcactgaaaagagaacaatcttgacaatatctggatgaatatctagcagctactgaagtcaaaagttttccccatgaagcaaaattaaaagttaagtgcactaacagttaatgttaaaaaataatttaaattttaagtctttagcaggtttgaatgacttttaagtattttattatattaggtattattatttgtttttataacttgttaatttggtcatgtaatttgacacattacaatttatataagtgaataaattatataaaaatcactttaaaatttagatatggagttaagttaaatattcatgggttttaaatttaactattaacttttagcttaaaatgtttagtcattcttaaccctccattgaataaaaacattaaactttatactgcttatatatagagatgtgtgcatagaacatcagcagatatatagtatatctatgttattaaatattagtgggaatttgaattacagagacatttctaaaaagactatggggaaggagaagaggaggtaataatgaaaaagaagtagttaagaaactgctctacagccctgtagagagagcataaaggaaaacaaaaacagaaatagaaaataagagagggggcattcagaaaatagaaactagtgtgttccctatttaaggttacgtacaaaataaggtcttcagataacctaaaatccagagttcagagtcactctctcagccagcccagtagcatctgaaacatccccaatggacttgccctttagtttactgatggctatgatggtgctcagctgcaagtccatctgcctctgggctgtgatctgcctcaggcccacagcgtgggtaacaggagggccttcatactcctgacacaaatgaggagaatctctcctttttcttacttgaaggacagacatgactttgattttccatcatcaggtgtttcatggcaaccacttccagaaggttcaagctatcttccttttccatgagatgatgcagcagaccttcaacctcttcagcacaaaggactcatctgatacttgggatgcgacccttttagacaaattctacactgaactttaccagcagctgaatgacctggaagcctgtgtgatgtagaaggttggagtggaagagactcccctgaggaatgtggactccatcctggctgtgagaaaatactttcaaagaatcactctttatctgacaaagaagaagtatagcccttgttcctgggaggctgtcagagcagaaatcatgagatccttctctttatgaacgaacttgcaggaaagattaaggaggaaggaatgaaaactggttcaacatggaaatgagaaacatttccatgattaatacatcatctcacacgttcatgaattctgccatttctcatttttgctatatccatgacatgagttgaatcaaaattttaaaatgttttcaggaatgttaagcagcatcatgttcagctgtacaggcactagttccttacggatgatcatgctgatggatctgtttatctatttgtctaaataattatttaactatttatactatttaaaatcttcttttcatgtatcatgtatttttactttgtggttaatataacaatacatgttctttatatttagtcaatatattactttgcttttttcattaaatttttactatggaaaactccttgtatttgtttattctttaaaatgaaactccaagcctgattatttaacctgattaaaaaatagattatacgattcagttacctattattggttataagtcaaaatagatttttctataccagattgtatgttgtatgttgccttcaggatataaaattgaaaaaacaaatacatttcctgttctcatgtacctttgatttttgtgaggaaagaaacttataaacaataatcgttctcaattgatatcagttatgttaaatgctataatgtgagataggaaaaaaaaaacaatgaatttctcatagaagaggatggatttaggcattccagaaataaaaataaaagaagcaatatcctcaataaattgacttctaaacatacaattgcaaatgtgtatttccagtcagatatatgaatttgcaattttcaagaaatacaatgcctgaaggttcataactggcaatggaaagcccaaaaatagaggcagtcatgtggagaggaaaaagaaaagtaaaggaaaaaagaacctaaaattgattctgaggaccttccacctttaaagagaggggatataagagacacaaaggaagcaagggtggaaaactgtacattagtgaaggaaagacttaatggtgataaatgtgtgtcttgaaaataaatgtatttagaagaagaatcaatagacttgggggaaatatggattaaaactgtccactacatcagaaaaataaatggcagtggagatcttagtgagagctgcattggtagaattaatcactataaaccgtattgcagtaggtggaagcatgaatcaaagaagggaaatctgtgacaaaatagataagaaatagttgtgagaggtttccctttaagataaaggaaagaaataaggttagacatgaaaaaaaaagtggatcacatttcattttacctgcatggtttatccgtttgaaaatatatatgtctgcagattgatttcatgcattgaaaagctgttaatatacttaatattttataatatcaaattataacatataaagttgcaataattataattttgattagtactatgttaattgtcagtaaaacctgacaaacttccttcataaaataaaatggaaaactggatgaaagaatcgctttctcaacgctttaagaaaacaaaaaaagattggtcacaagtatcaatagccaaatcaatcaagtggaagaaacgatatcagagattgaagatcaacttaatgaaataaagtgtgaaggcaagattagagaaaaaagaatgaaaagaaatgaacagactctaagaaatatgggactacgtgaaaagaccaaacgtacgtttgattcgtgtacctaaaagtgaaggggagaatggaaccaagttgggaaacactcttcaggatattacccaggagaacttccccaacctggcaagacaggtcaacattcaaattcaggaaacacagagaacaccacaaaggtactccttgagaaaagcaaactcaatacacataatcgtcagattcaccaaggctgaaatgaaggaaaaaatgttgagggcagccagagagaaaggtcggattacccaaaaagagaagcccatcagatcaacagtgcatctctctgcagaaactctacaagccagtaaagagtggggcccaatattcaacattcttaaaagaattttcaacccagaatttcatattcagtcaatctaagcttcataagcaaaggaaaaataaaattcattacagaaaagcaaatgctgagagattttgtcaccactaggcctgccctacaagagctcctgaaggaagcactaaatatgaaaaggaaaaaccagtaccagtcactacaaaaacatatcaaattgtgaagaccattgaaactatgaagaaactgcatcaactaatgggcaaaataaccagctagcatcattatgacaggatcaaatgcacacataacaatattaaccttaaatgtaaatgggcaaaatgccccaattaaaagacacagactggcaaattggatagagtcaagacccatcggtgtgctgtattcaggagacccatctcacatgcaaagacacataaactcaaaataaagggatggaggaatatttaccaagcaaatggaaagcaaaaaaaaaaaaaaaaaaaaaaaaaaagctggggttgcaattctggtctctgataaaacagactttaaaccaacaaagatcaaaaagaaaaagaagacaaagaagggctttacataatgttaaagggatcaatgcaacaagaagagctaactattctaactatatatgcacccaatactggagcacccagattcataaagcaagttcttagagacctacaaagaggtttagactcccacacaataatagtgggagaatttaacaccccactgtcaatattagacagatcaacaagacagaaaattaacaaggatattcaggacttgaactcagctctggaccaagcagacctaatagacatctgcagaactttccaccccaaattaacagaatacacattcttctcagcatcacgtcacacttattctaaaattgaccacataattggaaataaaacactcctcagtaaacgcaaaagaatggaaatcaaaacaaacagtctctcagaccacaatgcaatcaagttagaactcgggattaagaaactcactcaaaaccccacaactacatggaaactgaacaacctgctcctgaatggctactggataaataatgaaattaaggcagaagtacataagttctttgaaaccaattagaacaaagacacagtgtaccagaatctctgaaacacggctaaaacagtgtttagaggaaaatttatagcactaaatgcccacaggagaaagcaggaaggatctaaaatcgacaccctaacatcacaattaaaagaactagagaaacaggagcaaacaaattcaaatgctagcagaaaacaacaaataactaagatcagagtgtaactgaaggagatagagacacgaaaaacccttcaaagaatcagtaaatccaggagctggttttttggacagattaacaaaatagatagaccgctggccagactaacaaagaagaaaagagagaagaatcaaatagacacaataaaaaatgataaagaggatatcatcactgatcccacagaaatacaaactaccatcagagaatactataaacacctctgtgcaaataaactagaaaatctagaagaaatggataaattcctggacacacacaccctcccaagactaaactaggaagaagttgaatcccatttcagctttctacatatggctagccagttttcctagcaccatttattaaatagggaatcctttctccatttcttgttttcgtcaggtttgtcaaagatcagatggttgtagatgtgtggtattatttctgagggctctgttctgttccattggtctgtatctctattttggtaccagtaccatgctgttttggttactgtagccttgaagtatagtttgaagtcaggtagcatgatgcctccagctttgttcttttgacttaggattggcttggcaatgcgggctcttttctggttccatatgaactttaaagtagttttttccaattatgtgaagaaagtcatcagtagcttgatggggatggcattgaatctataaattaccttgggcagtatggccattttcacgatattgattcttcctacccatgagcatggaatgttcttccatttgtttgtatcctcttttatttcattaagcagtggtttgcagttctccttgaagaggtgcttcacatcccttgtaagttggattcctaggtattttattctctttgaagcaattgtgaatgggagttcactcatgatttggctctctgtctgttactggtgtataggaatgcttgtgatttttgcacattgattttgtatcctgagactgcttaagttgcttatcagcttaaggagattttgggctgaagtgtttgggttttctaaatatgcaatcatgtcttctgcaaacagagacgatttgacttcctcttttcctaattgaataccctttatttctttctcctgcctgatttccctggccagaacttccaacattatgttgaataggagtggtaagagagggcagaacaaaaattaattcaagatgaattaaagacttaaatgttagacctaaaaccataaaaaccccagaagaaaacctaggcaataccatacaggacataggcatgggcaaggacttcatgactacaacaccaaaagcaatggcaacaaaagtcaaaattgacaaatgggatctaattaaactaaagagcttctgcacagcaaaagaaactaccatcagattgaacaggcaacctacagaatgggagaaaatttttgcaatctacccatctgacaaagggctaatatcaagaatctacaaagaacttaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagtgagactctgcctcaaaaaataagtaaataataaataaaaatacaaaataaaataaaagattggtcaaaatcagccgaaaatacaacatgaaccaaggatatacagagagcaggagagagttgtgtataatccaggaatcaaaagagagttaaaattattgcagaaattcccaatacaaagcttacacattagttgtaaataacaataaaaaatttaacattgaaatttcactctgtttgcatgtatgtgtgatgttgaaaaaaagcacttaatatctctgagcctcagtttcttataaatagaaaggattagaaatacttacatagttgttgtgattcttaaatgaacgcaggcagttgaaagcagtttgcatagtattctccatagtgtaaggatttaacacatggcaagtatttttctatttttcttcacacagttgtagatgagaatattatttgtctttctacaaaattcataagaattgtgtcctaccattcagtaactgactttcaatggagacagcgttaaaaaaaaaaaaaaaacagtattctgtcatgaattctagaaaggttaaaaatttgtcgctcctcatttcaaagaagtgtcctatttgcattcagtcaggaaatgttggtttgtatgaatacctgaaagaaaagaagcagcatgtagattgaaatgcagaagacacataatgcctattaactgattctggcacctggcacgttccttttctggctctcagaattccagcatacgctcccatatgaagttagtctcctaaactaagtgaaatatacatagtagcctttgctggttctgagacctggtccacttccccatttcctctctgcttttctggatcccatttttcactcccatatcacattagattcctttctcttcctctagaaattcccactgtgctctcctcttcactcttcattagcctgcagtgcctattcacacagctgatttctgttctcttgtggggtttgcccatcactttccccttatgaatacaaaactgcaaattaaagccgaccttgagtgaaagttctagttttttcagacactcttatataacaggctgtttttcttttcttaggaatatttctggaaaaagagggaatgtcccttttataatgatgtaacagtagctttgcaaaggggaaataaaaggcaggttctgtggagtcttaattcggaaaaaagagtagggctggtgggagcaggagaaagcaaaaagaggaagcaggtagaaaacaagcttgcttttctttatagtctgggacacacagtcctcctgctcaaatcattcataatatttctgtacccagctatcagtagacatctgcaagttagctcactgcaacctttgtgttatcaataccacacaaagccctcttcaacagacagcatagattttatcctataaaatctccagcaagcctttctctcctggcagtcagcttctcttccactggctgcctgttgtctctctggcaacatattttcctaataaattttctgccttcctttacctacaactgtcttggtaaatcctttgagccccatgccaccagcactcagtcttccacaataggctccattttactctgaggctgttaaaacatttacaggaaaagagagccaccgatgaccaaaatgcaccaagacagcggccaagtctgtgaggagcagcttttctgcttatgcagaagtgtgtccctggcaggagatttcatttcagagttaaaaagaggctctttcctgtcaggaactgaccccagtatgggaataagcactttttcttaatgtttgtatcttagagaaaatactcccagcctcaggcacattttaactttttttggcaatggatggctatgtggggaaaaaagggtcaggatgtgttccttacctccagcctggccagcctccaagggcctcctgttccatccctccctctatgtattctgttatataaggaatcagtacagccagccaatctgggtgcagaactccaatggaaatcaggaaaaaaaatctcatttgaaggcacattagctctttcttacaagtaagttgtcagttttagaaattctttcctattctcagattctgtcccttgactttactatcatgagaaaattctcactctcactttgaataacaaatgagcttggatcaattccaccttgactctgagttagagcactgccataagtaaagagatttcagagactataatgactcccaattgacacctgtttgctacctatttgggtagaattgaagcatactgaggtaatctgctcaaaattgttaactgaagaagttaatcagtaagtgtgtgtaaattgcccaggtgtgaattccccagacagtaacgcagggtttcaacttcgcagagatcgctcaaatctctacctcagattagagacccaattttaaattccttttctcctattgatgggttagagtgctctgatttacatattaaacaatgtttgttcctatcttttctttcctcttcaatcacttgttgggaaaccaggataggagcagggtgacatgcatattttttgataaacctgactctgtctttgtgattccctaacacctttcaattgtgattccctaacacatttcaaatgtgataaccccttccattatttggttgctgttgtttttttaatgtaacttactttcattatattttctggatgcaaattttttatgacttggctccacactgatatcttgtcctggaacagtaagctacagccatatattttttatatcctggagctattgtcaatgaaaagagtcaaatttcataaaatatttgaagagatttattctgagccaaatatgagtgaccattgcctgtgacacttggctcaggagatcccaagaacatatacccgaggaggttggggtgcagcttggttttatatattttaaggagacatgagactttaatcaaatacatttaagaaatacattggttcagtccagaaaggtgggacaggtcgaagcatgggggcttccaggttataggtagatttaaaatttttctgactggtaattggttgaaagagttattattaatagaaaggaaagcctgggttgcaataagttgtagagaccaaaattttatgcagatgaagcttccaggtagcaggcttcagagagaatagattgtaaaagcttcttatgagacttaagttctgtgttgatgttaatgccagggagagttccaatgaagcatgtccaactgtcatgcctgaaccagtctttcaggttaaattttaagaataccctgtcagaggaggaagttcattcaggtggtttgggggccttataattttatgtttataatttacatgttatatatgctacagtattggggaactgagtggcaaatctggaggaacctgggcagggagtgcaatggagtgcatgagcactgaggtggctgacccttgcccccaggtcctgctgcgaacttcactttacttcctccacccccaccccaggtaaagtgcatctagtaaacctaaaaagggcatggagagccccctggtgcacaggaagacttggctaaggatcaatcactatgcagcaccagctggagacagccaagtttctgaagcctcagggcaaggggtgagcatggctttgcttctccttcctgccaggtgattcatgagctacaagggttacaacccaaggaagtccaattcagcacaaccatggttagtggaaagcaccctgcccacagatctgcacccaaagagctggtaggaatgcaaaaactcatctgtgcttctattcaaaagtttccaaattctaattccacttgaagagactgcagaagacccagggctctcatttgtttaaaaatctaaagctcacaacattaacttgaagaaggtactcaagagctggaacaattccagtgggagcactaagtcaactgttcagatcattgcaattaggagagaagattaaattggttgctaagagcacagagtttcctcatggagatgtggccaacatcagtgtcttcagcataggttaccctgataccacagcagactgagagtattgaaaggggcaagggttattccagtgtcagctgtaaaattctgtttcctccctaggactcagtaagttatcacagtgcaggaaaaattattcatagggccaatgaaatccaagacatctcatgaattctggtcacaatggagacttcgtttaaaaacaaaacaaaatgaaacaacacctgaacagaagacataaaggcaggtatctcccataaggaaagatgtgattaatgtagacattgcaagatcacaatttcgaatgcagcaaagacctttgcaaaattcattcatttaacttagttgagaagacaatgacactttaattatctttattttctttccagttggtgcactttgcactaagtagttacatttagaattagaaacccttcctgaggattaaggttgttaaaagaaaaacttcagccaaattaaattgaaaggagtttaattgagcaacgaacgattcatgaattgggtagcccccagaatcacagcagattcagaaagacaccagggttgccttgtagtcagaacaaatttatagacaaaaaaagtaaaatgacgtacagaaatcagaagtgagctacaaaaacagctagattggttacagcttggcatttgccttatttgaacacagtttgaacactcagcagtgtatgactggttgaggtatggctgctgggattggtcaagactcagctattgatacagactcatattcttaagttaggttttcaatcttgtctacctattaaattaggttgcagttcatccacaaggacttaaatatagaagtatggagtccttctcaagctgtatttagtttgctctaacagggtccatgaaacaaggatatcaaacctagataaataatatattagaactattaggcatgaatgtgagtagctaaagttttgttatatagcagcctgtgacagttaatcatgaaacttgtgacaattaagtctttaaaaagtcaaaaacacatgcaaacacaaaccttatgtgaatggaaattccacctatgccttttaaaagggttgctgtgattccatgttaagcaagctgtgtcctgcactaatagcactagggtaccacaccaactccctcaatagccatcaagacacctagacatgggtatatgcacaaatgaactgaatgtgcactctgggaccaggggaaagagcttcttttgtctctgtgcctgggtaggtcatacatgtttgtacacataggcaggcaggccaagatcttggcaatgatggggtatgcttctcttaaatctgtaaattcaatgttatcatgagaaaataccacacatatccaaattgatggacattctacaaaacagctgatcaattttatttaaaagcctcaagataatgaaagactaggaaagactgagcatgtgttatagattggaggagactaaagaaataaaacaaataaatgcagtgtgggatcctggattgattcttgaaacagaaaaataatgttaatgaaaaaaacggatgaaatctaaagtttagatggtaatataatatcaatgttaatttatttgtttgaataattgtaccatgattatgttgtgtatattactgggatgaacaaattatttttcaaatgtatttgaatttataaagataaattctcaaggagacaaaactaggatagaacatgtgtaagtaaaatagggctcaatatattcattatgaaacacatctggcataagcaaatgggactttacagtgaagaagcataacagctgaagagaatgacttttttattccttaggcaggactctactggaaaagcattgatcagtctagaaatcacctctggttcttttgaccaaaacatgtcccaagagcatgtaagagctgaggattcagagtcagattttctgcattccaacagtggctccacaattcaataactccctatacttctgtattttcttctgtaaataggaataataatataacttaccactgtccgctttggtcactgtgctactcacggttctccagcaagacaaaatcagtatatatatgtatatagatgtaataaatatatataataattacatataataaatatggagaccctaggatgctggtagtgtggctcagttcaagtctgaaggcctcagaataagggaagtggataatgaaattctcagtcccaggccaaagtcctgagaaccgaagggcttctggtttaagccctggagtccaaagatcggggagcttggacttgttgttgaaggacaggggagaaagagtgcatcatggtttcagtggatagatccacgcatctgtcttttatcagtttcgttctctctagattcccagcagatcacatggtgcccacccacactgaaggtggatcttccccacttagcccattaagacacatatgctaatctcctctggaaacaccctgggatacaccccaaaataatgcttgaccaaaattgctaggtattcctaatgcaatcaagtttacacctaaaattaaccatcagagacactgatatctatagggactaaatggaattggccactggtacacattcaataaatatgaaaaatgcaggtattcctcatgaggtgaaatgaggattaatttgtaagtgttaacaatgtgtgactgacaataaacattttctagaatttagctatttcattcttcgtattaacactattctcgttatttaattctgttaagttaaacaatgtgggagaagcattgtttgaaatcatgtatttccttgctttttgtgacagtcacaacaaggaaattattgatcttctggatatattaatccactaggaaagaacttagtgcaattaacacttacctattatccacagagaatactgtactttcaaaaatttacctttctgtatataaactcttgtgacttggttatgtccttcttaactctgaagcctagaataatcaaatctgaaagccaacccctagaccaggaatgatgacttttcctcgagcccatgcccatctgctgcttttggtctacatcccttctccaatgttgattcccctctacctcatcctttaatcactgcttggctgggctgaatttagctaagttatattttagcattgttttccaaggaataatgttgcccttgttacctatttttaaaattaagataaagtacagttagcagaaaatttaccaccttaaccattttttggtatacagttcagtagtattaactgcattcacagcattatggaactaatctccagacttttccatcttgcaaaactgaaattctatgctccttaaataacatctctccactccttccagctcctgccatccctaagcctctggcaaccactattctactatctgtttttatgaatttgactactctagatacttcatataggtgcaatcatacagtatttgctattttgtgactggcttatttcacttagcataatgtactcaaggttcatccatgttgcagcatgtgtcagaataagattgaataacatttcattatatgtatataccacattttactgaataatattatgaaaaataatactccattgtaaaaagctgaataatattccatgatgtgtttaatggaatgcatataaggcttaataatattccattatatgtatacactacattttatttatctattcatccatccattgatgagcacttggattacttctaccttttggctacagtaaagaaagcttttataaacatggtatataaatatttcttcaaaccctgctttgaaaaattgtttgggatatatacccagaagtggaaattttggattatatagtaattctatttttaagtttttaaggaacatcacactgttttccattacaactatgctacatcattttatattcccacaaacagggcacaagtctttccatttctctacatcatgccaactcttgttatttggggtgttttttaaagtactaaccaccctgatggatgtgaagtgatatctcattgtgattttgatttgtatcccctaacagttagtgaggttgagcatctttccatatgtgccttagtctgttagagctgctataacaagtaccatcaacttggtaattcacaaataagagaaatttatttcttacagttctggaagctggaaagtccaacatcaaggcccctgcagattctgaatccactgagggcccatttcttggctcaaatgatggtgtcttcttgaggtatcctcacatgctggaaggaaagttggctctctggggtctcttttataagggtgctaatcccattaatgagggatctgccctcatggtttaatctgctgccaaaatgcctaccttctaataccatcacttcagtgttaggatttcagcataagaatttaggaggaacattcagaccatagaaatatactagttggtcatttgtatgtcttctttaaataaatgtctattcaaatcttttccctttttaaattaagttaaatgctttttgttgttgattgtagaagttccttatagattctggccattaccccttattagatgtattatttgcaaatattttcttccatttttaagattgcctttttaactcttttgattgtatctttgagacacagaagtttttaattttgatgtagtttcatttatccatgttcaggaaataatttttcaagttttaaaaaaggttttgaatgacttttaagtctaccattgtatcagtgttataaatgtgtatttataaatttttaatttgtgatgatgaggatgtggagaaaagggaaatctcgtacactgttgattggaatttaaattagtacaaccactatggagaacaatttgaacattcctcagaaaactaaaaatcaggccaccttatgatccagcaatcccaaaactgtatatgtacacaaaagaaaggaaatcagtatgtccaagagatatctacactactatgttgcagcactggttacaacagctaagatttggaaataacctaagtgtccactaacagatgaatggtaaaggaaatgtagttcatacacacaatgcagtactattcaaccataaaaatgatgagaccctgtcatctgaaaaatgcagatatccctcatcagatgaaatgaggattaatttgtaagtgttaataatgtgtgactaacaaacaccttcaatcttcgttgaatcccctgtgaccagctcagcaacttgaagcataagaagtgttcaatgatttaatgaattaatctcaacatagacatcaacatttggcaaaataaaattacttttattctttataacaagagggaaaaattactgataatgtatactaaggtatataaaaattaggagtttcaggatgggcatgatggttcatacctgtaatcccagctctttgggagactgaggtggtcagatcacttgaggtcagaaatttgagaccagcctggcaaacatggtgaaacccattctctgctaaaaaaggacagtaacaacaaaaaattagctgggtgtggtggcatacacctgtagtcccagctacttgggaggctgaagtggaataattgcttgaaccaggaggcagagattgcagtgagccgaggtcacaccactgccctccagcctgggtgacagagtaagactctatctcaaaaaaaaaaaaaaaaaaaaaaaagggattaggagttttacgtaattttggaacacacaccaatagcacattgataaagggcagattaatgctttaataaaactgtttgcttttattttaatgctcaatttaaatgaaaattgaataatacccctttaactttagccaatatgattacacacagaatttcttctgcaagattaatatttcagaaaccttccacaacttggttaaacctttagctttatcctatctaaattaaaacaatccttaaatcctctaaacaagacaaaaatccacattcccatgcctttttataatcttttaccaaaagcacatttgactttccttacgtaccttgcacgtaaaactgtttttcaagtagtctcaaatacatgttacactgtttaactcttagaaactttttatgaaaacctggtgtatcactctgttcacatgctgctaataaagacctacctgagactgagtaatttatacaggaaagaggtttaattgactcacagttcaccatggcttgagaggcctcaggaaacttacaatcatggtggaaggggaagcaaacatgtccttctttacatggcagcaggaagagaattgctgagcaaaggggaaaagccccttataaaaccatcagatctcatgaaaactcactatcacaagaacagcaacatgggggtaatcgcccccttgattcaattaactcccactgggtcccttccacaacatgtggggattatgggaactacaattcgagatgatattttagtggggacacagccaaatcttatcagctggtaagtaagtaattctaattatatatgaggttttgagcctaggataccagacagaaatgcagataaggtctgactccagtatagctagggtgcatggctaactctgtcaccaggccttacctagctttaaagcagacaagtagttgtatagttaagaatcatagtaacagttaattagcaggcctattaacctttaaattgtacaagatttctttcataaatttcctttcactaatcttttcacaacgtgggccacttatgacatacttggactttctgacttgtcctaaatatctttctttttaaacaaccagttattttactttgggacaagaatttaccaaacaaaattctttctcatacaaaatccattttctttataaccttccttcccagaaatacctctttacctttataacctttgaatcagacaagtcattttccttctattagaaagttaaggattttactgcatgttgctgtgccagttctgtgaagggggagtaaatgaggaggttatttacatactgtagaagttatctccactcaagagattgttcagttcaatttttgctagggctcgtcaacctaagtgtgggctattctaaaccctgaggtaagacggtccaggttgaagttaatttgttcatgttttaggtagctttcctggaagaaatagtgctattagaaggaaagatgaattcaaaagttgtgtaaatactaagtaggcatccaacttgaaagtatatttttccccaaagaggtgcgaatcttttcttttggatgaaggaggtgccattttttcccattactcagtagcatttggaggagagttgctcagagaaggatattagcacagagtaggcagctcttgaacccaaaagggaaatgtacaatgttactttctgcctccagagttgcccttggctttgttctgttgatgatgctttctgatttggaagccagtcatagcagagagcccctttggctcaaggccatcaaaggttgggatcccttcctcggacccttcagcccttggggcagtctcattccagtggccaagcttgtggcagagagggcaagctgcacatggctttttcccatttatcccaccggggcagtttgtcttctagtggcctggattgccacaccagtggcagttacgtgaaggaatgtccttagggcaacctggagggagttggagagctccagcctctattgcagagcagccaatagttcagcctgccttttccccctgcatttctctttttccttaggcttgtcttccttgtcctgatctcagttataaaagactgaggaggctaatttgaggatctcctgcacagaggcactgggttccaaggctgacttttgtaattttctctgagttcatttttagccaaacagtattacagtggaaaactaggattttggtttcaaagtttcagggaattaaactttttccagttcttaaggatgcatcctaagggtgtgttctgtggtatggagatgtgattacccatttgcagagagagaacagaggagaaaaaaaggaaaaaggaacaagaagttgtcccctattactttcctattatactgaatggggtgtcccccatttgtccttagggttctggaataaactggtcttactgtgtgcccttaaccctggtcccatctcattacaatgacccacttgagaacagaggagataccagagtgaagagaggaccctcccctgttcatccttggggttccagaataaaccagtcttaccatgtacccctaaccttgccttcatctctgttctgatggtaatctattagcctgcggcaaacctttatctctgtcctatgggtctcttgtgcctgggctcttgggctgacctatccttgtctccatgatgttatagtaacttttgctcagagcattttatcaacaaaatgattatttcttttctcagattcccatttctcatgttcaagtagacaagaagcctgcttttcagctaactgccacaagggagctagacttcccccacccttcaaataagaccataaaggtcttgaagcatactgagaagggtgtgaaagtgatttgagaaatggaggctacaggaagaaataggaggaagaaagaggaacactcatggaaagccttcgtatgttccccaaaccaaaagcccttggattcaagagggcaatgtctatttgccctcttgacataaagtagtaacctctagaagagttggagcttggggtaagaactcacaaatgacaaagaaagactatctcctcctcccaaaggggtgctaactcagaaaaagcaagtggggccacagagtgaggccttatgcaggtggacagattgcttcaagggccactggaaaacttgtccctggggcataacaggaacaaaaacatatggtaagtcataagtagccgacagagccagagttccaattagtgtctgtcccagcaatgtgccagcagacaggggaagggttggaggtcatctgagctggtagggtaaaaacaaacataaatctcagaggatatccacaaggtagcccatgtttttgctcccacccaaatgcagcaagagccacaggtgcccaaataacaaggagtgtgtgtttaagaagttatgtggcatgcaaagtgaaagcaaaaagtcagacttcccccaaggcagatggtcagagatatgcaaggtcatttcagaatatacacagagaaaacaggagaataggcaattaaggtttgggggaaagagctgattttaggtgaaaaagcagaggaaaccccagacattgcatggtctcaggatttcaccataccactctcataagcctcctgtccaggaagatgtttagtgtctcaggtctacttggtgtgaaccccaaggtccttcacacccctgcgagccacccatcaggttgagctgagagatcagctggaggaacagaggaacagccacttgcggctgagaaaagtaattctaggggttggttagtgagcattagagcaaaaagggagaagagaaccatgtactggggtttaacacctccagccaaagaaggtgagccatcgcagtatcttacaactggggaacatatctgaatcacgcagcaacaaattatgttattagcagaatgtatccaagtcacggcaccaaagtatgttaccagcagcaaatccacatgagtctgtagcaacctcaattcttgcctcctcagaataaacaattcaactgaggggcacacggcagaatgagagactgaggcaagttttagagcaggagtaaaagtttatttaaaagctctaaagcaggaatgaaaggaaataaagtacacttagaagagggccgagaaggtgacttgagagatcaagtgcatgcctcagacccatggactggttatctggaagccctgatgcttccattttttcccttgcccaaactttctggaagaaagaaaggttaatttttgaactgaaggagttattttattctttacccctgtgtcacagccctgagtagactattatccaatatctgtaaattggtactttatacattttttgacagttctgtacttgttaaaggcagtaggacatggtccagccttcttaatgcatcatacctgaaacctgtactgtgttaattttctttttataaccaaatcttaagtcaatcctgtattccatcaagattttactttcttatatgagagtttatattgatatctacctagattgcctgattatcaccctataaacattttattgaaaattgatacaaactttctcctaaatcctattaccatgatagtaaaataatttcagatattatatattttaacaatctggttgcctaatcttaccctttgtcaaattgctttcactgttattataaaacactcctccatttctggtagagatagaaatgccaagagttattcctctccactgtgtcctttaatcctgattaaattataggtatggtgttattaaactacaggtatggtgatattaaactataggtatggtgacattagattaaactataggtatggtgatatttcataaaaattataaactcttagggagtaataaataatcaatttgtaacgaatataacagtcttggaatctccataagatagaaaagtgaaactagatcagaacatttctcatccccaatatctgaagtacggagcaaacttggatggaaatcagtcaaaaataatactaaaatagcagctatgactaaaaaacagaaagcaaaatagtgtgcaattttttgattaatttgtatctgaatttcaaaatataaaacttaagtaattacttgtaacatggaatttaagattctgcattgaatctatattttgccaggacatgtctgtgatcctgggtaacttacttaactcctctgagcctcaaattttaaagatgtaaagtaaggtagaaagatttctagaggagttgtgaatatcaaacaaactaaaacatgtaaaagaacttaacagattatcttccactgagtcacggcttaacagatgatggatatttcctcattcattcatatagatctatctgagaatagtcaactctcccatccctctctataactgattggaaaatgctgagagcctaaaaagagaattgaagacagtcttagagaagtatgaatattagatacacttgacattaaagataagtctgactgattttttattcaataagaatgtgacagcttgtaaatatctgataaaggaattagtctcgtagactaatgtattataaatatatctgtaaattggtactctatacattttttggcagttcttgataatggtagtgggaaatgtagcctgatgtgtgtatgtgtatatatatatatatatatatatatatatagtctcctcctagactaactatatataagtctgggagattgaatatcagtctaagagactgatacttgtttcagatactatatattatataatatataaatagcatgggctttatagctatctatatttatagcattctttgctgattctgatgcctgccacactctcccttcctctctgcttacaggattcaattctttcactcccatctcacaatagcttcctccctctccagtgtagaaatcccagcgtgctgtcctcattcactcaccagcaacccgcactgccactcgtacagctgcttcctgttcccttgtggtttttggctgtcagttttcccctaagagcacaaagtcatcaaataaaagcaaaagttaagtgagagttctaggtttttcataaacatccatatcagaggtctttttttttccctcctggtgaaaaattttggaaatgaatgaatacttttgttaaaatgatgtaactttctctaaagaaaaaggaaatgtcaagatttattctactctggaggctgttcagttatttacagaggatgacagccacctactggccatgatgacaaagacatacaccaagtctgtggagagtcagcttttcttttctataaagaattctgtccctttgcagaattttcttcataggtaaaaaggactctttctcagaaagagctgaaccttatattggaagaagcccatttccttcattttttttatcatagagaaggaaagtactcccagcttcaagcaggacatgtcctttgggcagtggacagctatgtagagagagaaagggtaagaatgtgtcccttgacttcagccccctgactcatccctcctttatgtattgagctgcactaggattcagtacagcctgccaatgtgggtgtagaactgtaatggacatccattaaaatctcctgtttgaaggtacattagctctttcttaatagtaagttgctaattttacaaattcattccttagatcatgtcacttacattcataataaggagaacattctctgttattttcaataatgactcaacttgcatcccttctattttcactcagtagtaagagagagaacagagatctgtaaagggatcagaagatacaattcttgccaaatgatacccagtagaagtatcaatttgggtagaattggggaaacattaaagtgatctgtgaaatggtgtatttgaagaagttaaccaggaagcatgtgtgaattgctaggttagtaggaagaggcttcaacttaggacagatttctcaattctttgctcaagttacagacccaacctttatatggctcttttgaaatggaagaggagagaaattgggaaattcaaagttatattttacaatatatttgttctttgcctctctttcattagctactgagtgtggggggcccagtttaggatcagaaagaaaacattaacacttttgaatatacctggttctctctcctctgtctctttgatggtttaacacctttcatatattaaaaacccttttattcctgactacttttaagcttcttatttctttaatgttatttttgttttttgttgcttatcatttcagtgggcaaaaattgtatgatgtggctgcatattgtcaccttatcctgaaaaatgtctgtaactatatcctgaacatatcgagaagttaattttttatatattctaaagtattggagacccaatgaaaggaagtggcagagctggcagagaggagccctattatagcctgcctcatacaagtccctggacagttcctctggtgaggaacacatggaagcttagtccctgccctgactccattggaacagatacaagagatcatgatacagtaccacctggagacaacggggctttgtgagctcacgaggccaaagaatgtaaccacccctagatttcccttacctggcaagctcagcactgcagaggtcaaggatgttttgctgggaacagaaacacagtaaatagagagagtcctgcccacaacactacacccaatgagcgggtaaagaatacaggagctcatttgtgcctctttttagggacttccaacattctgattccgctaggaagagactccaccaggctcaggactctcatttgttgaaaaaagcaaagcccacattatgaaacatgaagacagagccagcagcagctttagaatttggaaggaggagagaagactggaaggtcctcagaaaatggagtagcaatggaagcactgagtcaactgttcagaatattcaaatcagagggagagaagattgaagtggatgctgagagcatacagtgctcccgtggagacatggccaacactgtcccctgcatgggtgacactgatactacagcagcctgtagagtattggaagggacagggttacttcagtgtcagctgcaaactcctgtttcctccctagtacccatcaagttctcacactacaggcaaacttatttatggggccaatgcaattcaaggcatctcttaaattctagtcataatgcagcctccttaaaggcagtaaaaaatgaaacaatgcctgaacagaagggacacagcaggtatttgagtacatttcaattgggccagagacttcccagcaggacagatatcaataatgcatgtattgaagaatcacaacttcttctcttttttttgtattcttttgtttgttttttgtttgtttgtttgagatggagtcttgctctgtcaccaggctggagtgcagtcgtgcgatctcagctcactgcaatctcctcctcccaggttcaagcgattctcctgcctcagcctcccgagtaagtgggattacaagcatgcaccaccacacccagctaatttttgtatttttagtagagacagggtttcaccatattggccatgaagatcttgatctcctgacctcgtgatccacctgcctcggcctcccaaagtgctggaattacaggcgtgaggcactgcacctggctgaagaatcacagcttctaaaggcagcaaagatctttgccgaattgtatttatttaacttcattaattgaaaagaggcattggtgggtcagttctctttcttcttttttcttttttcttttttccagtcagtgtattctatactcaataggcacattcaaagttaggatttgtacactttctgaggattcaagtccaaaagacaagcaaagatcatcctttatttctgataaaaaatactaatgcttttatcactttgtcaattactgctgattttaatgctatatttatttcattgctaagttgtatttcatggcttttaattggatcaggctagaaattaaataaaatcaaccatgttgggcagctgaactaagtttggagttacagccagactgtctttggtaatcacctcttcaaaagccctcacttcttctgtataggaactgcataatattcttccatctgacaaaacgttttttcagcactcaaaactcaaccacttgttggaaagacagaggataagagattcttcacaagactctatcagtacacaagatgaagttcagtctgggctggaggtaagaaacagtgctgtcacctttaggaatgagaacagtaggctagcctgaagaagctctcctgtagatttagtgaggtcctgaaggagataagacagatcccataaggctccactagcagcaaaccgaaaattgttaggtgctttttgtttattcttaaactcacaaaaaatctcgagaattaaaaataaataggctttcaattggtaagttaatagttattttcctgtatttctttgatgaaactacacattaaaccttagactttgtctttcaattgggagaaaaaaatccttgcttatagctatttaaacaatattttgcctacctagaatataaagccaatcagttaaattcacgtataaaacaccactgttgctcctgtacattggtcccatatctattcttcacttatgtaacatgccctttcatacaaaccaattagctcaactctccataaggttttgaccttggatcattggtatgttcagaatagttcatccttccagattgttattcctctccaaagagttatataaggagcataatacaaataggtttgttgaaagtattgaactttttttgttttttttatatttgaattgataaataacaatagtatatattcatggaatacacggtgagatttccatattcataatgtgaaataattagattttgttaattggcttattcatgatctcaaacatttattatttctttgtgaagggaacagtcactgtcctccttctagctattaacaactatataatatattattgttaactatatcctacaatggtatataaaactagaccttaacctcctacatagctataatttagtatcttttaataaatctctccaattcgtctcttcctccaacccttcctaccctcaagtatcctctgttctactttttacttttatgagatcaatttttattttagcttccagatatgagtgaaaacatgcagtatttaactttctgtttctggcttatttctcttagcataatattctccagttccatccatgttgccacgagtgataggattttattttttttatggctgaatagtatgtcattgtgtatgtatacgtataccacattttgtttatccagtcatctgttgttggagaactcagctgattccgtatcttggctatcgtgaataatgttacaataaatacgggggtgcagatgtctcttagatataataattctctttcctttggataaatggccagtactgggattgctggatcatatggttgttctatttctcgctttttgagaaacctccatactgttctccacattggctgaggtagtttagagttctcttttctctatatccacaccagcatttttaacattgtcttttgaataatgggcattctaactaagatgcaatgataactcagtgtggttttgatttccatttccctgatgacagtgatgttgagcagtttttcatatatttgttggccatatctatatctatttttgagaaatgtctgttcagatcatttgcccattttctaatcacattattattacttttttgctcttgagttgtttgagttccttgcatattctgtatactaattccctgttggttgagtagtttcaaaatattttctcccattctatagattgttttcactctattatttcttttgttgttaaaaaatttagtttgatataatccaatttgtttatttttgtttttgttgcagtttgtttatttttgtttttgttgtgacttgtttagttttgtatttgtttcctgtactattgtggtcttattcataaaactttttcccagacttctcttatgttttcttctagtacttttaaagtttcaggtattgggccgggcacggtggctcatgcctgtaatcccagcactttaggaggccaaggtgggtgggtcacgaggtcaggagactgagaccatcctggctaacaaggtgaaaccctgtctctactaaaactacaaaaattagccaggcgtggtggcaggcacctgtagtcccagctactcgggaggctgaggcaggagaatggcgtgaacctgggaggtggagcttgcagtgagctgagattccaccactgcactccagcttggcaacagagcgagactcggtctcaaactaaataaataaataaataaagtttcaggcattggatttatgtctctgttctattttgagttgatttttgtatagggtgagaagcaggggcctagtttcattcttttgcatatggatatccagttttcccagcaccatttattgaaaatattatcttttccctagtgaatgtttctggcaccttagttagaaattaaagcaatggcaacaaaagacaaaattgacaaatgggatctaattaaactaaagagcttctgtacagcaaaagaaactaccatcagagtgaacaggcaacctacaaaatgggagaaaatttttgccacctactcatctgacaaagggctaatatccagaatctacaatgaactcaaacaaatttacaagaaaaaaacaaagaaccccatcaaaaagtgggcaaaggacatgaacagacacttctcaaaagaagacatttatgcagccaaaaaacacatgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaacacttttacactgttggtgggagtgtaaactagttcaaccattgtggaagtcagtgtggcgattccttagggatctagaactagaaataccatttgacccagccatcccattactgggtatatacccaaaggactataaatcatgctgctataaagacacatgcacatgtatgtttattgtggcactattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaactctgcatgttctcactcataggtgggaattgaacaatgagatcacatggacacaggaaggggaacatcaaactctggggactgttgtgggcgggggaggggggagggatagcattgggagatatacctaatgctagatgacgagttagtgggtgcagcgcaccagcgtggcacatgtatacgtatgtaactaacctgcacaatgtgcacatgaaccctaaaaattaaagtataataataaaagaaaaaaaagaaattagttgttgtagattcgtgaattaatttatgttttcttgattctgttccattggtctatgtgtcagttcttaatgctagtaccatgctgctttggttactacagctttttagtctattttgaggcccagtagtgtgtgatagtgtgatagttccagcttggtttttttgttttgttttgtttctttttttttttttttttttttgactgtttcggctatttggggtcttttctggttccatacaaattttagaactttttttctgtttctgtgaagatgtcattggtatttgggtagggattacactgaatctgttgattgctttgtgtagtattctcattttaacaatatcaattatttcaatccacgagcatgggatgtatttctatttgtttgtatcctcttccatttttttcatttgtattttgtagttttctttgtagaggtctttcacctccttggtaaatttattcctagccattttattactcttttttttttttgtagctactgaaaatggaatggcttcttgatttctctttcaactagtttttcatgtgtagaaacactactgatttttgtacattaattttatatcttgcaaacgtacttaatttatcagttctaaggattctttggtacaatcttcaggttttgctatatataagatcatgcagtctgcaaacagagacaatttgacttcctccataccagggtaaatgacctgcacctgggccctgggcctgaaaaacacccctcgggctgcctctctcaggctcatccccaggctagcaaagcagctttgtgcccacgtcctaggcctgagttagtatttttaaagaccttacaacagtggatgatccatactaagcatgcaataaaactaaatgtcatattttcaaatcatgattattattacaatccagattaagcgcagaatcttttgggtgcatctaattccctctcttttaattctgcatttccacaagtaatcttttcattgcctgagcagatttattaactaggtagagtgctcaggcgagactaacatccattatcctgcctaagaggattggtgttgcagcaactgaagtcttgttgcccatctcttaggaggtggttggtgtcactcttcccttttctcctcagagctgattatatgtggacacatagaggaaaagaacaagttctagcattcaatggtacagtatttaaagttaacaacaatgtattatacatttctaaatagctagaagagaggatttgaaatgttcccaacacacaaaaaaaatgataaattctaaaggtgatggatatcttaaataccctgacttaatcattgtatatcctatgcattatcataatagcacatgtaccccatatatatgtacaactattatgtatcaataaaaattttaaatgtgtactataatacaatgcaagaaatgtttttaaatgtgtattaattcacagaaaagtcaggtggctggtcttgcaaagctgagagcagttcatggcttcagaagttgctcttctctgagcctcttggagaagcagcaatttccctgcctttgtgtacctcaatatgggccttcattcgtgccctctgccagaaccccagtctccaattttgctgcgttatattttgctaatttatacttggtgattgtgtcatcagaaagtcacttctcttcttccactttcatgacattgtacttttctgtaaaccacaaactactatcaagttttgctttctaggaaagtggaaatgagaaaaaaaaatgaaatcatggaaattatagaaaaaaacaatgtggcccctttgcctcacttttacttctcttaatttttgttacttcatcatgaattataatgtaatgcagaaacagcaagacaaaccttgtccagaaaatcactatgtgcaaagaagcaaatttaaaacaaaaaaccacaaaccaataaaggaaagaagcctatttcttcctgacagaatagtctggagcctaacttgccctgtactgtcagagtaaggcagagatgcaggtaaacaaccccaagaaaaacactaactggataaacaactgaaagtcctagtttctgtcatattagttgccaacaagagacaacattatcaacattattaacacccctgtggccagctcagaaaggtcaaatcaagcaagtgttcaatagttttaagtattgaagaatgaaagtaagagttgaccaataaaatctacaattttcaaaataaaaattatttgcttactaaagttaaaattatggcaattgaatacttcccccacctacttagaacaaatttttgctatattatttatatttactcttgcaacttgtcatatttctaatatttgtctatttcctataatagatattcacttttacattgtactaaagtgtgtaatacatgttcaacttttcatttgattaaaaaaagtattatttaatacattcttagtaaagaaaaatttttggattttttgttctaaaaataaattccaaattctggttttctaaacccaaatgaagaatgaatgacaatattcatttactttttctttcattcccttcatatcatatgtaaaaatttgtcagcaaagtgatatattatggaattgctgtcaggaaacacaggtgaataaaggtaatacacttccttctttgtggaaacttgaattattacagagaaagaaatataaaagctgtactaatatttacttaatttcacttatatgaaatactacaaaaagaagtaaaggacaatgatgtttatataacaaaaattttaggtatgaatcatgctggaaaaaaataataaatttcctttctaaggtgcctggaaaacatgaaagtacagaaatcatattgacagttgggtatgtgggtcaagatttaatgataaatgccatgggtggaggtataaattgagattctttattgcatatctggtaatgggagcatgggaatacaaaaaatgtttgctggaatcatgtgtaggctgtcagactatttgacacctgggtcaggaggagagaaggttacatctcgctactttctcagttagctactttctcagttatattcacacttggtaaataggagtagtgcttaggcaatgagaagaatgttgggggattattttggggacacttgagactacccaataaaggaatatcttactgacagaattaacccatgccctaccaaagggggttgagtcagggagagttggaggtcaggacacatggctatatgcatattaatcaagctacattttgtcacttcagaacagagggtgtcactagagacgtgaaacctcagtattctgaggtgagatggtactgtgaaaaggatgaagataatgttggttttgtaattgaaattcccacacccattatacctgaatataactaggatttgcattacgaatattggcaccaactgtaagagtcatacctagtaagaaaagaagatatgtttttcaaaaatgtgtccttttgaaaacatggaaatctagatgacctagtgtttgatgataactttagataaaataccaaaagcatgattcatttaaaaaagtgatacattggattttattacaattaaaactcctgctttgcaaaagacactgtcatgagaatttgaaaagccacatactgggagaatatatttgcaaagacatctgacaaatggctgttatccaaaatatacaaataatacatacacatatacaatggagtacaattgacacattaaaaaaatgatatcctatcatttgcaataacatggatggaactggaagtcattgtgttaagtgaaataagccaggcatagaaagacaaacttcgcatgttctcacttgtaggagctaaaaattaaaacaattgaactcatggaaatagtgagtagaatgatagtaaccagagtctgagaagggtagtggaggaggaaagagggaaaggctaagggatacaaaaataccattatatagaaatgaataagatctagtttgatagcataacattgtgactatagtcaacactaatttattgtacatttaaaaataactaaaagagtataattggattatttgtaacacgaaggataaaagcttcaggtgatgggtaccccatttaccctgatgaaattattactcattgtatgcctgtaccaaaatatctcatgtaccccttaaatatatacatctactatatacccacaaaaattaaaaattaacacacacacacacacacacacacatatatatgtatatatatatatattcaaagaatacttaaaactcagcaataagaaaacaaacaacccaattagaaattaggcaaaacctctgaatatactcctaatcaaactagatacaaagatggcaaataacatatgaaaatatgctcagcatcacacattattagggaattgcacattaaaacaataatgggataccactacatacatattagaaaggctaaaatccaaaaatttgaaaacacacacattattaagttgggagaagtgtcctttgaaattatcgattcctttctttcttctaagagacatgataagaaaaacattgacctcttgagtttatgtatacattaagggagagcttgggaaataacacttacccattatgtggataatatactgtagtctttaaaatttgccttttttgtgtataaactctagcggttggtgtgtgtcccatgactctctgtgaaggctgtattcagaaaagcagaaaacacacccttgttcaggaatgattacttttcttctagcccatgcccatttgctgcctttgatctacatccgttctactttcctgcttctgttcttccccattccttaatctccaacttggctgggctgaatgtacgtaagttgctttttgtccttgtttttttcccattaatatattgcttcctttttacatttttatcacatttagatatacatttgttttggggtttcttttgtcccagttctttaggatgcaaaaagtgacaacctttgttttcaataaaaatgaaaatgaaaatgagaaataaaggtttctggtgtcctgcatgtgaaacaattgtacaacacatttatgttatcacatttacatcccattatggacatttaggacaaaaagggtttcctttagtttgataaaaatcaactagaattggaacatctgcaggtcctttggaaatttgaattttagggccaaaaatttgtttaatcaaattaatggctttttcttaactacatatactccttcagtatgatattgctcccaaaagtgtaaaagttatttttgagtgtgttgacaaatcttgggtatttcggtgattggtagcactctaaaactcaactctatctgacaaaaccttattccttagtactttttttccattgggttatcttgtgtatcacatgaaaagtactgacattgagttcatggaagatacacacaaggtatataagatcagcgttacaaacctatgtcaaatgggtgctgtgattggaggaatttctaaggtttactagacatcaaagtcataacatctgaggtggcctctgtatacatatgggctgtcattagccatcttgtgaatgttgcttatgtttaatccttagcatttctgactgtgctgtgggctttcagaattaaatgcaaatactttatattttattatttaattctactaaaggtgctcaatacatcaataattatgtcaagcactgaagagaaaaaaatctatacaatatctggatgaatatctagcagctagtgaagttaaacattttctaacatgacagaaaattaagttagactaaaagtaaatgttaaaaaattaaattttagtagtctttagcagttttaaatgatttttaagtattttataatattaggtattattatgtgtttttataatttgttaatttgctgatggaattggacacattacaatttatataggtaaataaatcattttaaagacacaaacaaattgagttaaatgtccatgggttttaaatttaactattaacttttagcttaaaaatttcatttggtcttctttttttctttctttctttttttttttgagatggagactcgctctgtcacccaggctggagtgcaatgttgcaatcttggctcactgcaaccactgcctcccgggttcaagcaattctcctgctccagccacctgagtagctaggattacaggcacctgccaccatgcccgactaatttttgtatttttagcagagacggggtttcaccatgttggcaagtctggtcttgaactgctgacctcgtgatccatctgccttggtctcccaaagtgctggaattacaagtgtgagccaccgggcccagcccatttggtcattcttaacactatgttaaataaaaagattaaactttacactccttataaatagatatgtacagtatatcaacaaatatatggtatgtctgtgttattaaaatttaatgggactttgaattagaaagaaatttctaaaaagcccatggggcagggaaagatgaggtaatactgaaaataaaagtggttgagaaactgctctacacccatgtagacaggacataaaggaaagccaaaagagaagtagaaaaaaacatgaagacgttcagaaaatggaagctagtatgttccttatttaagacctatgcacagagcaaggtcttcagaaaacctacaacccaaggttcagtgttacccctcatcaaccagcccagcagcatcttcgggattcccaatggcattgccctttgctttaatgatggccctggtggtgctcagctgcaagtcaagctgctctctgggctgtaatctgtctcaaacccacagcctgaataacaggaggactttgatgctcatggcacaaatgaggagaatctctcctttctcctgcctgaaggacagacatgactttgaatttccccaggaggaatttgatggcaaccagttccagaaagctcaagccatctctgtcctccatgagatgatgcagcagaccttcaatctcttcagcacaaagaactcatctgctgcttgggatgagaccctcctagaaaaattctacattgaacttttccagcaaatgaatgacctggaagcctgtgtgatacaggaggttggggtggaagagactcccctgatgaatgaggactccatcctggctgtgaagaaatacttccaaagaatcactctttatctgatggagaagaaatacagcccttgtgcctgggaggttgtcagagcagaaatcatgagatccctctctttttcaacaaacttgcaaaaaagattaaggaggaaggattgaaaactggttcatcatggaaatgattctcattgactaatacatcatctcacactttcatgagttcttccatttcaaagactcacttctcctataaccaccacaagttgaatcaaaattttcaaatgttttcaggagtgtaaagaagcatcatgtatacctgtgcaggcactagtcctttacagatgaccatgctgatgtctcctttcatctatttatttaaatatttatttatttaactatttttattatttaaattattttttatgtaatatcatgtgtacctttacattgtggttaatataacaaatatgttcttcatatttagccaatatattaatttcctttttcattaaatttttactatacaaaatttcttgtgtttggttattttttaagataaaacgtcaagcctgactgtacaacctgatttcaaaatagatgatttaatcaagttacctatcataattttattcaagttatagaaaaatacattttctataccaggttatatgttgccttaaggatgtaaacatgaatataaaaaatacagctcctgttctcttgtatctttgatttttgtcaggaaataaatctaaaaacaataataatgctgaattaatatcagttatacaaactgctgtatggtaacgaagtaaaaaagcaatgaattcttcttagcacaaggtagattgagacatgtctggaaaaaaaagtagagataaactgactttcaaacatgtaattgaaaatgtacattgccagtcagatatatgagtttgcagtttccaaggaatacgatatctggaagttcataactggcaatggaaaggccaaaaatgaaggctgtcatgtggggaggaagtggagagggaaaaaagacttaaactggattctgaggaccttccaccattaaagtgtgggaacagaagagacacaaagaaaacagaggtggaatacctcaatattagaaggagaagagggaatgatgataaaagtgtatttagaaaacaaacatgcttataaaaagaatcaatagacttatagaaaatgtgaattaaaactgagcactacaggaagaaaatagatggcaatgcagagattactgagagctggattgatagaattaatcagcagaagccatactggggtaggtagaagaatcaatgagaaaagaaaaatcaggataacacatacagaaaattgtgaaagatctgcctttgcaatggagggaagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatatgcagaaaactgaaactggacccttccttacatcttatacaaaaattaactcaagatggatataagacttaaatgtaaaacccaaaaccataaaaaccctagaataaaacataggcaatagcattcaggacataggcatgggcaaagattttatgatgaaattgccaaaagcaactgcatctaaagctaaaattgacaaatggcatctaattaaagagcttctgcacagcaaacgaaattatcagtcatcacagcgaacaggcaacctacagaacgggagaaaatttttgcagtctatccaattgacagaggtctaatatccagaatgtaaaaagaacttaaacaaatttagaaaaaaaaacatcaaaaagtggcaaaacatgaacagacatttctcaaaaggagacatttatgtggcccataaagatgaaaaaagctcaacatcactgatcattagagaaaggaaaatcaaaacaccaatgagataccatctcatgcccctcagaatggtgattattaaaaagtcaggaaacaacagatgctggtgaagctgtggaaaaacaggaaagcttttacactgttggtgggaatgtaaattacttcaaccattgtggaagactgtggtaattcatcaaggatctagaaccagaaatagcatttgacccagcaatcccattcctgagtaatacccaaagaaatatatgtcattctattatgaaaatacatgcacgtgtatgtttactgcagccctatttacaatagcaaagacacaaaaccaacccaaatgcccatcaatgatagatgggatttttaaaaattgtgcttaaaacctagatgacaagttgataggtgcagcaaaccaccatggcacatgtatacctatgtaacaaatctacaggttctgcacatgtattccagaacttaaagcaaaatcaaaaaaaaaaaaaagaaagaaagagagagagcaagttggtcaaaatcagctgaaaatacaacatgaaccaaggaaattcagagagcaggagatggttgtgtataaatgaggaaaaaacgagattaataattattaagcaaatcccaattcaaaatttacacatcaggtataaataacaataacttattttacattgaaattccattctggttgcatatatatttttttggcagcctaaaaaaacagaattctatcatgaattctaaagaggctgaaaaattgtctcacctcatttcaaagtcctacttacacttagtcaggaaatggtggcttctataaatacctgacagaggagcagcatctagattgaagtgcagaatacacgtgttgatggttaactgattctggcacctggaacatttgtttcctggctctcagaatcccagagtacactcccatatgaagttactctcctaaacttaagtaaaatatacatctttgctggttctgagagctgacacacttttccctttcctccatgcggggctgtatcccattttttcactaccatatcacattagtttccttcctcttcctctagaaatgcgcactgtgctctcttcttcactcatcattagcctgcactgcctcttcatacagctgttttcagttctcttgtgggttttacccatcacttttcccttaagagcacaaaatcacaaattaaagcagaaggtcagtgaaagttctaggtttttcagaagctctttttataaaatactctttttcctttcttatgatgaatatttctgtaaaacacggaatgtcgctgttgcaatgacataacagtagcttagcaaaaaaggaaataaaacgcaggttccattctactttgagactattacaagatttacagggaaagagagccaccaactggtcaaagtgcaccaacacagcagccaagtctgaggacagcaggctgtgaatgcagaagtaggcctcctggcaggatatttatcttcatagctaaaaagaggctcttcccaagaaagaactatcacggtactggaattagcccatttccttaacttctgtatcgtggagagagaaaatactcccagcttcaggcatgacatgtcctcttggggcaatggacagctatggggaaagagaaagggtctggatatgtccctttcctccagcctgcccagcctccccgggacctcctaacttatcccttcctctatggattgtgctagactaggaatgagaagagccggtcaatctgggtgtagaacttcaagggaatttgatttgtgatctctctatcaagattgtggaagctttcatagactatatcctgaaatacattttccaagttgtttgttttctccctgtctctttaaaggatggaagtgattcctagatttggcctctttataccaccccctatttcttggaggttttgttcattgctcttcattcttttttctttatttttgtctgattgtcttatttcagagagccagtcttcaagtcctgagattctgtcctcagcttggtctattctgctgttaatacttgtgattgcattgtgaaattcttgtagtgtgtacatctactaggtccgttaggttctttttcatactggctatttggctgtcaactcttctctcttttgattgtgattcttagtttccttggtttaggttttactgttttcctgaatctcaatggaattcctttctatccctattctgaattatatttctgtcattttagctaactcattttggttaagaacccttgttggagaactagtgtgattatttggaggacataagatgctctgtccatttgagttactgtagttcttgcattggttctttctcatctctgcatatgggagtgtagcttgagttcaatcaataaagagacttattttctggctgtgttcacagggctgtagctttgtgcagggtctttatttgtagctgacatgtctttggttgaatgagggtgtgttagtgagatttgttggtgttgaagctttgggcatgacctagtaggtgactcttaggtgcagtggtcagttgtcaggctcttgctcagtcatggggctcacctacatttcctcacggttgtacacgtgctccatctcaatgctttgaaagtttgggctcctctcccacttgagtgctgactgtaccttgtatcttggcactcccaggctgcccacaacagctctggggtgatctcagggttaatgttttctccccaacttggagccatcgaaggaagggaccttagtagttgttgtaactgagggtcttttgcttgtctccggggggctccaccacagagaagcaggtcagcagtcactcagtgcaatcagcgtgggatgggagtgtgtcctgtgggcccaagccaggggttccctgcctggtgatgtgaggggtgggtgattgaccaatggcagacagactggcctcctctcttgggttgacggcagcttgttggaggtatggataaggtacttgaggtctctgctccttcatcagttccaaggtagctggggtagtaccactgcagaggcagtggtagacaggctttctgttgcccctggggtctccacctccaagaaatgtgaagccatgttaatggcagtgtttagccagaggagtggggtggctgcactgctggtgtaagcttggggcttcactttttgggtaatagaaggtggcaatcttaccaggaggagagactgttctcaccatatggtaactgcagtgtgctgtaagttcatgtgacagtggcttgctgcaagctcgtaaacaaagagcttcagactctttgtttcttccccagacccaaggcagcagggataaaactgctgctgtggcagtggcagaggtaggatggctgtgggagcctctccccagggaaactccaggcaactaccagtggatatgctcagctatgggtaggttgactgttttgcagtcatgggctgggggccctgcctcctgaagaatagggatgcagattctcagggaagaaaggctggactcctctttgtatggtggctatggtgtgctggaggtgagagtgtagtgactaggccctttgttccttccccagccagagggctgctggggctgtcccactgcaacagtagtggtggatgggttgtgggttgactgtaggatttcttcctttgagaaatgctggactgcctgattgaggagatgaggcaggggaagggtgcctgtgctggagtctggtcaggtggatctgcccacagaggagaggtgacaaccaggaactgtatggagaacagtatggtcactcttctgtgaggcagttgctctgttttggggatctggaccagccactgttccctacagactctccagagcctggagacagcaagggcaagagctgtgagaaagcaaagatggcaacccacccttctcactgggagctctgttccagggagatgcagagctgtcattggctcaatagccccaactggtagctgcagacccaagcctggcagacccacccagtgaagagagaggggatcagggaccgacataacacacagtctggccacttttccatagggctgctgcaatatgctgggggtccaatccagaccatagtcacctcacatttttcagtacctgaagatatcaacagtgaaggctatgaaacagtgaagatggggacctgcccctccccctgggagctctgttccagagaggtacaacctgttgcctcctgcaacatacatgcaggaggtggctggagaccccggtggggatatctcacccactgaggagaaacagtatcagggactcaggtgaaaaaacagtctggccactttttggtagagcagctgtgctgtgctgggggtctgctaccaccgccagcacgaagaatggcattttcaagaatggctaaggctgctaaacggcaacaaaggctacctacccttccctttgggagcgccatcccagggatattcgaaactgcggtccactagaaaacagtggtggaggtgactggagaccccagtggggagattccacctacagaaaagaaacaggatttgggatcgatgtgaataagcaatctgactgcttctctgtagagctgctgggctgtgctgggtggctgctccagtccctagctgccttggactccctagaacacaaaggctccaatagctaaggctgtgaaacagcaaagatagcagcccacaccctgccggtgggagctccatgtcagggaggtgtgacgctgctaccagtgtctggctggattcccaagccagtgggtcttaccctgagacaggccatggaaggtgggcctgccacttgtcactgcccagcaccctgaatgaaacccctttcctaggggtatgtataggggtctagcgtcctgcttggctggagttatagcttcttttgtggggaagcctgggtatctaaggctccagggtacccatgcatgcctgagcagctgctctgctgaaaccctacgtagccctgcatgtcagactgaaggctctggtagagtgggttcactaggagatctcctgatctgaggattgcaaagatccgtgagagaagcatgggtccccagggctgctgacttaccacttccctgggaaggagaggctcccctggctctgtgacactccttggtgggcagtcgtcctgccttgctttgctctgttctccatgggtcaagctgttgagtcccaatgtgtgtacctggatgtttcagttgaaggtgctgtatttacttgccccttccatttctctccacgagagtggcacacactagcagcttctaggtggccgtcttggccaaccctgaaaactatttgtttccaactataagccatgcataaaaagaatgccttgagagaacctggagtccagggttcatccagaccccagctcagctaggccagcagcaccctcgtttcccaatggtcctactgcttctactggtggccctgctgctttgccactgtggccctgttggatctctgggctttgacctgcctcagaaccatggcctacttagcaggaacaccttggctcttctgggccaaatgcagagaatctccactttcttgtgtctcaaggacagaagagacttcaggttccccctggagatgtggatggcagccagttgcagaaggcccaggccctgtctgtcctccatgagatgcttcagcagatcttcagcgtctaccccacagagtgctcctctgctgcctggaacatgaccctcctggaccagctccacactggatttcatctgtagctaggatgcctggagtcttgcttagggcaggcaataggagaggaagaatctgtaggggtgattgtggccctacactggccttgaggaggtacttccagggaatccatgggaatccagagaatctacctgaaagagaagaaatacagtgactgtgcttgggaggttctcagagtggaatcatgaaatccttctcttcatcaacaaacttgcaaggactgagaagtaaggatgaagacctggggtctgctttagtctttcttattttcttcctcttccttactatgtgtttattccttctttttctagttccttaacttgtaaagttagttcattcgtttgaggtctttcttcttttttaatataagcttttacagctttcattttcccctctacctctgttttcattgcatcacatatgttttggtatgttgtgttttcattttcatctctctcaagatattttctaagttcccctctgggcattttttttttactatactttaagttccagggtaaatgtgctcaacgtgcaagtatgtgccatgttggtttgctgtacccattaacttgtcatttacataaggtatttctcctcttacatgtttatcacttttagacctacatttgttttctttttgtgcccataaattaagatgaaaaatcagaccacttttaccttgtaggaaaagtgaagtgagaaatataaatatatttgctgttgtgaatgccacatagaacgccacatagaatcattgtatagtccatttaaaaattatatttgtattctttcattgacactaacgtgaatgtgaaaatgaaagaaatcaaagtatagaaaaaccaattttcacggtagaatacaacataaaaaatgaatatgcaaaaattcccaatacaatctcaagtgaacaaagaaaaaatactctctcccccagtgtttcaaagactaagaataataactcgggcaaaattgccctgtattctcagggtctaataaaaggatgagcccaaaattcaataaaaatgtgttgactggatcaactactaaatcaatgtacaaaatatacattcctgaaatgaaggctcctctagtatggaaacccctgtgcacatttcgtaatgtagaatattttaattgttcaatgatataaagaatttaagtgaatcatttaaaataatgaataataaaatgtgtttggttattttctaaaattgatccatttcataatttctacctcatataaaccagctcattttctaccagtgtcatctaaagattatcacgagatttgaatctgaaatttataaatgatggaaaaatgatgtcacaagtctttacaattcacatacacattcttgggatttgatccagggaaggaaagctgtaggattatttgggggagagaggctattattccatacttttgggaatagtaaattgtctgattcctataaactgtgtgaattggagagtttgaatttagatatgtgactctgtatttgacaccaggctacttattttctattatcacaaagtagaggacagattagagatgaagtcataaatagttaatatagtgctaggcaaaggatgatattatgctgctcttgcaacttgaatccccagatctacatgcactttaaaaaaactggaatcccagtggttttagcagtaaactaaatgggcattattgactctcagtaaaagctgaatggaaatttttgtcattatctattataatcccagcaaatatgtgcatgaggaagcaaaatggcttcattcttgaaccctttccagtagaagaaaaaatgagaaactagtaaaaactccacttactaaatagctgatttgctaaagcagacttcattccatttaagggttcagtatctatagggcctacttatgcaaaaaaaaaaaaaaaagtagagccagagttcaggaccactctgaaagttaattctttgcataataatattcaatatttataaatttatgaatttagaacaaagatggtcttttttatttgataagaattgacttggataggaacttctgaaaatctttagggaatatgaacttcaatgaaaaatgccaaaaatgatttaacttataatatttcctaagtcacatatgtttattggaatgatacttcttcgaagagtacaaaaattagttcttgtagtttatgtaaacaaatctgacatattacaatagtttgtgactctccaacaactctatccaacaaaatttcattgcttaatatacatctttctcattggattttcttgtgtacgatatgagaagcactggtattgagttcatgaaggtaaacaaaatatttgtaagatcagtgttacaaacctatggcaaatagatgactgtgattgaaggactttttgtccattttttgctggatcttaaagtcttatcacagtatgtggctttaacctgcatatatttgggctgccattgactatcttatggttattacttatgtttgatcctcagttcttcaggatgtttggtagactttgagaattcaatgcaaatagcttatgttatatgatttatttctactaaagttattcaacacatatacatttatgtcaagtgctgaaaagaaacaagtgttggcaatatgtggatgaatactgcagctagtgaagtttacaaattattttctcatataaagcaaaattcaaagcttcatacactaagagaaaaattttaaaaaattattgattcttatttttaggagttttgaatgattaggtatgtaattatattcatattattaatgtgtatttatatagatttttattttgcataggtactttgatacaaaatttacatgaacaaattacactaaaagttatttcacaaatatacttatcaagttaagttaaatgtcaatagcttttaaacttagattttagtttaacttttctgtcattctttacgttaaataaaaaaagcaaactttatagtttttatctgtgaagtagaggtatacatagtatacataaatacatatgccaaatctgtgttattaaaacttcatgaagatttcgattacaaaaaaataccataaaagactttgagtgcagggggaaaaatagggcaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatcttcatagctaaaaagaggctcttcccaagaaagaactatcacagtactggaattagcccatttccttaacttttgtatcttagacagagaaaatactcccagcttcaggcatgacatgtcgtcttggggcaatggacagctatggggaaagagaaaggttcaggatatgtccctttcctccagcctgcccagcctccccggggcctcctaacttatcccttcctctatggattgtgctagactaggaatcagaacagctggtcaatctgggtgtagaacttcaagggactttgacttttggtctctctatcaaggttgtggtagttttcatagatgatatcctgaaatacattttccaagttgtttgttttctccctgtctctttaaaggatgcaagtgattcctagatttggcctgtttataccatcccctatttcttggatgttttgttcattgctcttcattcttttttctttatttttgtctgactgtcttatttcagagagccagtcttcaagacctgagattctgtcctcagcttggtctattctgctgttaatacttgtgattgcattgtgaaattcttgtagtgtgtacatctactagttctgttaggttctttttcatactggttattttgtctgtcagctcctctctcctttgattgtgattcttagtttccttggtttaggttttactgttttcctgaatctcagtgaaattcctttctgtccatattctgaattatatttctgtcattttagctaactcattttggttaagaacccttgctggagaactagtgtgattatttggaggacataagatgctctgtccatttcagttaccatagttcttccattggttctttctcatctctgcatatgggagtgtagcttgagtccaatcaataaattgactttggttctggctgtgttcacagggctgcagctttgtgtagggtctttatttgtagctgacttgtctttggtttaatgagggtatgttagtgagatttttttagtgttgaagctttgggcatgacctagtaggtgactcttaggtgcagtggtcagttgtcaggctcttgctcagtcatgtggctcccatacatttcctcatggttgcagcctgctccgtctcaatgctatgaaagtgtgggctcctctcccacttgactgctgactgtagcttttgtcttggcactaccaggctgcacacaacagttctggggtgatctcagggttaatgttttctcctcaccttggaggcatggaaggaagagaccttagtagtagttttaactgagggtcttttgcttgtctcctgggggctccaccccagagatgcaggtgagcaatcattcagtgctttcagcctggaatgggggtgtctgtgctgtgggcccaagacaggggttccctgcctggtgatgtgacgggtgggtggttgaccaatgggagacagactggcctcttctcttgggttgactgcagcttgttggaggtatggataaggcacttggggtctctgctccttcataagttccaaggtagctggggtagtaccactgcagaggcagtggtagacaggctttctgttgcccctggggtctccaccttctagaaatgtgaagccatgttaatgggagtgtttagccagaggggtggggtggctgcactgctggtgtaagcttggggcttcacattttgggaaacagaaggcgacaatcttaccaggagtagagactattctcctcaccatatggtaactgcagcgtgttttaagttcaggtgactgtggcgtgctgtaagcttgtaaacaaagagcttcagactctttgtttcttccccagacccaaggcagcatggataaaactgctgctgtggcagtggcagaggtaggatggctctgggagcctctccccagggaaactccaggcaactaccagtggatgtgctcagccatgtgtagggtgactgttttgcagtcatgggctgggggccctgcctcctgaagaatagggatggggattctcagggaagaggggctggactcctcttcatacagtggctatgatgtgctggaggtgagagtgtagtgactaggccctttgttccttccccagccagagggctgctggggctgtcccactgcaacagtagtggtggatgggttgtgggttgactgtgggatttcttccttggagaaatgctggactgcctgattgaggagatgaggcaggggaagggtgcctgtgctggagactctggtcaggtggccctgcacattgtggcgaggtgacaaccaggaacagcatggagaacagtctgtccactcttctgtgagttagttgctctgtgctagggatctggaccagccactgttccctgcaaactctccagagtctggagacagcaagggcaagagctgtgagatagcaaagatggaaacccacccttctcactgggaactctgttctagggagttgcagagctgctattggctcgatagtccctgctggtggctgcagttccaggcctggcagacccacccagtgagcagataggggatcacggaccaacataacacacagtctgaccacttttccacagggctgctgcaatacgctaggggtccaatccagaccatagtcacctcgcatttttcagttcctcaaggtatcaacagtgaaggctacgaaacagtgaagatgggggcctgcccctccctctgggagctctgttccagagaggtacaacctgttgcctgctggaacatacctgcgcgaggtggctggagaccccggtggggatatgccgcccactgaggagaagcagcatcagggaatcaggtgaagaaacagtctggccactttttggtagagcagctgtgctgtgctgggggtctgctaccacccccagcacaaaagaatggcatttgcaagaatggctaaggctgctaaacagcatcaatggcaacccacccttccctttgggagcgccatcccagggacatttgaaactgctgtctgccagaaaacagtggtggaggtgactggagaccccagtggagagatttcacctggtgaaaagaaacaggatttgggattgacgtgaataagcagtctgactgcttctctgtagagctgctgggctgtgcagggtggctgctccagtccctagctgccttggactccctagaacccagaggctccaatagctaaggctgtgaaacagtaaagatggcagcccacaccctgccgctgggagctccatgtcaggggggtgtgagggtgctaccagtggctggctggattcccaagccagtgggtcttaccctgagacagaccatggaaggtgggcctgccacttgtcactgctcagccccatggatgaaacccctttcattggggtatgtatagcggtctagcctcctgcttggctggagttatagcttcttttgtggggaagcctgggtatctaaggctccaggttccccaggtatgctgagtggctgctctgctgaaaccctacacagccccgcatgtcagactggaggccctggtagagtgagttcactaggagatctcctgacctgagggttgcaaagatttgtgggagaagcgtgggtccccaaggctgctcacttaccacttccctggttggggaggctcccctggctctgtgtcactcctgggtaggcagtcatcctgccttgctttactctgttctccactggtcaagttgttttcttgagtcccaatgtgtgtacctggatgtttcagttgaaggtgctgtatgtacttgccccttccatttctctacttgagagtggcacacactagcagcttctcgttggccatcttgaccaaccctgaaagctatttttttccaactaagagccatgcatagcaggaatgccttcagagaacctgaagtccaaggttcatccagaccccagctcagctaggccagcagcaccctcgtttcccaatggtcctcctgcttcctctactcgtggccctgccgctttgccactgtggccctgttggatctctgagctgggacctgcctcagaaccatggcctacttagcaggaacaccttggcacttctgggccaaatgtgcagaatctccactttcttgtgtctcaaggacagaagagacttcaggttccccctggagatgtggatggcagtcagttgcagaaggccccggccctgtctgtcctccatgagatgcttcagcagatcttcagcctcttccccacagagtgctcctctgctgcctggaacatgaccctcctggaccaactccacactggacttcatctgcagctggaatgcctggagtcttgcttagggcagacaaaaagagaggaagaatctgtggggtgattggggccctacactggccttgaggacgtactttcagggaatgcatgggaatccagggaatctacctggaggagaagaaatacagtgactgtgcttgggaggttgtcagagtggaatcgtgaaatccttctcttcatcatcaacaaacttgcaagaaggactgagaagtaaggatgaagacctgggttcatcctgaaattattctcattgattaatctgccatatcacacttgcacatgtgtctttggtcatttcaataggttcttttttctgcagttgtcacagaatttattgaattaaattcagcaaataccttgttaacaatagtaagcaagtatatgttaaaaacctttggctctggtcttcagttcctaagacatgactgccctgatatgttttatatacttacttatttccattctttttgcagctgtttcatttataatatttagatattttacatataataacatattcatctttacattgtgttaaaatttacaaatatattcgtctttccatgtcattaaatttgcatttgttttattcattaaattctcgtttgttttattcattaaggaaaatgcctggaaatcttttttctaaaaacaaaatccacacccacatttttaacataattgaaggaaggacaataaaatatatttactcatttattccattcacattatatgtataagctaagtaagtggcagattgtagagttcccttcaagaaataaattgaataaagcactctccatcttacagagaaagagatgtaaaaacaggactaatgcttactttattgcaattctcttaaaagcttgaaaaagaagtaaaggaaaacaatgttctcacaccagaagttttagatacaaatgatgccaggcagggaaaacaatgttagatgtccttcttaaggtacttggggtatatgtacaggtagcccttgaacagcatgggattgaacttctgaactgcatgggtccacttatacaggtttttttttttccaatacagttcaccttccatatctgtattttctgcatgtaaaactaaactggatagaaaatacagcatttgtgggatgtgaaactcgcatatatgaaggggactgcaggacttgagttttcacagatttgggtatctggaggacaggtgtggagtcttagaacaaaaatcccacagataccaagggaaacagtatttccagaatcttattggcagctgggaatatgggtctagaatgaacaacaaatgccatgggcaaaggtattaatttgggattctttactgcatgtctggtattgaggacatgagaatggatattagggaatctgtcacctaacatagttataaattgagggaacgatgagacaggatctaaacttagtcctgcagatcctcaacagtcattggtagggcagagaaggagagtctgtgaaggtcaaagagcacttaggaggagtggtcagtgcagctggaaggagaaatagcaaagaatgagggagagacaagcgaggggtagacagtggtgttttcagggaagatgaaggctgacctgtcctaacggactcaaaaacagatgccatcagtgaccttaggtggatctaggtttagtaaaatgaatgggacagaaacttgatgggagtgggttgaagaagaaatacaataagggtatttgggtgttctatgcataaaaaattatggtgggaaacttgtttgtggagtagggaaataagatgatacttgtagaagaatgtgggttaagatcttcatgcatattttgttagtgttttctgaaaatcattttcaaagaatagatgaattcgaacaaaatctttaaacattttttgttgatatatagttgagaaattaaaatttatggatttaaggtgtacaacatagtgttttgctttaattatgccttgttgtaatgattctgacaatcaagttaacacatccttcacctaacatagttataatattttattgtgcatggtgagaacatataatatctactcccttagcaaatttcaagtatacaatgcattattattccatgctgtactgaacatctttaatatttcatttatttaacctattaattgtattttttatttaaaatgttgcttatttatttggctgagaggtaatttatcattattctaattaatactacctggtagtaaatttcaatagtaacccatttacttgctaatttaaattcttttttcaattaagttttacaattttgattttactttacctgttatttcatttactctagtttcaatgttgtttatttacattattgatttataattttagaattcctaatcattgtcaaaacatttcctgcacattgtagccataatcttttgatggatacttattctttatttcatgtgtgtaccaaacactaaacagttccttgtatatttttccaagcactgtctagaacatagagccacatgcctccttaagtcttttgatttacacatattcagtttctgttcttgtaaatatgtttttacatttaattatgtaatatattagagtttttttaatatgctatgagaatccaaattaatttttgttagagtgacaagcaattattgcacaacattctattgcaattttattttctttgttattaacaatagatgcagctctaccgtaaatctcgttaattctgataatacaactttttctgttttttttttctgtattaatatggttgctaaacttacaaactgctacacttatattacttctgatattttaaaactcatttaattcttctgattgagctacctaagttcaagaatccctttatacattttaatattattgcttgcattatttcctgattaaatttagagttgttctaagatagagagcactggcttcaggaaatcataaacatttgtgaatcctaaaatggctaattacatgatatcaccaagaatgtaagataacataaaaatgaatgagggaaactagattagagacttgagtgtaggctgctatttagtgatatgcttctaccatgtagtgtgtagagggcaaaaatagtaactttataggacagaagtctggcaaacaccatcttaaccaagtgattaagttaacatcagcagtaataaaagatatgtaataaaagatatcaatatcatgtaccttggatattgtgtgatgagacgatcagataaactctgtggtttcaaccctttaaacatacaacctcagcataatcctgagtaaacattagacaaatccaaattggtgaacagtctatgaaataagtgaccaatattcttcaaaagtttcaatgtcatgaaagccaaagaaagactgagcatgcgttacagattggaggagactgaaggtatgacaacaatccaacaatttggattgacaaaaatcaatccaaatcaagaatcaatttggactgattcttgaaataagataaaacatcagtttttaaaaatctgaggaaatcttagtaaaatctgaaagttagtaatatggccccaatgttcatttctttgttttgattcattacaacatggtcatgtatgttgttaacatgagaagaagctgggttaagggcataagcaaaattttatagtatctttgcaattctttgtaaatctaaaattgtttgaaagtaaaaagttaaaaatgaatagattttcaagattctagaccttactggtttaaaatttgtttatgtatttagttgatttaaatcattcattagattcctaatttttttcagaagacagaaaattctatctataatgtaactgtctaaaagattgttccttagctattagggttcctccagtcagaatgtgcaatcaacccagcagcaaaccctaaaaaaggcatcaaccagctcccaagtgaggtgattcagtcttcggtcatctcagtccttctcctctaatgcactgggctctcctctcttccccagatgtgcttacatttccacacctctaattcctttagtgagcccttctagatgtgccctccctgagctctgagccttcatttggttggtttagttctgattttagcgcatgcttatatcctggtgatgacacaaaggtgtgtgacaaacagatagaaatctgaagccttgtggacattttcataaatggatagaaatatgtagggtttcaaagagttgcctatggatatattactggggtgaacaaaatgtttcacaaatatattcaagtttatgaaaatacagtcttagaaagacaaaactaggatatatatgtaagtaacatgaggcccaatttcataataaaacatgtctggcatgagcaaatgaagcttctcagtggagaagaggaataagaagagaagagaaagaccctctcattatttaggtagggctctgctggaaagaaaaatgtggaccagagtctagaaatcagctctggttcttatgacatattaccagagcacatctaagagctgagtactctaaatgggattttctgggttccaacagtggctccacagttcaatagctccctgtgcttaggtttgttctcttaaaaatgaggaaaatagtagaatttatcactgcctgctgtagccacagatgtctccagtgacttaacaggacagggcacataataggtgttcaacatgtatgcaacatggggcttattcttcactgggtaaaatgaggattgatttgtaagtactaacaacaatgtctgactgatagtaaatatattctataatttagctatttagttcttttaattaacgttatttttgttatttaactctattaagatgggggaagtattgtttccaattatctatttccttacttcttgttagatatatgacaagcaaattatttatctgctcaatttatttatataccaggggagaatttagtgcaattaacatttaggactacccagaaaaaaaaatactagactctcaaaaatttgccttcttgtgtataaactcttctgagttagctgatatgactcccttgactctgtgaagacagaattcagcaaatctgaaagccaaaatctggaccaggaatgcttacttttctttgagcccatgcccacatcttatcaacatctaccattttaaccatttttaagtgtacagcttagcagtattaagtaaattcacattgccatgcaactgatcatcagtttttcgtcttggaaaaccaaaaccatactcattaaacaacagctccttatctcctctcccctggacccccacccctgacaaccgttttactttctgtttctatgaatttatctactctagataactcatatgattgaaatcatattacatttgtctgtttgtgcctggcttacattaggtcctcacgctgtagtatatgtcagaattatgctgaatacattccattatctgtatataccacattttcctgaataatatgataagtcagaataatcatccatggtataagactgaataatatagtccattatatgcttaatgaaatatatatgaggctgaatgatattccattatatgtatatatcacagtttgtttattcatccatcaatggacacttgggttgcttccaacttttggctattgttatgaagatggatgtaaaaatgtatctttgaatctcatttttaaaaagtattctaggccaggcgcggtggctcatgcctgtaatcccagcactttgggaggccgatgtgggcagatcacgaggtcaggagatgaagatcatcctggctaacatggtgaaaccccatcgctactaaaaaaacaaaaaaactagccaggcatggtggcggacgcctgtagtcccagctacctgggaggctgagacaggagaatggcgtgaacctgggaggcagagatttcccagagcttgcagtgagccgagattgcgccactgcactccagcctgggcgacagagtgatactccatcataaaaacaaaacaaaacaaaacaaaaaggattctaaatatatatccataagtggaattcctagattatatggtaattctgtttttaattttttgagatacctgttttccattgtggctgcgctgcaccattttacatttccaccaacagtgcacaagggttccaatttctccacatcttcaccaacacttgttattttatttattttgatggtagccaccttgatagatgtgaattcaaatctcattgtgactttgatttgcatttccctaatagtgatgttgaggatcttttcctatgttccttagttcattcaggttgctataatgaaatatcatcaattaggtagtttataaataacataaatttatttctcacagttctggagggtggaaagcccaagaatcaaggtaccagcagatttggtgtgtgattgtggcccgtgtcctatttcacaatgagccacaatggaattaatcacatcccaaaaaggcgcatgtcctaacaccatcgccctaagagttagggtttcaacatatgaattttggcagggcacaaacattcaggccagagaaatatgcttgttggccatttgtatatcttttttgaataaatatctattcatattccttactcaagttatatttttttgttgagatatgggagttccttctatgttctgaataggctattacttttatcaaatacatgatttgcaaatattttctgccattctgaggtttgagttttgactcttgattttgtccttgaatgcacagtgatttttaatctttgtatactccaatttatctatttttactttagttacctgtgttttggtgtgatatccaagatttcattgccaaacccattgtctgagccttccctgaagattttcttctaaagtttttacagtttcaggtcttatgtttaaatctttgatctattttgagttaattttagcatatagtgtacagtaaggatgcaacttcattcctttgcatgtgtatatacagttttcacaacctgatttttgaagagttgatctttaaccattgtgtagccttggcacttttgtcaaagttcatttgaccatatacatgagagtttacttctgggctttctattctctcccattggcctatatgtccatctttatatcagtatcattccatttctattactgtaggcttgtaatgtgtttcaaaatcaggtagggtgaggcctctagctttgcttgtctttctgaagattgattctggtccttcaagattccataagagttttaggacagatttttctacttctgccaaaaatgccttagtgattttgatagggcttgcattgtatctgtctattgctttggatagtttgaacactataacgatgatgggcttcccaaccatgaacagaaatgtcttctcatttctcttccttaatttctttcagcagtgattgctagttttcaatatataaatctttttccactttctttaagtttattcctcagtactttattgttttgatgctattgcaaatgtggtttttttttaagtttccttttcagatttgtccattgttagcatataaaaatgctactcatttttgcatcttaattttgtattctacaactatgctgaattcatttattagttctaacagtttgtatgtgagtgcatgcgtgtgtgtgaactttaggttttctacatacacgatcaggctatctgcaaaaagataattttacttcttcctttccaatatgaatgctttttatttctttttcttgttaattgctatggctagatctacaaatgttatgttgtataaaagtggtaacaatggcatccctacttgttcctgatcttagaggaaaagccttcagtttctcaccattgaatataatgttaattgtgggcttttcgtacatggcctttattatgtggaggtaacttccttttattccaagtttgttaaatgtttttatcatgaaaagatatggcattttgtctatttctttttccgtatctgtagagattattatgtatatttttcattcattttgttaatgtgatgtattgcattgattaattttcatatgttgaaacattcttccatccaagtaataaatcccctttggtcgtgatctataatccttttattgtgctgttgaatttggtttacaagtattttagtgaggatttttgtatcaatatttatcatggatatggatctgttagttttcttttcttgtagtgtccttgtctggctttgttatcaggaaaatgctagtctcataaaatgagtttgaaactattccttccttttcaattttttggaagattttgagaaagattggtgttaattccctaaatgtttgatagaattatccactgaagccatctgattatggttttttattgttgttgttattgggaagtttggtgactgattcaatctccttactagttataggtctagtcagattttttgtttattcatgatttggtcttggtaagttgtttgtttctaggaatttatatatttcttctaagttaatcaatttgttggagtataattgttcgtagtagtctgttataatccattttacttttttttttttttttttttttgagatgaagtcttgctctgtcgcccaggttggagtgcagtggcgcgatcttggctcactgcaagctccgcctcccgggttcagacctatctcctgccacagcctcctgagtagcctcgactacaggcgcccgccaccacgcccggctaatttcttttttgtatttttagtagagatggggtttcactgtgttagccaggatggtctcgatctcctgacatcgtgatctgcccgcctcggcctctcaaagtgctgggattacaggcgtgagccagcgcgcccggctgatcctttttaggtctatgccatcagctgttatgtgtcatctcttatttctgaatttttatttgatttttctctacttatttcttaaaatagttaagggtttgtcaattttgttgatcctttcaaaagaataatgcttagttccattgattttttaattgcttttctattctgtattttattaatttctgctttagtctttcttattttcttcctcttcctagctatgtgtttatttcttctttttctagttccttaatttgtagttagttcattggtttgaggtctttcttcttttttaatataagcttttacagctttcaatttcccctttagttctgatttcactgcatcacatatgttttggtatgttgtgttttcattttcatctgtctcaagatgttttctaagttcccctcttgtcacgttttttattattattattatactttaagttctagggtacaagtgcacaacgggcaaatttgttacataggtgtacatgtgccatgttggtttgctgcacccattaatgtgtcatttacattaggtatttctcctcttccatgtttatcacatttagacatatgtttgttttctttttgttcccataaattaagatgaaaaatcagaccacttctaccttctaggaaaagtgaagtgagaaatatgaatgtatttgttgttgtgaatgccacatagaacaattgtatagtccatttaaacattatatttatactctttcattgacactaacctgaatatgaaaatgaaatcaaagtataggaaaacaaattttcacagtaaaatactacatgaaaattaatatgcaaaaattcccaatacgatctcaagtgaacaaagaaaaattactctctcccccagtgtttcaaagactaagaataataacttgggcaaaattgccctttattctcagggtctgatacaaaggatgagcccaaaattcaatacaaatttgctgactggatcaactactaaattgatgtagaaaatatacatttctgaaatgaaacctcctctattatggaaacccctgtgcacatttcacaatgtagaatattttaattgttcaattatacaaagaatgtaagtgaatcatttaaaataatgaataataaaatgtgtttggttattttctaaaattggtccatttcataatctctacctttatataaacaggctgattttctaccagtgtcatctaaagattatcacgtgatttgaagctgaaatttatatatgatggaaaaatgatgtcacaagtatttacagttcacatacacattctcgggatttgatccagggaaggaaagctgtaggattatctggaggacagaggctattattccctaattttgggaatagtaaattttctgattcctataaaccgtgtgaattggagagtttgaattcagatatgtgactctgtatttgacaccaggctagttattttctattataacaaagtagaggacagattagagataaggtcataaatagttaatatagtgccaggcaaaggataatattatgctgctcttgcaacttgaatccccagaatcccactggttttagcagtaaacttaatgggcattattgattctgagtaaaagctgaatggaaatttttgtcattgtcttataattgcagcaaatatggccatgatgaagaaaaatagcctcattcttgaacactttccagtagaagaaaaaatgagaaactagaaaaactccacttactaaatagctgatttgctaaaacagacctcattccatttaaggactcagtatctatagggcagaggcaaactaacttcttatgcaaaaaaaaaaaaaaaaaagtagacccagagttcaggaccactctgaaagttaattctttacatgataatattcaatatttataaatttatgaatttagaacaaagatggtctcttttttcataagaattgacttggataggaacttctgaaaacctttagggaatgtgaacttcaatgaaaaatgccaaaaatgatttaattgataatattttctaagtcacatatatttattagaatgatacttcttctaagagtacaaaaattagttctcatagtataaacaaatctcacatattacaatagtttgtgattctccaacaactctatccaacaaaatttcattgcttaatatacatctttctcattgggttttcttgtgtatgatatgagaagcacggtattgagttcatgaagataaacaaaatattagcaagatcagtgttacaaacctatggcaaatagatgactgtgattggaggactttttgtccattttttttttgctggatcttaaagtcttatcacaatatgtggctttaacctgcatatctttgggctgtcattgactatcttatggttattgcttatgtttgatcctcagttcttcaggatgttttgtagactttgagaattcaatgcaaatagcttatattatgtgatttatttctactaaagttattcaacacatcaatatttatgtcaagtgctgaaaagaaaaatgtgttggcaatatctggatgaatgctggagctagttaagtttacaaattattttgtcatataaagcaaaattcaaagcttcatatatatactatgagaaaaattttaaaaaattattgattcatatttttagcagttttgaatgattaactatgtaattatattcatattattaatgtgtatttatatagatttttattttgcatatgtaatttcataaaacaaaatttacatgaacaaattacattaaaagttattccacaaatatacttatcaaattaagttaaatgtcaatagcttttaaacttagattttagtttaacatttctgtcattctttactttgaataaaaagagcaaactttatagtttttatctgtgaagtagagatatacatattatacataaatagataagccaaatctgtgttactaaaatttcatgaagatttcaattagaaaaaaataccataaaatgttttgagtgcaggggaaaaataggcaatgatgaaaaaaaatgaaaaacatctgtaaacacatgtagagagtgcataaagaaagcaaaaacagagatagaaagtaaaactagggcatttagaaaatggaaattagtatgttcactatttaagacctacgcacagagcaaagtcttcagaaaacctagaggccaaagttcaaggttacccatctcaagtagcctagcaatatttgcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaatgaaacctgtttcaacatggaaatgatctgtattgactaatacaccagtccacacttctatgacttctgccatttcaaagactcatttctcctataaccaccgcatgagttgaatcaaaattttcagatcttttcaggagtgtaaggaaacatcatgtttacctgtgcaggcactagtcctttacagatgaccatgctgatagatctaattatctatctattgaaatatttatttatttattagatttaaattatttttgtccatgtaatattatgtgtacttttacattgtgttatatcaaaatatgttatttatatttagtcaatatattattttctttttattaatttttactattaaaacttcttatattatttgtttattctttaataaagaaataccaagcccaaatgtgcaatctcattaaagaatggatggtacaattcatttacccatcatcattgtatccaaattgtaagtaaaaattgactttctctaagcgaggttttatattgcccttaggatatccaggtgaacataacaaataccgttttcgctttcttgtatcttttatttttgtaaggaaaataataactatactttctaatacctgttacattaaatgctatagtgagaagaaataaaaacaaatgaaattcagtaaaactgaagcaaggcatatcaaaattttttttaaaaaagtagtagatatcctctatagcagacaagtagacatctaagtgcaagtgtccattggtaacctgatatttttgtctgtaatttacaagcaataccatgaagtgaaagcttgggaacagaatatgtcacatgggttgaatagaatgagaaaaacacttaaaatttattcctgcaaacttcaactttaaagggagagaagagccaggaaagagtttgaatggccatgcattgggacaagaaaaaatgttgttaaaagcatatttaaaagactgaaactgcttagaagaatcaatgcattcttgcaaaatgtggattgaaagtgtacactacatctggaaaatagatggcattgctgctgatagagatagttgggtggaattaatcatagtggagtaagctggaagagtgaatcggagaagagaaatcagtgacaatacatatagaaaatgattttgaagtttgctttcagaattggaggacagaaatagagtgggactttgaaaagaatgtggattttttttctctgaataatttttacttcaaaaaatatatttgtctctggatagattttgtgaatttgatggacagccaaaccactttaatatgtttaatattttgatttgaaattatgacactttaattaattataataatcattgtttttcttcattattttgattaatactatgttaaatgtcattaaactgctctgtggattgaaaccattcactacagtgggaacacagatcattgctgaccttatgagaaatggacaagtggaagtaataagcagaaaccatactgaggtaggtgaaaggataagagaaaacaagaacttccattttcttttttcatctagagagtcactttgtttcttttacttttattatattgagacttacatttcttcttttgcctcaacttatgcaaatgtaataacggcttattaaaaaagtttaatggagaaagaaaaatgatgacttgaaaattatgggaaataataatacagattctttgcattaccagattctttacatttttatttccctgttgaggtactaaactcaagatgaaatagggagtaattcagaagcaataagacaaccctggcaaagaaaaatactaatttaattatgtagatagatagatagatagatagatagatatagaaatatatatatatagagagagagatagatatatatagaaagacaatgagaccagtaaggaagagtaattttatctagcatcatattctggactttattgccccacatttttattgtgaggtggagaatggtaaa

SEQ ID NO: 15554 - DNA, 193555 bp, Human; identical to SEQ ID NO: 15553
  misc_feature (1)...(193555): n = A,T,C or G

SEQ ID NO: 15555 - DNA, 193555 bp, Human; identical to SEQ ID NO: 15553
  misc_feature (1)...(193555): n = A,T,C or G

SEQ ID NO: 15556 - DNA, 10217 bp, Human
ccccacacacaccctactttcctcctcagacaggattctccccacacagaccctgcttccctcagacaggattctccccactcagaccctgcttccctcctcaggcaggattctccccacacagaacctgcttccctcctcagacaggattctccccacacacaccctgcttccctcctcagacaggattctccccacacacaccctgcttccctcctcagacaggattctccccacacagacgctgcttccctcctcagacaggattctccccacacagaccctgcttccctcctcagacagggttcccctccgcacacacaccctctttccctcagacaggattttccccacacaaaccctactttccacctcagacaggattctccccacatggacctgcttccttccctccttgggattccccactgttgaggttcagtttccccatctggaaaagcatcaaagtcagggtagctgctgacgaaaacatggggaggggatgccttggggggctgggtgggatttcacagactcattgctctttagcctcttgtgatttatatatatgtgtatatatatatatatattttttttcttgatggggggttggggggcccggcgtggtggctcacacctgtaattccagcactttgggaggccaaagtgggtctatcatctgacgtcgggagttcgagaccagcctggccaacgtggtgaaaccccgtctctattaaaaatacaaaaattagccaggcgtgatggcaggcccctgtaatcccagctactcgggaggctgaggcagaagaatcgcttgaacccgggaggcggaggttgcagcgagccgagatcgtgccactgcactccagcctgggcaacagagcaaaactccgtctcaaaacaaacacaaaaacctttctctcctcttttgagatggagtttcactcttttctcccaggctgtagtgcaatggcacgatctcggctcactgcaacctccgcctcccgggttcaagcgattctcctgcctcagcctcccgagtagctgggattacaggcgcctgccaccacgcccggctactttttgtacttttagtagagacggggtttcaccacgttggccaggctgctctcgaactcctgacttaagatccaaccgcctcgacctcccaaagtgctggaattacaggcgtgagccgccgcgcccggccacatttttctccatctgtggtctaggctggcgtgcagtggcacaatcccgcctcactgctgcctcggcctcctgggctaaacggagcttcccgactcgcctaagaaagtggtgggattacaggtatgagccacggcgcccggctgtgatctacatttgattcagtcaagtttctgtgtttctcaagtttaactatagcgtggttaaaatccaaaagtcagcacccgagctcacacaggagcttcctccctcttgggatggagactctcctcccctctccctggacacagcccttcactcggtcttggccccgcctacttctccatcggccctgccccctatcccgaactcttagtgacgcagaggctggagacgactctacggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccggtaagtacgaagtgatcggtgccacccctccccctactctctgcctttgattccgactgggtgcagagatgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtggactgtcccgtgtgcaagcaacagtgcttctccaaagacatcgtggagaattatttcatgcgtgatagtggcagcaaggctgccaccgacgcccaggatgcgaaccaggtgcgtcctatctcagcaaccacaaggaggtttctggggagggggcatctgcgcaggaggagcttggcaccagctccaggctgttactccactttcccaaggctctgggtgggctgcctaggttgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtagaggcgcaccagcgggtgaagtacaccaaggaccatactgtgcgctctactggtacatgaggctgaggggggctgttggagttgttctcccatgtgtgccctcagttgcttttatgatgttggttgcatctggtggatgggtcctagagttctctagggggtgccgcccgaagggcccgagggcagaactccagaagcagaaaaactggggttgtggtgtgtagtctctagggcctaggtgggagagggtgggaaggggaaataagggagaccttaatgtgctgcagggaggtacaaagggtttgagaaggcttatcagggagttgtcagacctggtggtgaagggctcagcatatgcaaacagggaaaggcatggtgtgaagggctttctgggtttgtggttccctggcacacatctggtataagatgctgctagggaaagtagactgtgggtccatggattataagtgatgatgatttttggaagtgttttagcttttgagttggcagagacttacccaaagtttggtttggcatttccagcttttcacagacacagctagctttggtttggaaggagcttgagagtcttttgagtctagccaagttttggggccagaatcctcccatgagtggccttttggtagccatactgtgattcttcccatcccagaggacagcattggtggaagatagcgggaaggtggtggctgtggggcctgagcagccaggagggatacgcaggggctgcagggtgtcctacattccagacgtcccaggcaaaggtcagggtgcaggaatgagtggcattggggaagtcagtttccccaatgagccctgatgctacatattttggatttggttggtatgtgggaccagtgtgtttgatcagttttctaatggggagacaggctttggaggttattaatgggttggtctttgggtgggattatgctgagcaccaagattctgctctagagggggtgtgaccaccattctgagggtcctggtttgacatttcatctctcccagtatgagaacctctacaaggtttcctctgggcccttggattgtaagagaccctggtgttctcttgtcagggaagagggaggaagttaaccatgaaaggagaagaaaaggaatccagggtggtgtgtaggcagaattctgagtatgtccacttggagaagtgttcagtaaagggaacagtgtggggaagggtcagcgggggtggggggtggggtgggggtggtcctctttttctagacgctgttatccttacccttacattgttgttatctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtgagtcccaaggcatagtggttgggtgggtgggtgccaccccttccgtagcttagtgctcaggaacacatctgtctgctctcaggtaccagttcttagaggatgcagtgaggaaccagcgcaagctcctggcctcactggtgaagcgccttggggacaaacatgcaacattgcagaagagcaccaaggaggttcgcagctcgtaagtgtgggttctggggctgtgggggtggcccagggcagcaagaccctacctagcctgacctgctgtgtcccctagaatccgccaggtgtctgacgtacagaagcgtgtgcaagtggatgtcaagatggccatcctgcagatcatgaaggagctgaataagcggggccgtgtgctggtcaatgatgcccaggtaagccttgtgccggtgagaagggtccctgagccccctctgctgattgatgatgctgtctggggtgaggagtgatcctagtattcttctgccttctctgcttacctcatacaccttctatctgcagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttggtgtgtactggtgggctcctggctggtgggttccaggcaggtggttcccaatacctcaaatccctatttgttgttggtgtgctcattctttcctccctttcactcccaaccagatctacttccagctgcaccgggccctcaagatgattgtggatcccgtggagccacatggcgagatgaagtttcagtgggacctcaatgcctggaccaagagtgccgaggcctttggtgggtccccagctttacctcactctgttattaccccacgtgctgcacctacttacgtttctctcttctttttgcaggcaagattgtggcagagcgtcctggcactaactcaacaggccctgcacccatggcccctccaagagccccagggcccctgagcaagcagggctctggcagcagccaggtgagcaggagagaggacccaggaaggggtgggcagggaatggggtccagtagcaggagagaggacccaggcagggggggtgggcagggaatggggtccagtagggttcctgtcccactgaggcagagggttctgctttgttcacagcccatggaggtgcaggaaggctatggctttgggtcaggtgagtgggtctgcctagtgggtggggaagggccccagtgctgtttctaccccaacctgccagtcttctttctccattttctaaggagatgatccctactcaagtgcagagccccatgtgtcaggtgtgaaacggtaagtatggcacctcccctgggggtgaggtggatggagggtgggggtgtactcatgccaggttgctgcatctacaggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggtaagcctgtcccaaggaactatagctgtaggatgaagcctgtagtccaggtctggaccctgttgaacacccctcatcaccaccttgcaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgagtgtgaggctggtgggggtcaagtctgggtgttgggctgtctggacaggatcatgtgcagacccttattttcttcaccctagggaggagtggagctgctcactctgccatgtgctccctgacctgaaggaggaggatggcagcctcagcctggatggtgcagacagcactggcgtggtggccaagctctcaccagccaaccagcgggtgagggctggggttacttaggtggggttgcccagagaggctttataggtgctgcccagagctgtgacatcccttacaatgtttgtagaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgcctgcaggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgtatctactagtcagccttatcaagcactggtggcacaagggaggggggtcttgtcccccacctatcgaagcccatgtgtatggatgcctagggagtggggaagactgcctccttgccctttctgggtatggggagggtcacccagggcaaaggatgtacacactagaggcttgttgggtaccctgtgggatactgggtaggtgtgacctacatccctgtgtaggcagggttagccccaggtgtagcacagccactctactgaatgcttcctaaattttggtgctgtagctgtttctcatcttcagaaggtcccacagtgaactgagaccttccagatgtggtttttttccctgtctccctttgctgagtccacttaacattatcattcatctctgtgttatgatttagttactctacagtcgagcctgtgtgaatcccaaggccacccccttgcctctattggttggtctggactgtccttgagtgttgtcattaaaccatcactggaccaaacagtgttggacactacagcctggcagatgaggcctggactctcaagatcctaccagggtgtttgggcagtccagtatcttgggagaggtgatggagaagggcccacagctcacctgaagctcccagctcctgaaaatcccaggtggactttgcttgttcacccctgccccaaacccccacccttagcttagtaccaagtgcctcttgccttagtgatgcccatcctcccagggaccccagtctggtcccacatcaggccaaaagtcacatgggcctggagactagtgtcaaatctcttttattacagaggggttgtggtaaaagatcctgggcatccactggttatctcggagtggcaggggcactcagtccctccgcaggttcttaagccgttcctccaggtctgcatcagcatcagctagggctgaggctgcggcctctgcttttttcccaccagcagccacactaagcgagcccccagttgaggggaggtctgcagagaaagtgggggtttgagcaggtggggtcaggcagcggaggggagtaatgcagggaaagggagggcttggagctgtggctgggccttgggtgggaaatggggtccaggatttggagcactcactcgacagctcatctgttaggctaagtcccagctcatccagaacctgggacaccacagcatcactagggaagagagagaactcagtgagggctatgcactccgtgagggccaggcaaacatctccaccctcccatccagtttccccatacctctcctcttcatcttcctcatcacccatggcatcatcaatggcatcattcatcatctcctccttcatatccatgatctctgcctgccgctcaaactccatcatgatcttctggatctggggcaacttcagctggaagtgacaggagtgtgagtgtgatccccatgggtcgtgggagtgggaagggggattgggaaaagcgcacctgtctgttcatggtgcccatggccttggtgacacccttcatggcttgtgccatcgagttgttggacttgagtgtctggatcttgagggacacagcctggatgttggcccgcatcaatacaaacttgcgcacatagcgccgggtgcgcaccaagtcttttgccatgatgcgaacagcatcctgcagagtagacaagggtatcaaggacacaggaatgagattatcctacacttcttgacaccccattagttggttgtccctccccaccagcccaatttgcaattccacttgaagtttccagagactctggctaacccaatggtcactggtccctccctccttctgacctaaccctcctctgcctcttgggccaccaactccctgggctcctttgtaaggtcctcctcacttctcttgatctgtaaatggtaaaagaaaggccccaggctcactcctgag

SEQ ID NO: 15557 - DNA, 6456 bp, Human
cctggtgatccagattctgcctcaggatgtctttgtaaaactcctttacacctaggaaaccatttcctagttttaaaactagaagatttcacctggaaattcagatttttcaagactttcctgttctcgtgttcacaagcagcaggtgatgagggtgtaggaccctgcagatggaaccccagccagtctgagaagcaaaggctgcaggccctgggccagtttccctgccctgtggtgatcattcccatcgctagagctgaaggcttctcccaccctggccccatgcacattggaaggtttcagtcaggagtagattcagcagcaaaccagtggaaacgcagcttaggtgaaagtggacagatgctgagagcataagttcagcatactgcaggcttcagggcagcgtctccaggacccagtgccattgcctgttttgccctagccatcttccccttccatcccattgtccaggtccttcacacagcccctctcccccaaccctccagtgggtgacttgggtgcaggtaacacaggctgaaaggcagtttcaaagaaggggcttggccttggccagaagccactcctgggggagcatctgcagaatcagaggagtggcgcctgggcccctccgcaggcaagtgccacaccatgcgctcacggggctggcagtttccgtggtgacggccggaagtcgctgaccggcagagttccgtttcctcccgccctccgaggcacgctgagctgtgattggatgggaagctgacccccgcctccatccccttttccagatagtgggggaagcgcagaggctgcagtgcgtgtccgctggaacttgaggcccacgccaatagcggcccgattccgcccccacgtcgcgttccccaagtgtccaccccgacaggtcttcccctacaccactgtaaccctccacagtgcttaccactctctggcacaatacatgttttgttagtttacctcaatcagaatctccaggaacggggatctttgggtttgcgatgggacagggaaggtactcgacctcgcaccctctgggtaacgcatctagtctcactcagggtcttgccgcgatcaccctgccttgtctgtgacccatagggtcaaaggcaggccgggcgggtggcggcagcagcggaggtgaccacccgcgccgcgctctgcacatatatacaacttaagatgaagtgaccgcgagcaaaagcggcccacgtctgccccactcaaagatggcgactaactccgcttcctgcccggccccgcgaaagtcgccggaagtgacctgcaaggccgccgaagcgtcatctccatgaacggaaatgcccgagtccagccgaaggaggccgaaccccaaactccatcgctgagcaacgcgggtttgcggcggctgcgcaggcgcacaacgcaggccgggcgggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaagggtagggggtcaggggatggggttggagccggaggtcggaggtcagggcctgaggcagggtgatgtgggagtcaggaaggggtaatgcggttgctgagggtcagaggtgaagggccccgagcgtggggggggtcggaggtcaagtcttgagggttgggatcatgcagtcacggggagggggtcagagataggggcccggtatgtggtggtttaggatattaggaaggcctggtgtctgctactagggactcggaatctcagagtcaggcagtggagtggaggaactgacgactcgagagtctgggggttagacgggaacttgggtttggggtgacaggcggagaagagagggatagtagaggccaggggttggggatatgagtggaagaggatttagtttattatgctggggtctctgggaatctctgagtcaaacgggtgaagtaggttggaggaccagggactcatgggcctgcctgagtcacagcaatttggggtttggggtgacaggtggaggagggaaggttaatgagtaccagggattggagacaggggtgaggggaaatttaggctattgtgctgtgaacctcagagtcagagggggtggggtagggtggcgggggttggggacttgagagtgtgggggtcacatggaaagctgggtctgagagacagagaagaggaaggacagtgaggactgagggttggtgggggtgggcaggatctttgagtttgggtgaacaggtagatactgtagagtggaggtcatggatggggagcctggggtttagggcggtcagaggatgtttgggagtgggggcatttgggagctgtggatacagaaaagttgggggtcaccctgggccaggagttgggacacgcatacacagctgaacatgcatgtttggggtatgctgtgtatccacaagagccaagctggggagcagggagagggctggaggtgtggagcacagcccaggagaggcgcctgggggtccaggaggagacgatgggggctctgctaacaaacacccgccctaagtgtcctgctggctccctctctctctctcttcccctccctctttctgttcccgactctctgctacccaaacccagacataaacgagctgaacctgcccaagacgtgtgatatcagcttctcagatccagacgacctcctcaacttcaagctggtcatctgtcctgatgaggtgagggtgcatatggctgaattcccaggagcaaaccaagggtgtccccactgagaggagggagacatgttctgcccatcgggccccacaggatggaaccctaaaattttcttctcccccttttcctcccagggcttctacaagagtgggaagtttgtgttcagttttaaggtgagtcccaggcgggcagggatggctccctggacagaggaggcagcagctgaggcccttccaggcacctacccatctctcttttcttttcctggagccaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtttcttgatttcccagtcatcttcctcatggcctgaccttggttttctccttggcctgtcctgctccacaccctccctcccagcctctcacatgctcactctcctatgccctggatctgacctgcccaacaccagaggggcctgtggcagtctcccactcaccaagccctgaccctgatgctctctgtccacagagaggactggaagccagtccttacgataaactccataatttatggcctgcagtatctcttcttggtgagtaggaataggtggttgggtctggggagattggccttctgtccctctggcctgttgaccccccctacctgtactggccacaggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcatggcctctgcttcttacttctatggggtgggaggggcagctgaggtccattagggcctgcaaagctggggtggtggaaggtgtggtcacaggtggcattggagcaccctacaacaggctgcccagtgcctggggcagctctaaagttggtggggataccatgactgtgcctggggttggttgggatgaagcctactctaggatgagaagcgtaggcaggatccagtgacctgtggcttcctggccaagaggccagcaaagtggaagaaacaagccatctctagctttgcccctttcttgtgtgggtgggcccaccgaggaggaggagccttctgaggctccttctatctgaggcctcaggcagaagtcaaggtctcacgaataagctgggtcctcaagtggaggttgggtggaaagcgcccaccccggtactggcttgggtcactcgggcgggactcaaaacatgaaacactcggacgcgcagaggaaacgggagctgttgcgcatgcgctcggacgctggcccgttccggggcacgggcgcacgcgcgctcctggagtttcccaaccttccgggtgcgggcggggcatgttacgtcacgtcgtttaatccggaaacggcggcggcggcgacaggaccgaggggccttagttggtgggcaagtcggggatcccagaaagagaagcgtgacccggaagcggaaacgggtgtccgtcccagctccggtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcttcacagccccacattcacctgttcttggtacttagcgtttccgcccatcctgtcctcctctatcagaacccccacaattgctctgtcctcggtgcccacagtctccaaaacaccagtgcaccggcccgcgtcatcccccgctctcagtcgtatcaaggactccagggcctcacccatagttctggagagggaagctgaacttgcaagccataacttcttttggggcatggcgatgaaggaggggctcgggccagcacttggataattttcaggtctacctgtccccctttatgtgtccccgggacaatcccagtgttctcagctgctcccttttggctcctcattcctgcctccagtctccgttagccccttcccatttggcaaggctcccgtgaccctgttctgcttcttgccctcctgggccccatgccctacaactgggcctcactcacatctgtctcaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggtgagtgtgggtggtcgggcaggttgctgtcaatcaggcacggctctaacagcagtgaacaagagagaccagacaccaaacacaggtgctttcagcaaaacgagtggagtgaaagg

SEQ ID NO: 15558 - DNA, 11496 bp, Human
cctgttttctcccaccctccctacaaccagcacccccatgcccctcactcaagaccagggagaagcccacctagcccctcctgcaaccacacagaccccagtgggagccccaaggctgctactctgcacaggatggagggcaggggtaaaggccattaggcggtggcagtaggccgtgcccctcaccagaggctgaggtctgaccccttgaccagcccagcttcagggcatgtgtcctttcatgagctgtgactgaccacagtccaagggcccactgtggggagtcctcagcatatttggacagaaacgccccagaattggggtaagaagagcctttacagtcaggcagtgaagaaacacagctgctgggcacctgctatgtgcacgcctcagggatgggagtagggggcaggcccagccctgggacctgggtcaggtggctgggcccttcggatcccgagttggagggataaccccttggaggcagagatgggcatcagagacagggcggccccaggtggtcctggagtcgcctcgtaaaggttatgtctatgcctgctgcaggcagagacacagtcaaagtagttgctacctctggaaagtcccagttctgctcatgagcctagatctaagaggctgggacaggcagaggggtatgaaggggtcatgggcaggcagactgtccacactggctgccagggtggccaagtgagtagagtgagctggggcactcactaccgtgccaaccccacgcacggatgaggaccccgggtcgaaggcccacatcctcaatcccacgcaatagttcaggccctgtgagagggttcgctgtctgctcccagccagggctgagctgttcagaggccctacctgttcagaggcagctgggggaagggacagaagttggggggcaggggattgtgtgctggcgggaataatctccttcatctcatggctaaatcttccatccctcctttcaacctttggccagaaacctacgtttctgacccttggagaggtcggccagttcaagaggcacccctgagagccacgtctgcagacacgagggcctcgtgacgtgagccctgagggcagggggctgcaacccctcgcgcgggctccccggccgtggaggacacaaggacaaacacgaagggtccccgacctgccgaccccctcctcccggacaccgcgcgtagcctgtaggctacctccgcgctccacccagagacgggtcgcgctgctcccgccgccgcaaccccgggccctcgtgccggcggtctcccctcttccacgggcgagattactgcatagcagaggtgaagggcgcggaggctgtgggggaacccagcgtggtatggcaggaaaggtcgagcagggaaacaggcccagccagaggctcgggatccggggctcgcgagcgtggtgctcctgggccgggcggtgggggaggggccgcgtgtggcaggcacatgcgcacggcaacctggacctgcggagggcggcggtgaccactgggccttactccgctaacccaggtccgcatcaggcgcgtgccggtgaggcggctgtggccgcggcgaggagtcagagggaactgaactggctactcccgcggcaggtgggatttaaggtcagcagctgaacaaagaagcgagcgctggccagacttttttctttattagacatggctgcgttggtctcacggaaatctctgcgcttttgcaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacagtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcactctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaacattttaaatattattattattttttgtttgtttatttatttatttatttttttgaaacggagtttcgctcttattgcccaggctggagtgcaatggcacgatcttagctcaccacaacctccgcctcccgggttcaagcaatgctcccgcctcagcctcccaagtagctgagattacaggcgcacaccaccacgcctggctaatttttgtatttttagtagagacggggtttcaccatgttggttaggctggtctcgaactcctgacctcatgatctgcccggccacattttaattatttatttattttttgagacagagtttcgttcttgtcgcccagtctggagtgcaatggtgcgatcttggctcactgcaacctctgcctcctgggttcaagcgattctcctgtctcagcctcccaagtagcggggattacaggcacatgccaccgcacccagctaatttttttatttttagttgagacagggtttcatcatattggtcaggctggtctcttaactcctgacttcaggtgatcagcctgcctcagcctcccaaagtgctgggattacaggcatgagccaccacgcctggcgttatttatttatttgtgagacagagtctctctctgcctcccaggctggagtgcagtggtgcgatctcggctcactgcaacctctgcctccccagggtcatgcgactttcctgcctcagcctcccgaagtgctggggttataggcatgagccactgcgcccagcccacaaacattttcattataggcccagataatgttttagactttgtgggccacactggccactgttactttttttttttttttttttttttttttttgagatggagtcgctctgtcacccaggctggagtgcagtggcacgatctcggctcactgcaacctccacctcctaggttcaggtgattttcctgcctcagcctccctagtagctggaactacaggtgcatgccaccacacctggctaatttttgtctttttagtagagacagggtttcaccatgttggccaggctggccttgaactccttgatctattaaacgtttgttaagtgcctgttccactagggaaataaacatcaatgggagttcactgtattttaaacacctgtgcagggctccactgttgggccaaacccttcctggggaatttggtgtttgcaattttttgctgcatagtgaaagccctgcgtgaatgcccttcacgagactgtgagttttttttttcttgcagccagactatgaaatagtactgagagtttcagtgtcctgtgttcttttcccatcattccttgtatttgtagaaacaggtattttgtgtatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgcacctgttgtcccagctacttaggaggctgatgcaggagaatcgcttgaacctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcacgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacctgtgctgttgtctgtcttcggtggggggatgtgggtggcatagccctggtggccttgggagctgctcaccttcctgacctgttggcctgtggggacctggaagtattgctgactcagaaccatggcaccccagggctagcaggtggggcactggatgcaggccaggctgcctggagtgtcccagcaggtactggaaatgagatggggttatccataacttctgagggcgtggcacatgagatgttgctgtggtctgggtggatgggtggcttgggtgcctgtgaggtctgggtagtcacaagaccatcctgagaggcttgtcaccttgaagtagcactggggagaggaggaaagctcagctgtttagggcacacgatttcagacccctagcttcacccccctcttggagtgtggggtggtttcacactggcgaggttgtgctcctggttacctccccggctacactggttgtggctgcaccctgggcctgcacacccagtttctgtgggctgtacgggttcccttctgccagtgtccatgcagtgtcatcaggctgctggggacaggttgggacccacccagggccacaggctggtgactctggtagaagactcatcaggttctgaagggtggggtgggcccaagcccacccaccgtgtgccatcacccttccaccgcccccaacatctggccaagacaggcttggtgttcatcctggtggggctggcccagggggcggggcaggcagtcaaacgggtccagcgggtacctgggacctggaggggtggtgccggttgagcaccctccccctgggagggtacttttgagcccagctgctggcaggccaggaacagacagggacacgccactggccagagggaggaggcttccacaggtaggaaggcgcccacaggctggctgcggtctgtcattactctgtggggggtgcctatctctgctcctctgtgggtcaggtcctttccatccctgtctggggtcctccccatctccgtgttcaactgcggtctgtctctccgtttccaattcaggaactggtaccccgtgggtccattcctatccccagtctccgcctcgggcctccccatctcccctgctcctcgacgctagctacacccttctcgggatggggtgctctgtactgggggatcctctctaaagtacagtccccagtcttccctggattccctgctggtctcagaacccgctccaggctccaccgcctccttccctgcctgacctcctctcctcccaggtccatccggatgccctgccctcggccgttctggctccgccattcccgggccccccagggctcgggtcccagctccccaggctcgctctctgcgccccgctccccaagcagaggggaagaccaggaggaggaggaggaggaggaaggggacggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgt

SEQ ID NO: 15559 - DNA, 5806 bp, Human
atccttttatatctcttgttaccctttttgatttaaaatctctattgtatgatattaatgtagccattcttactcttttttgcttgctatttgcatggaatatctttttgtaggctgtcactttcacctcatttacatctttggatctaaagcaaatctcttgtagacatcataaagttggatcatgggttgtttttattttaacccattctgccaatctttgtcttttggcagagtttaagctaaaagttgggagcatttaaggcatttacgtttaaggtaatcactgataaggaagggcagacttctatcattttgctctttgttttccccatgtcttatagccttatagcttttttgatcctaatttcctgcattactgcttcttttgtgtttggctcacttttttttttttttttttttagtgaaacttcccttgtcatttcctttatgtacttttttttttttttttttttaatggtgtctcactctgttgcccaggctggagtgcagtggggcgatctcggctcactgcaacctctgcctcccataatcaagcgattatcctgcctcagcctcctgagtaatccctcctgggattacaaacgcacaccaccacacccagctaatttttgtatttttagtagagacagggtttcaccatgttggccatactggtcccaaactcctgacctcagttgatccacccacctcagcctcccaaagtgctgagattacaggtgtgagccaccacgcccagttctttgtatacttcatgtagctctttttttaaaatagttaccatggggattacatttaacatcctaaagttacaacactctaacttgaatttatacaaacttaacttctttaactttccttgttcttttttgtgccgtgttgttctgggccagtgttagttgctcacatgtcctgtctttcccttaggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggtctgtgtttaaattgcaccaggaacctgtcctgtttgacttgtcttgatgccattgccagagacacttcacttcgaccttcccctcttcactcttaacagtttacaaacttgttatttctactacttgtcatttttattttgacttctagctaacgctaatcctcacctctctggactccttatcctacctgttcttttcactgttccctctgtagtgttctttaatattattttgtcctgaagtgtgcatatctcccttaatagtccctgaacaccagttactgttccagtgagattttcctgggcctgggcatacacttcacagcatcacttgtcaccagcagatgtgatcccactaaaagctattatcagaagaattaattgtataacatgcctcttagtcctgggccataccttagccttgtgcactgtacctgggagggcctaccctattccgtaaccttagggacaagtaatgcacaacagctgcttcctcaacctgaccccccaactcacttttcctaaaaacaggcccatatactggttctttgctgtaactgatgtgcatttgcaattgcattgtctcctcctaataaaggtaacatgtacttcaccatgatctctttacttttaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacactgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttggcatttgattcactctttgaggtggttcaaaaacagaatcgggccctgccagctttacagagtaaacacctttggagggagagggaggtgtcatatgcctcagtgacaacagtataatggaaaaatacaactgtctttccagctttggcctaatctgaatttgaattattgcccaaggccttctaggaaatactgcaggatattatggtcttaattcgtggactggatgcaaggattttttgtgggctcaaaggacaccctgaggaagtgggaaattgtgacaaattccattgcttctgggaacaagatgaattttgttgttattcacaagggttattacatactgcccagcactgttgaggcagtctacccccagtgctgccaaggagccaagtgccccaatacaatttagtaggctactgtcactgtaaaatgatgggggaaccataattggtgtggaaacactgggttactagggagtgaaggagactgcagcaaactagatggaatgtgctccttgtaatatgttctagtaattgtgcaggatcagtgtgtacagacattcttagaatttccaggcatgtgtattttttgtagctgaggtgactgtcaaaaaataataaacaacctaaaggttttgtgtattccaatagcctttctgggatgtgcacctcaagaacattgctgcataggccaggaaaacaagcatagaaagaaggggcgggggatgtccttccaggaatgtgactttgtaacctaccatcatcctgtgtttaaatgaattcaaatcagtttcattgattaccagtatttgctgcccactgaggcaaggtgtccctccaaggtcatcaggaaagagagttaatgtagggttaccaaacctagtcaaaaacacattataccatcattataattattacaatgaacatatcagtcacctcggatttacctcaggcctttttctaagctctccctcccctctctggccctcaaggcaaccattgatttataccttcatttataataggtttgtttgtattttctataatatatgattttattaataaaatgtctttttttccagtttcattcatgatgcataattattttgagattcttcaatggagcttatatgtggtggtcattctttttattgctgagtggtatattttttatggatatactatttgttatccatttgtttataagcatttaggttttatctagttttggctattacaaataaagctgctagaaatgtacaattcttcatatgtgcatttttttcacttctcttgtgcaatgcctgagacacaggataaatgaatgtttaacttattaagaaatggccaaaaatgggctgggtgcggtggctcacgcctatactcccagcactttgggaggccgaggcaggcagatcacgaggtcaacagatcgaaaccatcttggccaacatggtgaaaccccatctgtactaaaaatacaaaacttagctgggcgtggtggtgcgtgcctgtagtcccagctgcttgggaggctgaggcaggagaataacttgaacccagaaggcggaggttgcagtgagccgaggtcacaccactgcactccagcctggcaacaaagtgagactctatctcaaaaaaaaaaaaaagaaaagataaatggccaaattgatctaaaatggctgtttgctcttgcttacctactgggaatgtgtgagaattccagctgtttcacatccttgccaatacttggcatggtctatcttttagaatgtacccttttaataagtgtgcagtagttttaattgcatttccctaaggattcatgatgttgaacattttttcatgtgtttatttgccaaatgtatatcttcttttttacacttttttttttttcttttagacggagtcttgctctgtcacccaggctggagtgcagtggcgtgatctcggctcactgcaagctccgcctcccaggttcacaccat

SEQ ID NO: 15560 - DNA, 11652 bp, Human
atttagcatttttttcatatttcctcctctttcttgagtacagcgtaagctattggggtctgtctcttgttttgtaaatgtcccatgcagttaagatagtgtctgaaatacagtaggtgttccttgaatatttcttagaactatgaataagcataatactacagcatccctgttcaccttaatattctgatagcactttctaaatgttttctttacttctccttccaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagactaaacgctgcttgtagtcatagttctaacacagctgtgtgctcagcttcatttgctcacttctcagaattcaatgtctcctgctcaaattttgctgtcatcttaaccgttttcacttatcacagatatgtttctccaggtccatttcgtcatgtatctgtgaataactacagaattattaactttgagtaatttggccgggcgcgggggctctcctgtaatcccagcactttgggaggctgaggcgggcagatcacgaggtcaggagatcgagaccatcctggctaacacggtgaaaccccatctctactaaaaatacaaaaagttagccgggcatggtggcaggcgcctgtaatcccagctactccggaggctgaggcaggagaatagtgtgaacctgggaggcggagcctgcagtgagctatggtcgcaccactgcactccagcctgggcgactgagcaagactccgtctcaaaaaaaaaaaacacaaaacaacttttgagtaatttaaacaattcacaaatgtttttgtctttctttccccatacactcgcccttttcttttttaaaaccataaataaatctcaattctcaattcagacactgtcggtgtaattgcaggtgaaatgagaatcacctcccagccaagaaatctgatcccaattttccaaatctttatttctgggttcagacaccacattttcagcccctgtcttggcatataaaagcatttataatggttcttcttttcagataagaaacatcaccaaaaggaaatagatatatctcaacttttgggctaggaactctcatttggataaaagaatatttctcctttggttggacattagtgaccatacaggcaggaaaggtgccttccttgaccaccttctctcgcctgtcttcctcctcatggttctctcaggtattttttttctgaggaaaccagaggaagagctctatattagtccacttgcctcagggagctccagcatccctccatagccactgtctggagaccattcttccactccatggccctgcctggggacaattctctgttaactctgacccaactgaggctcacaaaactgactcaaagcttccctctacagtacacatattttttaaatgaaggaaatttgactgaactatgagtggactcagagtgacattggatgttgtgtgtccatttggtggtgtggcttcagggaacatctgtaagaatatatcccaatatttcggggatccctgcagacctcactacacaagacctggttgagggtcctttaaaaggagcgaagccacgccctgacctcagagtctcagggcataatttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagcccgtagcagtcgggagcgtgtgtgaaccgtagtcaggcctgcaatgtcgaggggagaagttgctccttcattgcgaggacgataggagccatggcgggttttgaatggtggagggaagggatccgaaaaaggatttttaaagtattccaatgtttgctgaggaggaaaccgactacagtgaggtagaaacgatgaggatggaggcaaggagacgtttgaggaggtccctgcaacaaactccagaagtgttgcggtggtggctgggccagagcagtggcaggaggggttgggtggggaagtcatgagattctgggtagatttttaaagatggaaccaatggggtttcctgccgcatcagatgtggtcgtgagtgaatgtagggaggaaagggctatccagggtttttttggcctgttttccttcctgaacgtgtgaaagaatggaaattggtaagtcacagcagggagcacgtttcaggggcatcaggaattgggttttggacttggtgaatctaaggtgttctgcactggaggttcatcacgggtagctgaacatgcaggtctggggttctagagagggagttgtgctagagacttcaatgggtgaggcataaggtcaaagcctgtagtagatcagatttagagggtggaatttcaaggaagttattttgtgtggtctctgaagtgagaggtgggtttagggtggaaggccagggatgaaggggtggacacttaagattccttccagaaaggaggggtcctggcatgtgaaagcattctagatggtgttgttggaagtcaatgcttggtgctgcaaagtgaaaccagcactcaggcaaaagttttctcagcaaggcaatttacttctgtgcaagtgtgctgcctgtgttaatcacgatcccaagagcacactgaacaaaggagggaaggggtttttatctctaacccatagtccctaccttcctctgtgtcactcccccatgggctggggtcggaccgcttaatctaagctgagccaattgggtatttgtgagtattttccaaataaggaagagggaaggggaaggtgagttacagtggtgggacatgtgagttgtgtaggacgtgtggttttggcgggggcaatgggtgcaaagtgagtaagggaacagatgtgaattattggttagtgcttacaggaaggttgtttatagtaactaggggcaaggaggcatggagaacaagaaaggtttgagaacaaagaacaaggaagttaacaggctaaacctttgaagaggaattttattatatcttatagtgtcagcaagaggagagggctgtagagcataagtagcctggcctgcactggagaccaaggtgagggatgcagtaggtttgccaccctacaggctcagcatgccttcatgggcgctgcctgtggagcagtcccatccccaaccagtgcattggtgcctcagttacccaaaccctcaggtaagcagaattgatgaacatctctaatgaaggatcactgcagctccccttcagaggaatatgtatcaggtaggctggtttagtgcaagggctagtgtacaccttgcaagtacgcagaaggaactaaaaaatgtatgtacaaagtaagggaaatttatactagcacttaatgattggtcaaaatattaagttgccttgaagtattttattacaatggaaaaatcttaaccaaattttcttaaaagctttaaagcaggcaaaacaaacctaatttttcaaaaactcatcagttcatttgcatggatagtagtagctgtttcaaaggcacttgagatgtacagacaagcctgatacaaacagtagccctatgaggtgggtgccattattatccccacttttaagatgaggacactcagacgctggtctttatgttcacacagctggtgggagccagcactgagatctgagtatctgaagttagagaggtaacccaaaatcattcctgccaaagggcagggtaggcagggcttagggaaacagttcagtcgatgagatcccactgtgggaacctgccactcccagcttccctcctcttgtgaggttgccatggtggcagaaacttatgattcctacctagatgagagtagattgtctcaggccctcacttagcccaacacacccccattatctcagcaactcagtgtggagaatgatagtgttctgggactcttcagtgtcccttctgcctaccgttcttggaggtcctgcagtcacccaaagctctgtgttgtaaattctgttttggaattatgtggaagggtttctatttctggcaagcaatgggatgaaatgtggaacattatctcaggcataggaaccagcatgtgcaaatacttaacttaaggctaaactaggagtgttcagggaacctcaggcctccattatgtctggtgggatcagacagcagggacaggattcagcccagaaatggcagcctgaggatctgggtttgtatgctgagagaattgggagccactgcaggtttggagctaggagggagtgatctgactttggtcttaaccaacttcctctgtacagtgaaaaaagactgtgggagtgaggatgaaggaaggaataccactgaggagcttaatgcaacagttcaggttggaccagagtggtcgctgtagaggtgggagatgtggatggattctgaatcatttttcttaaagtgggaccaaccagattttctgatgtggaagatgagaaagaaaaggcaaggggtgaaggaagaccctggattttttagtctgagaagatataaagatgccatcaactgaagtgacaaagttggtggtaggagtacctttcagaggtaatatcaggagtgcagtttggctatgtggaatctaccatgttccaaagacacttgagtggaggtgtcaagtagacagctggacacagagatctgaagttcagagaagggattcaggttggagctatccacagggtggcagccagcatgtggatcaggatggagctttgcttccaatttagagagagaatctttaggtcatggtgacagtgccatcagcacactgtaagggcagacacagcagggtagaggtaggggccatcttagagtctagaagagggagggaaatgtccctgggaggaaggggaataatagggtcaggcaggtggcaaagcgttccaggcagagagtggatgtgaggtgaagtactgtagtaatagaagtgaggtggcagtgaggccagagccagtgcttattcagctctttatgtgctcctcaggcttccatggtgacctttggtgggacctgtggagtttcagtcaagctagtgaattagcccagggacagattgggtcagtaggcagaatccctgtgcttggggtaggtgcccagtgagtgtaggttttgaatgagttaaatgttgagaagcctgtgactgacctcagtagtacaacaacaaagcagaaaagggctgagtttatctgggatctgcacatggttctggattgctgaattgacccatgaaatagagccaggaggggaagatttaataggtggattcagggcaacccatggcagtgtggccgttgatcaggaccagatgtaatcctggatgcattatccaagcattctctggatgctgtgtgcagatttgcatgtggggaagccatggaggtaccagtgttgtgggtgtccatagatgtaaaggaggtatagccaaaagggtgatgtgcacatggagatggagtgtgaattcatgagcccagagctttggtatggagggtttctgaaagaatgcttagctcaggtttgtgtatgaggaataatctgttgatccccagggagctggctgataggagaagggttgggtcctacataccaggcccatggtgttttatctgtccacttgcctgttctgagctggacaaaatgattaatggaatatgagtcgagaacaggcaccaatcacaccagggcctgttatctcatttgagttagatgtgacaaggagtcctggagagagaggctgtccttaagctcagttgtccacctcacacagggctatgtgaccttcaaggatttatttgtttacttctcttaggaggaatgggagctgctggatgaggctcagagactcttctattatgaaataatggcttctgtgctttgcatttatagtctccctgggtaaggccccagtatcccatttttctgggctgggtcctactcttcctttttgccctaggggttgctctttcctttccatagctagagcatgggtactgctctcttctctgattccctcacataggtcccctgggtgcctaggctcagctagatgcattggcccctctcttccctgtgttcctcaactcctgctgccctgaagccttgccaggaagggtttggaggtcaggggtcctaaggtgacccagtgaattctgcttggcctctccctggccaggtgactgtccacactcatgacacctctggactccaggctccacccgcttcctctaattgtaatttccttgagtctgcctgtgtcctcaatttcagtcatcatggtcaccacttgtgggcccactgcactgttcctgcaggacaattttctgaggttcattttgtagcatttgttttcttgcaattttgcatgggtgggctactctggctagtgctctcagcctgtttcacctttcccctatgctttgtatcttccagatcctctgtggttgttgaattgtaacaagagagagaactctggctgcctgagagggcatgactctagtcacagcaggaggggcttggacaggccctggtgagtgggagctgagggacgccataacctcagggctgggttcctgtagttccggaaacctatgttgtgcccatcacaagtgccaaggccagaggccctaacttatttctacctttttatccccattctgtacactcttgtcatttctaatctgacttctgacccagggctgtcttctcccattctctaccagaggggctctagtagagcaatagctctctctgcgatgctttccaatattgtactacacttacactattgtgtcataagatgtgtgcatatctgtaaatagtccctgaacacgttacttatttttaatcacattttcctgggcctgtactcacatttcgcataggagtcacctgtcacccacagtcagccaaggtcctgctaaaagtcattgcagaggattaagttggagaccttgtactacaccccatcctcgtgtctttgtttcttgtgaggccatctccattctgtgactcttagattccagtactgtacagcagcccttttttcaacctgatcctagctctgttccaccaggaaacttaggtactcagtcctgggtacagcagacacatatttgtgatgtagttgccccacccaccaaagtcagcatgtacatcaatagtatttttctgccttcaggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggac

SEQ ID NO: 15561 - DNA, 8376 bp, Human
ccctttgtaaaaaatggaggtgagtttggacgcagtagctcacacctgtgctcccagcactttgggaggccgaggcaggtggattgcttgagcttaggagtttcaaaccagcccgagcaacatagtgagactccacctctacaaaaaaatacaaaaattagccgggcatggtggcatgtgcctatggtcccagctacctgggaggctgaggcaggaggattgctggaacccgggaatcggaggctgcagcgagctgagatcgtgccactgcactccaccctgggcaacatagtgagatcccatctctacaaaatatacaaaaattagccgggcacggtggcgggtgcctgtggtcccagctactcgggaggctgaggcaggaggatcagttgaacccaggagattgaggctgcagtgagctgagatggtgccgctgccctccagcctgggcaacagcgagacctcaactctgaaaaaaacaaaagaaggagatgaaatttacataacttaaaattagccattttgaacggtacagtgaagtggttttcggtgcattcaccgacttgtgcaaccatcactgctgtccagtcccagaacattccatcaccccaaagaaggaagccccatctccatccatcagccatcaccccctgccctcccccggcccctggcaaccacagatccacttcctgcctctgcagatttgcttgttctggacatttcgtctatttatttttatatagtttttaatttgtttttatttattttttttgagacggagtctctctgtgtcacccaggctggagtgcagtggcgcaatctcggctcactgcaacctccacctcccaggttcaagcgattatcctgtctcagcttcccaagtagctgggactataggcgcccgccaccacgcccagctaatttcttttttttttttgaaatggagttttgctcttgtcgcccaggctggagtgcaatggtgcgatctcggctcgctgcaacctccgcctcccaggttcaagtgattctcctgcctcagcctcctgagtagctgggattacaggcatgtgccaccacgcccagttaattttgtatttttagtagagatggggtttctccatgttggtcaggctggtcttgaacgcccaacctcaggtgatctgcctgcctcggcctcccagagtgctaggattacaggtgtgagccaccgcacccagcttgtcaattatatctcaataaagctgttgaaaaagtttaaaaaaatcacccaatcgggcacagtgtttcacacctgtaatcccagcattttgggaggccgaggtgggtggatcacctgaggtcgggagtttgagaccagcctggccaatatagtgaaaccccatctctactaaaaatacaaaaaattagccaggcgtggtggtggacaactgtaatcctagctactcaggaggctgagacaggagaatcacttgagcctgggaggcggaggttgcagtgagtcgagatcacaccattgcactccagcctgggcaacaagagcgaaactccgtctcaaaataataataataataataataataatcacccatacagacgcgcaggactcaacgcaggactgccagctccactgccctgagccccccggtgccaggcccagcgggcagtgctggagccccagtggcttgggatggggagactgggactctgagctggcaatgttcctgggtgctggctgcatgcccgccatgtgctgggctccgggatccactggttcctgacaccctcacctgcccctgggggtgtggccatcttctagagagggaaactgaggatcagtgcagaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagacttaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagtgaggggtcctggggagggggcctagggggcattggggctcagagaaggggcttggggggcttaggcattcagtgggggtgcttggtaggtgaggaggggaggggattgcaaaaggaggggctcagggaaaggagggggcttggagagggaaatggggactgagttgaggagggacccaaggatattggggggctcagatggaggaggcccagagaagggaagggggtcagatggaggaggcccagagaaaggaagaggctcagatggaggaggtgcagtgaaggaaagggggtcagatgggggaggcccagagaagggaaggggctcagatggaggagggggcccagagaaaggaaggggctcagatggaggaggtgcagagaagggaagggggtcagatgggggaggcccagagaagggaaggggctcagatggaggaggtgcagagaagggaaggggctcagatggaggaggtgcagagaagagaagggcctcagatggaggaggtgcagagaagggaagggcctcagatggaggaggtgcagagaagggaagggggtcagatggaggaggtgcagagaagggaagggggtcagatgggggaggcccagggaagggaaggggctcagatggaggaggggcagagaagggaagggggtcagatgggggaggcccagggaagggaaggggctcagatgggggaggcgcagagaagggaagggggtcagatggaggaggtgcagagaagggaagggggtcagatgggggaggcccagataagggaagggggtcagatgagggaggcccagataagggaatggggtcagatggaggaggtgcagagaagggaagggggtcagatggaggaggcacagagaagggaaggggctcagatggaggaggtgcagagaagggaagggggtcagatgggggaggcccagataagggaaggggctcagatggaggaggtgcagagaaggggagggggtcagatggaggaggctcagagaagggaagggggtcagatagaggaggcgcagagaagggaaggggctcagatggaggaggtgcagagaaggggagggggtcagatggaggaggctcagagaagggaagggactcagatggaggagggggcgcagagaagagaaggggctcagatggaggaggaggcgcagagaagggaaggggctcaagatgggaagggggccctggaaggtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccgcctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttgggaggccgaggtgggcggatcacgaggtcaggagattgagaccagcctggccaacatggtgaaaccccatctctactaaaaatacaaaaattagccaggcatggcagcgggcgcctctagtcccagctactcaggaggctgaggcaggagaatcgcttgaacccgggaggcggagcttgcagtgagccgagatcgcgcccctgcactccagcctgggtaacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctgctcctggtttctgttcattggtgggggagggggctgtggggacgcgtgagtggcaccttcaccggccttaggggcacccaccgcaggtgcactgcctgtgcagatgtcagatgttcagagattccctcaaagcccgggaagcaggggctggtgttatctgcacccgacagcggggtgttggggggaggcccaggttcagagaggttgggtggctgcccagaggtcacacagtgaatgccgcccagcactttgggaggccgaggtgggcggatcacctgaggtcaggagttcaagaccagcccggccaacctggtgaaaccccatctctataaaaatacaaaaattagccgggcatgatggcgggcgcctgtaatcccagttacttgggaggctgaggcaggagaatcacctgaacccgggaggcggaggttgcagcgaaccgagatggcgccactgcactccagcctgggcgacagcgagactccagctcaaaaaaaaacaaaaaccacgggagaaaacggggaacattctcctcttggatccaatagaaacagtaaaacgtgaatatgaaataataaatataattgtatatataaataatacagaataaaatatgaatatgatggctggatgtggcagtcacatctgtaatctcagcactttgggaggccaaggtgggagcatcgtttgagcccaggagtttgagaccagcctgggcaacgtagtgaaaccatgtctctacaaaaataatttttaaaattattaaaattacacaggagaggccgggcacagtggctcatgcctgtaatcccagcactttaggaggccaaggcgggcggatcacgaggtcaggagattgagaccatcctggctaacacggtgaaaccccgtttctactaaaaatacaaaaaattagccaggcgtggtggcgggcgcctgtagtcccagctactcgggaggctgaggcaggagaattgcttgaacccgggaggtggagattgcagtgagccgagatcacgccactgcactccagcctggtgacagagcaagactccgtctcaaaaaaaaaaaaaaaaagccgggtaagtggcacctgtcgtcccagctactctggaggctgaggtgggaagattgcttgagtccaggaggtggaggttgcagtgagccgtgatcgcaccactgcactccagcgtggtccacagagcaagacccagtctcttaaaatgataataataataataataataataataataataataagaagaagaagaagaagaagaagaagaagaagaagaagaaggaagaagaagaagaagaagaacctgtagtctcagctattgaggaggctaaagtgggaagatcactttagcccaagaggttgaggatgcagtgagctatttttatctcatttatttatttatttgagacagagtctccctctgtcacccaggctggagtgcagtggcgcgatctcggctcactgcaacctctgcgcccccagttcaagcaattctcctgcctcagcctcctgagtagctgggactacaggtgtgagccacaatgcctagccaatttatatatatatattttttagtagagatggggtttcattatgtcgaccaggctggtcttgaactcttgaattcaggtgatctacccatctcagcctcccaaagtgctgggattacaggcgtgagccaccgcgcctgaccttatttcatttatttttgagacacggtctttctctgatgcccaggctggagtgcagtggcgtgatcaaggctcactgtagcctcagcctcccaggcttcagcaaccgtgcccggccttagaattcactcttttaaagtgtgtacagccgggcgtggtggcccacacctataatcccagcactttgggaggccgaggctggcaaatcacctgaggtcaggagtttgagaccagcctgcccaacatggtgaaaccctgtctgtactaaaaatacaaaaaatt

SEQ ID NO: 15562 - DNA, 35969 bp, Human
tttgagtttgtggctctggtttaaggtgtttgtgggcacagtgtgaggaagaaacatggaaaagacagattttctctagactgaaaaggagattgcccaggggcgggaggaagacaaacagaggtcagtgggtcctgaggctgacggtatgtgtgacttgtgtccctgaaataccatcttggaaactgcaggacccccgggaggaatggctgcaggggatgtcttagcagatgagacaatagccaccgccaccccaccccaaattcctgtgcccctagtgggatacagaagtagtaggttgctcatcaacccaagcagccacatcagcttgggcagtggaaacaactcagccatatcttttgggaacagaggaccaaatggatgtgctgtcccttctcccaacccactacatgggactgtgtatagccctggtgttaggaactaactccaggaaggatgaaggctgactcccttagtctccagtagataagctgctaggggcagctactaatatataataactgagttatttacgtaaaataatggatatgtgatgcttcttgcatgcctgagtttctgggctgagatttattctgtcttgaatgtcgcggttttcttaatgaagttgctgaggaacgcaggggccttgttcattttgcctttttctggaaactttgtcctccaattcccagatccagagcagtgcctctgctctcagccccataccgcccacattctcattaggaaaagcaaacaaaagccaaagtcctgtccagttacaagccttctctaaacggggcagttggactgtatatattcctggcgcatcaattttactcagacagggaaaatatttttacattaaaagaaactaggttaaattatggtagagaatgcaaaattcacagtttaaaaatgatgaaattccagacttcaaaggaacttctttcttgcagggtagggggagggtattctgtttcagaaccccatgcgggtctccactggagttcttttgagaaggacacttctgtggaaaagtttgagcagctctggccctgcgcctggcctggctaggggccaccttcttctggtttgggctgcagcgccctatgggtatcgcgttcttgttaatatctcctcacgtttctaaactcacagcttgtcagcgcgggcgcaacctgagagctgtcgcaggtttccagctcactcgtttcccaaaggaggaaatggagaatcagcgactttaaaggacttgcctggcgggcatccacgcttcccaggctatcgctcctccctgcgtccttggccacctccgttctttaatcctgcaggaactcaggacccacgtgcaaatacaaagaaccgtatccacccacccccggcccttcttcatcctgcgcttccaaccttgggggggtcctctctctccactggggtatctgacgcccgtggggggtgcttagaaaagtttggtagattagtgactggtggttctggaacaaatacatcacagcccaaactgggggctggtggtggagaggtgggtggatgggggctacaaatctgctcggcaactgccctttcagccaagagagaggagctgaggtcctctggggttggaggactggaaccggccagattgcgggctcaaggggcgaaggcaggttggcaggggcagcctcttcccgccgcccacaatcctcgggcgggcgcgcagccgagccggctcggctggctggcgcaatctcgcgcgctccttgcattgatcaaaaatgggggttgaaacagtaaacgcgaggaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgccggtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagctgaaagggattgcaaacttaaaggtccgcgtgtgcgtgcccccctacgccttacaccagtgtttgctttagccagcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccggctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggcagcgctcacagtagctgagaggacagggcttattttttctcagtggttacagttcattttaggcgagattccctgctccagctgtggagatgtttcctgtagcctcctcctgcaccccccatgttttggagtgttcccaacgtttgttccctatgtatttcgttattaatttattactataattgtaatggcaattgtcatcagtaatacaattatttgttattaatttttctgggaggatttttgcccttggactgcatgtaacctggggggcaggagggtgagggggcaggcagatgttgctttttatgtatttccttgatttagttgaattgtaaatattagagaagctttcaaacttcttttgactgtaacctacagtgaaaaacatgtttacaaaatgacaaagtatacacattcaattgtaacaaaaataaatgccttatgaaatgatgtgtagcctaattacctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtctttttttttaatctaattctttttttttttttttttttttgagagaagtcaagctctgtcacgaggctggagtgcagtggcttggtctcggctcactgaaacctccgcctcccgggttccagcgattcttctgcctccgcctcctgagtaactgggattacaggcacccaccaccaagcccagctaatttttgtatttttagtagagacggggtttcaccatgttggccaagatggtctcaatctcttgacctcatgatctgcccgccttggcctcccaaagtgctgggattacaggcgtgagccaccacgcccggccttgtctaattctttattgttaaaatactgttttttgagacaagttgcaatccagtttaggttatagctgtgttttaatgatgccctccttagcaagcatcttaaaaaaaaaggtgcctcctatctgtagaccttctctggctggttgcttttgcacttattttgtgttcatttttaaagcttttctttttctctttattttttattaagggaatcctcacatacacaaagataaaagtagtgtaatgaacctccaaggacccatctctgagactcaacaattatcaacattgtgccagtcttgttgcagcaccctgggacgaatcttattcacagcaggctcttccttcttcctgcccaccccacgcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtgggtggggatggatgcctggggacctcactgtagacccttccttgtcccctcgtcaggtttgtatgttcagagggaaagcagtgcagaacatatttaaataaccctattttcctttatttttttctaggtgttgttagagatacaaaaggaattattagactacaaaggagttggcattagtgttcttggtaagatttacttttgaattctgtgaatgtccatgtttcaaaggaagctttttttttttttttttttttttagaggcagggtcctgctctgtcacccaggctggagtacagtggcgtgatcatagttcactgcagcctccaactcctgggctcaagtgaccctcctgcctcagcatcctgagtagctaggactataggtacacatcaccacacctggctaattttttttaaatgtttaaaacattttttaaagatcccatgagatgggatctcactttgttgcccaggctgatctgaaactcgtggcctgaagccatcctcccacattggcctcccaaagttttgggattacaggcttgagccactgagccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttaccctgtcataattggtttttgctaatcataggatttaggatcagaagatactgtatatttgcataacagtgcctccaaacatttataatattgctttacattcaatttacagtttttattatacttaaatacaacctcattaaagtttaaaagtacataagccttttatgaagacctcgcacattgataatcttattaagtttcccctatattttttgggaagaggacctctgcattctaaaacttattttcttttgtttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactgttgcacatggattcctgtttgtgagaaagagatggtaagaagaatcacagagagcatcacggagtgataaattaataaataacttgctcagtgaatgtaccacttgaaaaatccttctgccatgactataaagctaaaatgtttgcaatttgaaaatcagtttgtatggtcccctaaactaagtgagccttggcccacaatttgaatgcagaataactgaaatttccctgtattgttgtttacttgcaaatttcgtaggtatttctgttcatttggttttgagctggaatatttgttattgttgtttatctttcctttcacagaaatgagtcacaggtcatcagattttgccaagattattaacaatacagagaatcttgtgcgggaattgctgtaagttttaaaaagaccaaatcatgttacttttgttagatacttcctaaatctggatgtcttccagtattttctacactctattgtttgttcagaatatttcataatttaaaataatccttgtaagattctctccaattcactattagtacctaatgctttttatttgttccccatcccgtgtttatatgtttttgtttttattttatgtgatatttccaaagatttgaaatcattgtatctaggaatgatttttcagcactgtggcagttaaactggtgtgaaagagatgtaaatgacacagaaatggtcatctttgtcagcataattgactataaactagttcaggtgttctcgaagtttgagtctcatacgatctgtcagagtcacctggttagggggaatattaaaaaattcaagtggggccgggcaaggtggctcatgcctgtaatcccagcactttgggaggccgaggcgggtggatcgtgagatcaggagatcaagaccatgctggctaccacggtgaaaccccatctactaaaaatacaaaaaaagaaaaaattagctgggcatggtggcgcatacctgtattcccagctattcgggaggctgaggcaggagaatcgcttgaaccagggaggcggagtttgcagtgagccgagaccgtgccactgcattccagcttaggtgacaaagcgagactccgtctcaaaaaaaaaaaaaaaaaaaaaaaaaaatcaagtggtgggcaccacttagtcctgctgaatcagaatctctggagagactttatttttaacaggctctttgggtaattgtaagagttctgaactgtaggaactactgcttagacgaaatctcctgggttatctgtactgcctttcctatccagagaatcccttattcttaaatagattgctatttaaaggagagatttttatatattatataaacatgttcacataaacctacgaatatagcaagtttgaaagcataccattttttttcctgctcacagaaataatgcacatttatggtaggaaaaacactgtagctcacaactaaactgaaattaactttaaccccactaatcagggataatcactaatatgttaggacccattcttgcattattacattaacaaaattggaattatactgattatttcaagttttctttttcaaattgcttgataaaatgattcagatggggcaggcttggtgatatttctgtgaggagctgtagacgctaattgcaatgtgaatgttcagagctggtagccatctgcttggcttctctcgtccattggcctgctgagtatcatgtcacattcataggacaatcctgtccttcatggagtgggtatttggaacatcagcctgggagagatggcatttgaccacatggctatgaacttcctctgactggggtcccagttcaatttaagggcctatcttttcttctcctaacctggttcccaccttgtatacctgtacctagacctcggcctggtttctttccatctaattcttggccttgttaactgccctgcatctgaataatgtgaacctggaactctgtcttgggttatcagtcttcccagctgctaagaacctcatggccagagtctcctaagacctgctggttgcttgctatcctactaagcactgaatataggccatacatctttcaggacaagatatttacactcctaccaccccattccccaagaccctgccacattgccctgccctttattaatttacctctgtatctttgctggagctctgttccctggccatctggcttccgtacacctattcccaggctctgaccttactcagtggcttgggtccagtttccatggccttgtccttttggagctgggcttatttctactgcctgtagccattctcatcattatcttactttttcatcctggagtcaaagaattttgctttttattttgatgtataatagatacatgatttcatgggtaggcctaaaacattatcgaaaccccctgcccaacatccacctggttcatagcatgttgcataacacaggattattggttgcaagttataggacccccaactcactggcttaagtaaaaaagaaatgtattatctcacctaacagataaatgcaggagaatttaggtgcttctaaatgactgcaggaaggtgattttcccccatcttctggctctgctttcttatgtgttctcttcattgggtggccaccattggttgcaggattagctcctacaagtttcttctttccctcaatagaaacagctttccttacctagaagtttgagtaaaggtctcagtaccaaattccattggccagcctggggcaggtactcatccccttgagccagggttgaccacagttgaaccatgtcgactgagagtggcagaggggtaatttcctaaaggaacatcaggctgttgtcactaagaagaggaggaagagcttcaggtcaaacagtaaccctaggctttcaacacagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaagtaagttctgggagctgagctgggtggtgacgtgctcaatggtgggttaccccgacccagggcaatctgtagttttcaattattttctccccttgacagtgttagttcattaccatttagattgggtggctgtactagctaagactagagcctatgcatactcttactttattttattttctattttttttctagacagagttttgctttgtcacccaggctggagtgcagtggtgcaatctcagctcactgcaacctccgcctcccaggttcaggcgattctcctgcctcagcctcccaagtagctgggattacaggtgctggccaccacgcctggctaatttttgtatttttagtagagacagagtttaaccatgttggccaggctgcttttgaactcctgacctcaggtgatccgcctgcctcggcctcccagagtgctgggattacaggcgtgagccactgtgcctggcctatgcatactcttcttgcagaagctagtcagtagttagtagtagtttttcagctaattagctgaaaaagtccaggggctggtttggctttagatatggcttgatcaggggccccaacaatgtctccaggacctggtggctccacaggcagaaaaagctgtccctttcttgaaaggtggctgcagctgctcctgaccttatattctcccaagtttcaatgcctttatggagcattcccagtaacggtctcatgtcctgtgccccattctgaatcagtccctgtggccatgcctgagttgcattctacctctgggctgtaggtttcattggctcccctggaactacgtgggctgagagtaggtgagggctggggttccaagaagaaactactagtccatcaatggatgtaggatagatggatactgggtgacaagtaaaaactcagatatctcccatgccttttgaaaaaatttactttattttattttgttgagacagagtctttctgtgttgcccgggttggagtacagtggctcttcacaggcaggatcatagcacactgtagcctccagctcctgggctcaagtgatcctcccaccttagcctcctaaatatctgggactatgggcacataccaccatgcccaccttcccatgccatttttgaagatgatttgttcccagtaaaagtcgaaaggttggatcgctcatcctctcaggatgttgataacgatggtaacaaaggatgaggctgggagggtgctttcactcgtgcaatgctttggagtcagttagtctttccctgctaggggaggcctgtcagtctcctggttgactcccatctatgtaaggaaagaggagagtgaaaagtgcaaagtctcaaacttgtcttctgtgatagaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagagtataaaaggcagggtgaggggaacccactgactcggtttctgcagggacattttaatatatacaagagcgggaagaaccatgggtgtttgaggcctgcagaacccctgagccagtgcagctgccagtgagcaggctgccaggtgcgaattcccagctgttgcagtgcctgagtcctgctgttcccagcctcgtggtgatgtttgcctcacagggtcccactcgagtccttggggaactacctgcttttgagagtggttcttagaaacgtgtttggtcaacagacggggagagacttgtcttcaagagcagatgcagattatcctgagcccaggggacctatgtgagggagcttccccttgcctggtacccacctccaaaagcatcaacaggataccgttttatgagtggcttgccaaggcagggcagtgggactggcgctgtaggtacatgccccagggtgcgatgcgggtagagaatctaagaacaacagttgaactgactgagtggtattctgcctttttaattgggataaaatataacaaattttaccatttaatataaaatataccattttaaccatttttaaatatactggtcagtggcattgagagcattcacattgttgtgcaggcatcaccaccatccatctccagaacttttacatcttctcagatgaaatctgtacattaaacactaactccctctctccccaccgtccagcccctggcagcctccattctagtttctgtctctgtgaatttgactactctaggtatctcctagaagtgaatcatgtactatttgtccttttgtgtctggcttattgcacttagcagaatgtcttcaaggttctattgcacttagcagaatgtcttcaaggttcgtccatgttgtactgtgtgtcagagcttcctttctttttaaaggctgaataataattgtttagatatactgtatttggtttatggtctgctttttattatcgccaggcactggcaattttaaataactataaattactttcccccacccccaacttcctgccaacgctcaattttcctaagggtttcatggagagaggcatgggagagggttctgtatcttgcacaacagaattacctaaagtacctttaagcctctgttttctataatttcttctccctcaggcagcttgtcccatcccttctctttgtcataacagtccctttctcagcaccttctgactgttcttttatacaaatgtaaatagattaaaaaatctgttttggccaggcgcagtggctcaggcctgtaatcccagcactttgggaggccgaggagggtggatcatgagatcaggagttcaagaccagcctggccaacatggtgaaaccccgtctttactaaaaatacaaaaattcactgggcatggtggcacacgctgtaatcccagctactcggcaggctgaggcaggaaaattgcttgaacccgggaggcagaggttgcagtgagccgagattgcgccactgcactccagcctgggtgccagagcaagactccgtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgggtttgctgtccacatggagattgctttagagcatgaactgctccctacacaggatagagtcatttccttaaaaaaattgtgcttcgggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcacacctgtaatcttagcaatttgggaggctgaggtggatggaccacttgaggtcaggagctagagaccagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagctgagatggcaccattgcactccagcctgggtgacagagggagactccatctcaaaataaataaataaataagcaaacaaacaaacaaataataagtaaaataaagtaaagcatgtttccaggagccggtgatcaaatgccccagatatcctatcagattctctgcccagctcacctctccctctgcaccatctctttaccatttgatcagcttttcctcttgttcttttctggggatgttgttttttgtttggtcttggtaatccaggatccggtggttcaccattaacccaaaagctctctatacatgaggtgctgtggcctgcatctcaaacagccagtgcagctttggagaagaactttcaaaagctgggcctcccctgccttcatttctttctctgtcgggcctgcgggaagctggctgcctgacagaacatactggcttaaatacctttctgggttttgttgttgttgttttttgagacggagtctcgctctgttgccagcctggagtgcagtggcatgatctcggctcactgcaacctccacctcccaggttcaagcgattctcctgcctcagcctcccgagtagctgggattacaggtgcgtgccactacgcccagctaatttttgtatttttagtagagatggagtttcaccatgttggtcaggctgctcttgaactcctgacctcaggttatccgccggctttggccttctaaagcgttgggattacaggcatgagccaccacaaccggccaacatctttctgtattttagcctaatctgaaggggtccttttagcctggctctcattcgctgactgggggctgcgttgcagcacttcaggaagagcagggttgccctgcctcaggatcctataactcccaaacttgggtattttgagaaaatcttcatggctcttaagatttacaattgcctaagagagtctagtatttactagctgtgtgaccttaggcaagtcacttaacatgtctgtgtggtaggttctagaagtaataatagtacccctttcactgggttgctgtgaagattaacatacatataaataaatctgtgtatatatataaaaattttaaattttgcactgagtacctggcacttggtgattgataaatattagctgctatgttgttattgttattgtgagttctcagagcctcagcaggagcagacacaagggaagagctggagtttgtagatttatctttctagggccactatgatgcagaatggtgatgctttatgtgtatgaccgtttaatcctcccaactaccctagtaggtagccagtgttatgatcatgattcccattttgcaagtgaggaagccgaggtcatattttaggaagtggcctggctggggtgtgaacccaggccatctgactctagatcctgggtatgtacattctgccattagtgctctctcttcaccagcaaaaggatgagtgtggatttgcgtgtgtttgcaggattctgccttaggagaatagttcactgttggagtccagctcttctctcaacaggattttcttgtcttggtggaagttctcttaaaggagcgtaggaaagagggggctcaggctggtgcagttagtggttccatctgggccaggattttgtcagagcttcccctcctccaggtgctgcttagggaaaatgtcttctacataatttactatggaaaggaaagaattttttttttttttgacagaatcttgctctgttgcccaggctggagtgcagtggcgtgatctcagctcgctgcaacctccgcctcccgggttcaagcaattctgtctcagcctcccgagtagctgggagtacagacgcctgccaccatgcctggctacttttcgtatttttagtagagacggggttccaccatgttggccaggctgctctcaaactcctgacctcaggtgatccacctgcctcggcctcccagagtgttgggattacaggcgtgagccaccgccggaatttttttcaatgttagaattctggtgaaaattctgctgggtttctgcttggtcacacgatgcagagcagcagctcctcacattgtgtctcccactttcctcaggggagtgttctgggatgcactctcctggtcacctctaaaccctactgtcttttaccttggttgaaatgtttctaaaatgcatggtagggatgggagtggggctgagtcttacctcccactcgcctgtcttacctctggggaagcaccagtggtcactggccaactgggacacaagaactgggcaggctgagcggtgagggtgcagctggggacctcaagtgctggcctccgggggaaggggccgagatgtcaggctgcacatggcaggtagaggtacaggaggctgtccttacctgtttggagatggggccagggcctgccttgcagctagaggaggctttcagaggagcccaagaccatcacccatttcagaagtgagaaggtgggagggggcagggaaagagtgctgttcctgaactgtcccacagcctgtaggccagcaagttgcgatcagggtacagcttggggcagggcagacagtcactctctggtaccttcttcaagggttaccttgaagagcatttttttaaaaaggaatgaacacggccgggtgcggtggctcacacctgtaatcccagcactttggaggccgaggcgagtggatcacaaggtcaggaaatcgagaccagccagaccaacatggtgaaaccccgtctctactaaaaatacaagaattagccaggcatggtggcgggtgcctgtagtcccagctactcaggaggctgaggcaggagaatcccttgaacctgggaggcagaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagacgcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaatacaaaacaaatagaccattaatcttaggccacctgttaaaagaatgagaacaggccaggcgcagtggctcatgtctgtaatcccagcactttgggaggtcgaggcaggtggatcacctgaggtcgggagttcgagaccaccctgaccaacatggacaaaccccgtctctactaaaaatacaaaaattagccaggcatggtggcacatgcctgtaatccaagctactcgggaggctgaagcaggagaatcacttgaatccagggggcagaagttgcagtgagccaagattgtgccattgcactccagcctgggcaataagagcaaaactccatctcaaaaataataataataataaataaataaaagaatgggagcatgcaaattaagtttgtgggcctgtttggaaggcttcactggtcccagactaccttctcccagtgggatggggatgcctggaatcctggaattcacagaggggtgtgtagtggagccagttttgggagctttcctctgggaaaagtgctcaactcagtggctacattcaccgattcctgagaaaactgtgccataacatcaacttcagaacctcatctgcagagctggagtcttagaacagccagggagagttttccaggggactttctggtgtccttttctaagccctggtgcacagggactattttgtattgctttaaaaaatttataacagtgatatactcttaggctgggtgtggtggctcacgcctgtaatcccagcacttcaggaggccaaggcgggcagatcacctgaggtcaggagttcgagaccagcctggccaacatggtgaaaccctgtctctactaaaaatacaaaaattacccgggcgtagtggcgtgcacctgtaatcccagctactctggaagctgaggcgggagatcacttgaacctgggaggcggaagttgcagtgagctgagatcgtgccactgcactccagccggggtgacagcaaaactctgcctcaaaaaacaaacaaagaaacaaagaaacaaacagtaacatactcttagcaaagacttgcaggtgggcagagtcaccagggtagccactgttcactgcttgctttgtatcctaacagactcttaactgggcatatgcaaatatacagagtcatatatttaatcatgcaaatggaacttgaactttaccatacaaattgttctgtgaattctatttttccactccacaatataccatgggcattctgctatgtcagctcaaatgcctatttttattttttacttttaaattttatttttgttagagacagggtcttgctctgttgtgcaggctggagtgcagcagtgtgatgatagctctcagaaaccgcaaactcgtaggctcaagtgatcctcccacctcagcctcctaagtagctaggactacaggcaagtgccaccatgcctggctacattaaaaaaaaaatttatggcgacagggtctcaatatgttgtccaggctggtctcaaactcctggcctcaagctgtcctcccacactggccgtccaaagtgttgggattacaggcatgagccaccacacctggcccttttttgttttaaaatatatatggtgtcctgtagaatggacatacctcgatttatttaatcatttaataggcagagttaggaaccctatcctgtgtgtttgcaggtggcattttagaaatgaaggcataagtcttaaaaatgtcacactggtagtgggaagaattgagaccactctataagctgtgtaagcgttttagagcccttgtgttttcaagattttagacggtatgggagttgaaacatgagttaataaagaactggaagccacgagggtcctgtgttaagtagagccacaggggctagacatcagtgctctgcagagggctgggtgggaggggaggcaggacctcctatcctgtgttaagtagagtcacaggggctagacatcagtgctctgcagagggctgggtgggaggggaggcaggacctcttatcctgtgttaagtagagccacaggggctagacatcagtgctctgcagagggctgggtgggaggggaggcaggacctcctatcttgtgttaagtagagtcacaggggctagacatcagtgctctgcagagggctgggtgggaggggaggcaggacctcctatcccagggatgtcttcagtcttcaggacagcttgcttgcttctgagttgtctgcctcttgtttaggcttcatagagccaagttatgggtgctggctccaggcagcccctaaaagtgggtgagctttctgctggccttgcctcctcagatcccattaagaaagccagagatcatgggcggcgagtgtgagcacagcagtcagctaggggttcaggcgtcggtactgaggtctggctaggacggtggacctgacatgggccttgctgcactttggatttagacaaaccaaatccacagtgcagcaagggcccatgtcagctttgaaaccctgggctaacacagagcttcaggcaaaagggaagcttggtcacctggaagtattgttggtgacctgggctctgcttggattcaatcacatggcagggtgtgtttctgtggttctgtgtggaggtggggggtgaacaggctgcaggtgtgggagaggagcagttggaagtgaagtgggaattgcagagcatctgatgaacagagggctgggcagcctcgtgtctggaatgcacacccacgtgcatgtgtgctgtgtgctggacttggccactgtcactggtgtgtggtgatagctctgcagtcccactcgcaggggagctagtggctggagccctgcagcccctggcaaagcagagggcctgcatacttgtgggaagagcttgcattcttggagtcagacaggctagagttggagtcctggctttaagctgcttgccagatgacttgaggcaaagttaacctctctgagcctcagtttcctcatctggaaaatgggatgacggtggctctaacccgaggattattgtgatcaataaagataggctgaggccacagtagacttcaggaagtactcattcccttctcttactttctctcttctgtctcttttgtccctctgacttcttggacgttagccagagagctaccgctgaggctgtggatattctcaggggctgtttcctcttcctccctgccttccctttctgccagcagccactcttgctctttcttcccagtgctgtctggggaggtaggctggggaagcttcaggagaggttgttggatgtttgtggctgctggctgctccctgcctaaggcccctctgggcagcccggtgttggcttttgccaacatgagctggcatgagccactgcacccaggccttgggtcccacttgagacagtgaatgagccagttggtatagggggcttccctgtgacaagctgctggctgttagagcattttccagaccccataatgtcccctcctgttaataaaggaggaagcagctgggtatccccaccctagatcttagctgagcattgactcccagtaaatttttgcacaattcccataggggatctttgattcacacctctggagagggcatagttggcagctgacctccagactcccagctcaagggagatggtgtcttccctgggcgacctctcctcctgtgccctgagcttttactgagtacacgtggagcctttagcaccttcttaaggagaggggttttcagactggggaaaaccatgcaccgctcctcagtgtttcatattttcagcttaagtttgaagggactactgactgccatttgtgtggcccacctgccacgtgccaggccctgtgctaagcgttggtctggcaggaagaagttgaaatacttggttcagaaagggatggtcctgagctgcgggaagggcccaggtgcagctggacttcctggaaccagggacacaaatcctcctccatctgctctccacttctgatcctggcttctctcagcgggaatgttggcttcattttcagatgggccttcttcagatgtttcctagaaacatgatcccctagggctctcatctcctgtctcacagttgcactaatattctgccgctttttctgctctccccactctttctccccacacccaattcagaaaatctcagggaaggccctgattggcccagttaggtcctatgccgaactctgagaccagggagccaaggggccttgctggacctgcatactggctggagggtggagttgggaagagcagggtggataaaatgccaggtgtccaccacaggtaggtggatctcccggttccagatgggaaaaccgaggtgactaattctgggtagtctgttagtgagtggctgccctacaatgggagtcaggactgggagggggagcccgtccttttaacccctcggccacagtgctctctgctggctggaaggcactgtgctaaggctgtgggtagaaaagatgaacagcgtgggcttctagccttccaagaccacagaggccaaacaacaggcacacagaaacttaaaagagcaagtggaaaaaaactatgcaggtaatatgggcaaggcgctctgggagttcaggaagtgaagagctcgctctgggtaggggtgggattggggtctgctgatgccttctggtggagataaggaagtgtgttctggctctcaagaagagtttacattagggcttaagctggacaaggagggactgatatgatgtttagtgaaaaatctgattaaacctttttctgaatggccctcagggatctagaattgggttgaccctagtccttgcttgatgacatgctcttgttcacatgggccctgcttttgtcttgtgtattttctttctttattttttttggagacaggatctcgctctgtcacccaggctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtctgttttaatgcaccttcaacagcagtttgcttgaatatagttctacttttgcaaagatgagctaaacggattttttaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtaccgttgaaaagtggacatattcacctttctctgagacattaaaatactggtgagtgtgtgtggtcctgggccccatgagcaggggagtgggtggtgagtttttccctcctgtacctcaccctggggctctcaggctttgggacctgtgtcccagtgggtggtgatgtttctcacaccaaagacatcgccctggggaagaatctcagttcaccccctggggtaggtcccgtctattccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacctgggaattctgcagaaaatgtctgggtcttgtattagtttcctggggctggtgtaacaaagtactacagacttagtggctcaaaacatcagaaaactgattctcactcttctggggccagaagttcaaaatcaaaatgtcagcagggttttggtccctccagagagccatgccttgcctcctttagattctagtggctcagggtggtccttgatttgtggctgcatcactccagcctccacatctgtcttcacatggccttctttctgccgtgtcttcccttctgtctcttaaaaagagaggtctttggatttagggcctgtccagataatccaggatcatctcatctcgagatccttcacataatgacatctgcaaagtcctttttttccaaataggtcatattcacagattctgggggttaggacatgcgcataccttttcagggtcaccattcaatccacaacaataggcccttcaccaaaatgccagatgggaagcacctagtgcggtgccttggatgcagagaagtgtaacaggtggtatcttcatttgcttttccctttcccttaaggtggttacaggtatacaaagaccagacttcctgctgtgtacatgtatgtgcgcctacacatatacataaatgcttaaactcaccaaactgagaacccccttcttagtggccattgctctttggggttcagtctatagtaacaaaaatatctgcttgatggtaagttggaaatttgccctctctcagataattcagtggccacatgggaccgacaaaacgatgcctctgtcctaacttaggattgtactttttagccaagacttaactaacacatctccataaccacccatgggcgggcagtgctggtgtactttttggatggcatgctgctgtcacctttgttcttgcaatgcttgttgcctgtttctgtgagctcttgacatgcagtggccctcctccagctgcaagcccagggggagttaggcttggcgggatgccttggcctttgggctcctttcccaggcaccatctcagggaaggggtacacactctgcattactgcctgttctctggttctgtgcaacagagaagcaagtgcaggctgggggctcagtgctggggaagcttccacactagaccttgatgtgtgagtttggaggccaggataccctgcctgtgctcactgaagccatttaaagtgcacgatcagcagtaggtatccaaagatttcatagccaagggctaaagaatgtggcatgagcctggaaaagggggatactctttggttggagtgaagagagggcttttgcatgagcttattatgagccctggtcatgagtggaattaggcagagaagagggcagaagtacttttagaaaggttagaatcatccccgcaaaggcactgagggaagagtgtacagtgtgtttggggagcagaacatgggctgcttgaagggcatggtttatgctgggattgggaagaaggtccgtggaagtgtgtgagggcgtgtttagtccacctatttattcattcattcatctactcacccacccatccacccacctacccatctatccatccactcattcactcattcattcattcatccatctgtctacccattcatctatacattcatccactcatccactcatccatccaccattgacccacccatccatctattcatctaccacctgcctacctatccatccatctacccactcactcatccatctatccatccattacccacccatccttccacccacctattcacccatctacccattcacccatccacccatctatccacccgcccattcattcacccatccactcatccagacatccatctgtccacccattcatccatccatccattcatccatccactcacctacccatccactcatccatcaatcttccatccatccatctatccatccatccatccatccatctgcccacccatccatccattcacccacccatccacacacccacctatctatccatctacctacacacccacccatccatctatccatccatcacccacccatctattcattcacccttccacctatctacccatctatctatccatccatccatccatccactcattcatccacccgcccacccactcatctgtccattcacccttccacctatccgcccatctatctacccacttgtccatccatccatccatccactcatccattctcccacccacccatccacccacccacccatccatctatccatctgtccatccatccaaccgtccatccatccataaaatggctcctgaggacctgctctgtacactagccttgttctaggctcctggaagaccgagaagaataaatcatcttccctggctccctaaaaagtgctgagaacctgaatgtgagtaaaagcacttggtgggtatagtggacgggagaccaatttttctattagcttttagctctatacatttctcaggagatgtgtagacatgatgttagaggacagaaagaacggtgataccactgggaaaaaaattaagggcatcaggaacaaaataagaaagcatagaaggaattctgggactctcctgaatccccccccgccacgcctaggtcctttaactccaagcactaaacctgggcctctcccagaaggcagcctgccaaactaatgtggcaggcaggtcatctcctgggcaggtcatctcctggggaatctggtcatccttcacacccagagctcttcactcatttctgaactgccttgacccaggacttccagtccttttaagaataaacctctttctaggaactcccaccaccccctcagttgcctgcctggaaagcgtcatcccaggcacttggtgttctgtgggaccttgttactggagtagagaggaggctgtactctgtctctcctctgtttatagctggagactcccaggctgtgcctgaactcacttagattttcaggaaattcttcttttctttggaactatggaaatagttgagcaacatggccccatgggaggtggccacttttaaagaggaatacctagaattagaatttgcaatttaccaccacctttgctcctcatttttgtctctgagaagatgcaccccctccccacttccatgccccctgactcgtaaaccagctccttaacatagttccaggttgtttgctgggggtttcaccagccctgccagtgaccttggcagggaattctgggactagataagacaaccatcgaagcctccaagttgattccatagcccagtcacccacactgtgctgactgaccccatgttgagcccacgtgggccgtttagcaccttgggcttagaagccccattttgccacggtggtgcgtgtgacctcgtgcaaatgacctaactgctctaagccacagttttctcatctgtacaatggaggtaatgatacatacttcttaaaattgtcaagagaattaaaaggaaatgcttctgaatcaagaatatataatataaggattgagagcatttttacattaaggattgaggactcttgtgctggttaatttgtataaagtgctagaaacagtggttggcacacaggaagcattccttgcatgttagctcttaatatcattatttgtggttattgttatataaagcaattatgatattcctgacacacagtgcttatataagcttatgtaatataattaattatataagtatataatatatattaattttattatataaggatgtccaagtgacagattccatgtctggatctgaggtcacctttatcaccttatgtgggtaccaggccttaggaaagagaaggaggcacgtgatgggtctagcgaagaccctaaaataaaatgaagcaggcagagtcctaggcaccttacacatgtgaatgcattttgttgtcatcacaaccctgtgaagtagacattgagcctatgcagcagaagcacagataggacaaggatgcagctggaaagtgggaccagccaggctacgaacatgggggtggaaggctcattccagaacctctgctgctgtctatgtccaggagtgcagaaggccttaaacatacaactcaagctataaagtaaaagaatgacgtatttaattacatgaaaattttaaaattttatatggcttaagacatcataaacagaatcaaaaatgacagaatgagaaagattttgtagtatattaaacataaaggttactatccttaatttaggcaagaacccacagatgaatgaaaaaggataaggaaataaaagtgggggtgtggtggttgctaacagtatgaggaaacaactcagaagaaatgcaagctgcctcatagacaaatggaaagatgccaccttcattagttccttaggaaatgcagattaaacccatgagatatgttttgcctttcatctgcatacattaaaaggattgataacatctggtgccagcaagggcatgcacttttggtgagagtataaatctggacaaatttggagcaaagattgcagcgctcattataattcaaaacttacatgggctttgaccaaggattttgatgtctacagatttacccttccccagcactctgcctgggtacagtggtgtgcacaaaattagggaccagcaagtccaatgtaagatgtaatggtggaaatatgcagttgtgcccatcagtaggggtctgatgaaaacaatgaggatctgtgggtaatatggaatgactgcattgagaaggatgaagcgggtctcttagcagacatgggaagatgactgtgttatgtcatcagaccaaaaggagcaagagcaagtgtaggaaaagacaaatctattagtctttaaaaactacaacaaggccagggacagtggctgatgcttgtaatcctagcactttgggaggccaaggtgggagaattgtttgaccccaaggagtttgagaccagcctgggcaacatagtgagacctcgtctctacaaataataataataataaaaaattagccgggtgtggtggtacatgcctgtagtgccagctgcttgggaagctgaggcgggaggatcgcttgatcccaggaggtcaaggctgcagtaagctgagattggaccactgcactccagcctgggtgacagagtgagaccctgtctcaaacaaaaacaaaaacaaaactacaagagttatatatacatacatatttacacatagacacacatacatgtatacatgcatatgcacacagacgtacatgtgtatatctaaaatgatcttcaggaatgcacagcagaccattagggtagccacctcttgtgggaagaggggtggcagatcttcatatttttattctagattttcataatcatgtacaaatttaaaattaattttttgttgacaaaaccaggcagtaaggagaggcctacatagggttgcatttggtaggcttctcttcacatactcttctttctcattccctgtgtatctgacacatcctttcagaggggcctgactgtggagtgatgtttcttcactgcctgctcatctcctgtgactttcttgcgttcccttctgagccttaccaccttcgtgggatgggtgtccctggctgaaggtgtacctctgccatgttcccctcctccagtaccttggaaagtcccagtgtgtccctgagcagcgtgtctccgaggggactgtctggaactctcatccccacaataggaagggtttttcagtcatgggggaacactgcgttcctgtctgacctcctggggttcctcatttacgtggtcggtgagctgttgagaggcttcaggaagtcaggagtgaggaggcctgcctagctctgtgaatgcagctttcctaagtttctctggccatggaaccactttcccagaatgcctgttgacatcttcgtgctccaccaagatgttgggaagtgcggctctttccctggttcccacttggactttctccttaaatctttgcagccctgggatttccagctggttccatgcccatccatagcccacatagcctctcagtctgccttggccccttctcctacctcggccctcaacccattcaaacaacagacctggtcacctctgaaatttggtgttaactccagggattgattgctcactggggagcaggggctagatccagcccacagtggtgcttgacggggtcacccatgtttaaaaacacaacttgagccaatattgggctcttggaagatacttagagatctggtttcttattccataatccatgtgcctgtgaaaatgggaaaaagaaactttgacagggatagccatatgtttcaggaaaaaaaaaagggagagcctctttttcagactagtcctccacgtttaaaatgtgagagagcttgtttgcaccttccacaccggcccgtcctactcatttatgtgagtggtgcggggacatgctggcttagagtttgccgcccatgcttgaagctcctcggtgccggcaccttggtacaggccctagttcttttgacctagaaagctttttttttgtttgtttccagccatttcctttttttaatttacagtttgcgttcagtgcaaacccatagcatgagacattactatgaatcaaaatgtaaatacacaaacacaatatagaatccaaaacagaggtgcagctttcaggaatgaagcagaagacaggttcattcacatgcacagtagcttcagggctgtgtgatctggttgttcccatgtagcttcctaaagatggaaaaaaatgattttggtcatcaagactactgtggccatattagatactggaaccgtagaaagttcttcataagagctttccagcaggtctgtgcgttcccagtttcttcaccccccagtctctcctctgtgtgctgtaattatttttctaaaacacagaccgcattttgttgtggattactcctcattgctcaaggatccagtccagttcccagcagggcactccacagccccggccctgtaggtcttccagccaccccagccaggaagccagtgctccagttaagtcagcagacttgccggaagcctttgtgcctttgcagatgcagctgtctgccagatgccctttcttctcatctgttggaaccatgccttgtcccctcccctgaaacctgtcaaccttgccgctgctgaattccttatctggcttctctgcctttgcagcccttggctgttacagcacttcctacgtataattgtgattccctccggagccatctctctgtagattggaagcagttaatttcccttaatctttttttctccccccagccccatactagagacactctcccatgggtagtgcataaatatttgttgcatgacaatttagtctttaatttctcacttttatgacattattgctttgtgatatcttctactttcatgataggatgggtaaattgcagggagaggaactgtaaatacggatgcttaattcttcctgctttcaatttttttctcttaagttaaatgtgctttttgttgctccacctctctgattggagcctcacattgggagcctgaggcagtggaatatcaaaagagggtagccgttgaatgtttattttcaatgtcagccgtgaaacctaccacttcgaatagtggggcctggaattcaggctcaaagtcttttccccatatttgtttccccctttggcctctcttttgcttgaagctgtgtactagactctcattaactttaacaagaattacagatgtgccctcagggggcctctcacactgcctttatttgctgtaattttaatgaattccacccgtagaagtgtaagaataaaagaggatatacttgagcaaagggaaagagagggttattacacattgtacctttttttaaaaaaattgcagagtaatgtcagctattcttccatttgtctcctttggttgccagtgaaaaataattttggctgcttattttccaaagcagaaactgaagtcaaacacgaacctttcctagacaaaaattcactcataatcatttttgagagtcgatatgtaccttatgcaaagtgctgggaataaaaagatgaatttattcccataaatatgtacacctactatgtacccagaaaaatttaaaataaaaatttttaaaaagatagatgtattaacaggtacttatatagcatttaatatgttgcagacatagttttaaattgtgtcagttatttgtttctgcatcatagaacaccttaaaacttaagtgactgaaaacaaccaccattcacttgctcgtagttttttgggtcagcaggttgggctgagctcagctagggggttcttctgctggtcttgggatgcctcattctactgaagtcgtcatctggttattcatttggagccagatggtctacagtggtttcacatatctggcagttggtgctggctgttggctgggacacttatctccagcactctagctcaaacatgcttaagtgacagcaatatatatatatatatatatattttttttttttttttttgagacagagtcttgctctgttgcccaggctagagtgctgtggcacaatcttggctcactgcaatctccacctcccgagttcaagcaattctcctgcctcagcctcctgagtagctgggattacaggtgtgtgccagcacgcccagctaatttttgtatttttttttttcagtcgagatggggtttcaccatgttaatcaggctgatctcaaactcctgacctcgtgatccacctgcctcggcttcccaaagtgctgggattataggtgtgagccaccgcgcttggccatgacagcaatattttaagagagcgggaggagaggctgtaaggtcttttgagacctaggcttggaaggtgcaaagagtctgttgtaaactcttggccaaagccagtcaaaaggccagcccagattcaaaagatggaaaactagattccacctcttcttatttttaaatgggccacaaaaattctctataaagactgacttatttaatgcttacaacaacttgaggtggttgaggtaggttcctctattattcccactgttcagatgaggaaggtgaggcatagcagagaggttaagtaacttgctcagggtcacacagcttggggcaatacaccatggtaagtcctttggaagttgctgctcattatttttgccttacagccactataggaccaacttattatttctctgcagccttgcagagaaagaggtcactcacatttgccgtgcagctgccatgtgttggaagcttcatatatgtagtaccactaaaccgtcacaactagtctgaaatggagatattattattcccagtattcaggtgaggaaactgaggctgatggaaattaagtacaagtcatacaaggggatgataacccactgttccatatgcaagagtttgttttccctaagtaaacaataaatgtgctggggcagattttttgttttttgttttttaaaaaatcttctgcttgcatctaggaagtgttaagaaaaaaaaatctgttgatttgtttatgacaacccatacatttcagaaaagtagctggaataataaacatgtttttcagttgtccagtggagccccaaaatagaagcaagatgaatattccattccgcattggcaatgccaaaggagatgatgctttagaaaaaagatttcttgataaagctcttgaactcaatatgttgtccttgaaagggcataggtgagtacatctgcaatgcacgagcttggcaaagaattagcttagtttttcaaatgcagaataaaacaaatctataggagcctgcttagcttggagtagcagttatgtaatttgttgggccaacccagctgttataaggatgtgccttcttcctgttgtttatggaaccctttgcataattccccagctgagagtataatggagctccatcttccatgagggttttggcaaaattacctttgaaaatctcttacactgctcgtatagcacagaggttgccattccatctctgatgaggccagcaccactctgttctggaggtagagaatcattattattccaactgaacatcaaattagtagctagtcttgcatgctctatgaaaaataaatgtcctcacatgagaatagcagcagggaatgtcctcacatgagaatagcccagccccgatcttgctggcactgtcacgacaggctcatgaatgttgaacagaatcgctatcttcttccaacttaccttttcttccccacatcttgcttgctttctttgccaagagtgaatagttcgaatgactctaaatgtgagcatggtgaaccttcacagcttaagggagaattttctgatgactgagacgtgtgaagctctgtgccaggtgtcgggagtttttaggtaggagaccggaaatgatggtctcaggtgctgcaactctcaggagccagtggctagaaaaaggtgttttgatgcgaaattagacgtttttgttctcaatgcctggatctttggtcattctaggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaagcccttgtcaatgaatttctctacctgctttttagacaaattgttctttatgatgggaaagcttgaggtctaaaaatagcacctgctaagggtaatttagttcaaccaaagatctaagacttaattcttgtgcatccatttaaaaaaattcaacacggtgtgggagctttccatttgcttttggaatgggcattatcagcaaaccaccttccattgcagctgaaggtgtaaagttctttttttttagatggaggctcgctttgtcgcccaggctggagagtgtggtggcgcaatctcgactcactgaaacctcccctcccaggttcaagcaattctcctgcctcagcctcccgtgtagctgggactacaggtgccagccaccatgcatggctaatttttgtatttttagtagagacggggtttcaccatgttggtcaggctggtctcgaactcccgaccttaggtgatccgcccacctcagcctcccaaagtgctgggattacaggcgtgagccaccgtgcccagctctgaaggtgtaaagttctatgagctttgtcccatttgccccagaaacatgccactaggactgttttgagctatcttcctggtttatttgattgcataatgaggactccaccagtgtcttgtcccatctctgcactggttagttggctcccctgttcaggtcacaggctccaaggcttggttctgtcatctgtaacaggagggttgaaataactcccccaccacttaccttaaggatgtttaaaagtttaaaacaagggctcgatgcaggatgtgaataataaccacaatgaagttttaagtagcaaaagccaggcagtccatggattccaactaagtgttcacacataaaagtcatgctcagagtcagcctcccctccttcctcaccctttcatatgtggttgcacatccctgtcatctgtatcagacctgtgcttctcaaatatctgctaattttcattccattgccatgtcagctctgctatgtcagccctcagtggattattcagcagtctcttctctgc

SEQ ID NO: 15563 - DNA, 58356 bp, Human
agattttaacttagtcaaaacatgctttagagtcaccaaaggagaatgatgtctaacagtgctgatttgggagttgggcaccctgagtgttggttgggctttaaaaacttcatgctaaacttcaggggaagtctcctcccctctctcttcagttgtcttccgagatgaaccctattactaattacttgaccacctttcaaagttgcagttaaaattcttcacatttttctcccatttctatttaattaattattttttttttgagacagggtctctctgttgcccaggctggagtacagtggcgtgatctagtctcaccgcaacctccgcctcccgggttcaagcgattctcagactcccgaatagctggggttacaagtgtgcgccatcacacccggctaatttttgtatttttagtagatacggggtttcatcatgttggccaggctggtctcgaacaactgacctcaagtgatctgcccgccccggcctcccgaagtgctgggattacaggcgtgagccactgcgcccgccccccatttctattttaattaaattttatttaggataggcttagcttaaatttttacgactgaggtctgacttaagatgatagcatcaaccatggagttttctttcgtgaacattattattactaagcccaattttcccaggtcaaattttgtaaaacaaaacgtggtcaaaatttgattctctgatcgattttttgtaaaaaagaaaaaaattaccgtgtagttttaaatgttgtcaattaaattttgtaatagttacctctactctgttcaggttaatactgaggttttcaacaagaccaacatacgattcttttttttttttttttttttttttttggtggggttgaggggacataacagttttttcactcttgttaaattaattttctgttgattccatctatccttaatcttcattatgagcaacataccaggttttcttctgaagatcatatgtggtagtgaggcaataatgcaaagacataggatggcagggggattccggcttctttctttcttcccctcctgtggaaagagggtctataacactccgtagtagataggacaattctaattatgaagggtaattagctaggctctgctacaaccgagagccctgagagattcctcgacgctggctgcttttctcttcctctccaccagaggcgacagcctctttccaaacagaaactgggttggaataggccggtccgggggaacggccagaagaaagatcaaaggttaaaaaccgcctcaaagagcacaggtcaatacccaactcctaaggaggccttaagctttcatctgccacgaaacatgaaggtgactcctcccaatatcaaggccggggggccactcagccttccagagacccggcgggtccgaggcgagtaacaggtaacacctgctgagccgccgccgaccggaagtggaagagagcccgggacgggggtgaggacaggccgcggcacgcctgcgcagtcagcaggagttgcagcgctcatgcgcagctgggcggtgacagggtgacgctcggagcgtgggccgcgactctcacggatccggttccgccctctcgctgccgatccttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggtaatcatctggggtggggttcacgataacgctgcgcttttactcattccccccaccaccaccgtgcacccccaaagtgctcgggcctctcctcatcgcacgcactcgccagggagtccagggagctagttttcctggcttacgaacctcgtccgctgtctccctaaaagggtcaagaacccgatagaaaggttgggggaactagtttcccaccttgttaaacacgtcccataaatgtcccttagtcgagctttttttttttttaaccgtcttttaaggtggaaacggcaaaatcctctttcagtgattcccatgtttttttttttttaattcttaattctactgggcctcttgttccaattagaacagtttccgatcgcctagttccttaaaaacctctcactacgttcagaggttgcctcttttttctggatgaatcattttcctgcactttagaggacgtacggatttcgtcactaccccctgaagaggcctttgaggctggttgcctcgttttataattaccgagagctttctctttccagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtaagaacccggtgcatataggcgatccgctgagggaagcacggaatggggaagtgggtagaggcaggtaatgagaccagctgaatccgggtcttggtgttttagttacctgggttccctatagctggtggtttcctgtaagtcagtcatctcaattactgagtaaatttcagtttgccaacttatttcattgtattacactgctccatttcgcttccgtcattctcactcttcccgaggctttcatttgcagttatgcgtgcaggtcatctttgatccctacgcggaagggttggctgctgccttttttacggcggcacttctgatgtacttaggtttgtccagtgaagtggatttgaaggtgccgaagcgacccggcagtgtcagttcgagttgctattggagctggcttgggaaatggctgctcttttgttgtgtttttgttccaacatgtcttcctcctccgcttagaaaatggcggaacgacgtgactcaaccccatattcctgcccttttctcagcttgagttcacaaattatgcttccttgattcctcctttagcagccccgagtggattaaacctttgaaaagccaagaataaagctgcaggaggcggtgtggaggttcgaggaaggagatggcatagtgacagtgtttgtgatctctgcagcagatgtgacacgaaattgttgaattacactatgtaaaatccttcgtagttcttttaaaagtgttaattactctttcttttcgtgaatggtcatatttggcacgtttcagtcgggactaaatttgtataggtagtggcaaaggcagtttgagcagcaccaactatgttaaaatttactcatatcagttgtatttaaaaaaatcttaatcacttagccacactttgataagtaattttaacctgttgagtttgtcagtaaatcttcacatcagagaaattggggcctttgttggtgtggaatattggtgagtgcaaatagcagtaacgaggataaaagatgacgagatagacattgttctgtcaaatggttaactttactttggagggttttaatgttttaacttttgggattaaagatcctcttcatggaatggagactaaaatatagtttaaagcccagctattttccagcaataatctaaaataacatttgcaaaattattcagaataggtaagaatggtacttactgtttactggagcctcttctttaagacggagttttcgctcttgtggtccaggctggagtgcaatgaatggcacgatcttggctcactgcaacctctgcctcccgggttcaagtgattctcgtgcctcagcctcctgagtagctgggattacaggcgcccgccaccacgcctagctaatttttgtattttagtttcaccacgttggccaggctgggctcgaactcctgacctcaggtgatctgcctgcctcggcctcccaaagtgctgggattacaggcatgagccactgtgcccggcttttttttcttttgaaacggagccttactctgttgcccaggctagagtgcagtggcgcaaccttggctaactgcagcctccgcctcccaggttcaagtgatcctcctgcctcagcctcccaagtagctggaattgcagagctgcactactacgcctggctaatttttgtatttttagtagagctgaggttttgccgtgttggccaggctggtctccacctcctgacctcaggtgatccacctgcctcagcctcccaaagtgctgggattataggcgtgagccaccgggcccagcctgttagcccctttttctattccagtttgtatttttcatgtcttgaattaaggactgggttgcatagtctttacatggaaacaactcaaataaaactgtccttaaaaagagttccagccaggcgtggtggctcacgcctgtaatccaagcactttgggaggccaaggcaggcaggttactttaagtcaggagttcaacaccagcctggccaacatggtgaaacctcgtctctactaaaaatacaaaaattagctgagcatggtggcacgtgcctgtaatcccagctactcgggaggctgaagcaggagaatagcttgaacccgggagtcggaggttgcagtaagctgagatggcgccactgcactccagcctggtgacagagcgagacgccatctcaaaaaaacacaaaaaaacacaacaaaaaaaaaaacaaagttccaatgctgatttacagttttaatggagaattgagtgataaaatgtgctattggttgtaaatgagcaagtaaatcatttggaagaaagttgcaaatttatcttatgaggtgaagattaaatctgagatgatatagatttgaagtttttaaatcattcttgcctttaaaaaaaaaacctactatgtgggaaaataaggcccctcacccctgatttgctttccattactatagtttttcctagaatttcatataaatggaatcatacgatatgaggtcatttgtgtctggcacttttcacttaacataatgtttttgagattcatctatgttgggagattttataaatttcacaaatcaggttaaatttaatgtatttgaaatcagtttcaaaaagcattaagcattgtcatttttcagtgctaaacccaagtacagtacatgtccttttatctggtagcttttatttaagacctgatacagacccataagggcaatgagtaatgtactgaataagcacatgaataaattaacttctgagcagaattatagtaataggtgcctattataaggtggtgagtgcagagagagttatggtagttataagctgtctgtgggtgaggctaaacagattaacctgactttcaagttaaggcttcctgagagatgggatttcaggatctggctctaaggaagaaagcttggtgaactggtttggtaaggcatccaagaatagagtgtggcttctgggtgtagtctctaaaggagaacacagtaattggatgagagtgtggaaagggtaaatttgctttaggagtggtagggtcaggtacatggaaacaaaagtggttcattggttttaaagtgaaatgtaaaaaaaaaactgtttccactgaagcaaaaaggataaagatttatgtaaacattctttatttgggtagcagcatcttcccatccccctcagtttgttccccactatttctgtatcacctatacatggtacatacttaataaatatttactcggaaagtattgaattaagttgactatttagtgttagctagataaaagttatgtgttatctattgttttagaagtattgtcactaatttaaaaaatttagattttgctgcctttatccttcatatacaaatttgttcaatcccttccctatgttttctgttacaaaattccctataggatttgctttttttttttttgacatggagtctcactctgttaccaggctggagtgcagtggtacagtcttggctcactgcagcctccacctcctgggttcaagcaattctcctgccttagcctcctgagtagctgggactacaggcacgtgctgccacgcccagctaatttttgtatttttaatagagatggggctttaccattttggccaggatggtctccatctcttgacctcgtgatctgctcgcctcggcctctcaaagtgcttggattacaggcatgagccaccgcacccagccaggattttctttaagatactttggtatatcttacaacagagactgaaaattacctggcctgcgtagatgacctgctgaatcaggtccttcctgtgtaatttgagagacctattgttaagaagcatagcatcctgagtaaagagcaaggataagccgggcgccatggctcacgcctgtaatcccagcactttgggaggccgaggtgggcagattgcctgagcccaggagttggagaccagcctgggtagtagagacaggtgaaaccctgtctctactaaaatacaaaaaaaaaaaaaattagcctggtgtggtggcgtgcgcctgtagtgccagctactcaggaggctgaggcaggagaattgcttgaacatgggaggcggaggttgcagtgagccaagatcgtgccactgcactccagcctgggcgacagaatgaggctccgtatcaaaaaaaaaaaagcaaggataagagaatggcatccattttcttgatattttaagaaatgaagcttccggttctaggcacttggagagccgcggcttaaggtacagacatggccaagtccacgaaccacaccacacacaaccagtcctgaaaatggcacagaaatggtgggctccaggttcctgaggaacatgcactttgccaagaagcacaagaagggcctaaagaagatgcaggccaacaatgccaaggcaatgagtgcacttgctgaggctagcagggccctcgtaaagcccaaggaggttaagcccaagatcccaaagggtgtcagctgcgaactcgattgacttgcctacattgtccaccccaagcttgggaagtgtgcttgtgtccgcattgccaaggggctcagactgtgtgggccaaaggccaaggatcaaccaaggcccaggctgcagctccagcttcagttccagctcaggctcctcccaaaggctctcaggcccctacaaaggcttcggagtaggtatctctgtctgccaacgtgaggacagaaggactgatgcaacccccctgggctgccgtctttatggggctggggtcctcctgtgctattagtacaaataaacctgaggcaggggaaaaaaaaagaaagaaaattcttggaccttgtcaattaatatgtgagagctcacttaaaattacagttgacccttgaacagtgctggggttaggggcactgaaccccagcccactcccactgtgccccacagtcaggaatccaagtgtaactttttttttttttttgagatggagtcttgctctgtcacccaggctggagtgcaatggtgtgatcttggctcactgcaacctctgcctcccaggttcatgggattacaggcgcgccgccacacccagctaatttttgtatttttagtagagacggggtttcacagtgatggccaggctagtctcaaactcctgacctcagatgatccacccacctcggcccgccaaagtgctgggattacaggcatggaccactgcacctggccccaagtataacttgactccccaaaagcttaactactactagcctactgttcactggaagcttcaccaataacatgattggtcaataactatatatatatatatatatatatatataaagctctttaccctcatcatcctcactttgggctgaggaggaagaagaggggttgatcttgtttgggtagcagaggcagaaaaaaacctgtgtacaagtggacctgtgcatttcaagccccttttgttcaagggtcagctgtattgagtttctgttaaaacctttttttgtgtgttccattctaaattgaattaagttctccaaaggaacaatttaaaaatttttttaaattttttttatatagatgggctcttgctatattgcccagactggtcttgcattcctgagctcaagtacttctcctgcctcagcctcccaaagcgctgggattataggcatcagccaccgtgcaatgacccaagaaacaactatgacataccgaaaaattctttatctagataggttttggaggtttgagctgtagatctgccatgtgatattgactgggtcatctacagtcagtcagttccttaatgtgtgtaagcccatctgtttcctcatttagaacataaaaaaaggattgttctaatgggaaggagagtgctgaatagaaagatttagggctgcctacccttcttttgccagctaaatactcatttccatttgcctttgcatactgagcttttgggtagggttttgtttgaacaagggttccctacttaaaagtgtcactggcctcattgatcctaaggacttttagtcctggaattttaagacctattttcaaaggatagtagctagaaaaaaagcattccagcagtttgatattgtgtctactacttgccttcctttcttgtttttcctatttttctttcatcttttattatttttatttttagcggcaggttcttgctctgtcacccgggcggagtgcagtggctattcagaagtatgataatagcacactacagcctcaaactcctggactcaaatgatcctcctgcctcttagcctcctgagtagctaggactgcagatgaataccacctctcccagctgcctagtgtgttttaatcactatttttgccctctgtgtctgaaggtcaaatgttttagaacgtatttataaagcactagttaatccttactcttcacttttaaaagcagcttaatcttatctttggcactgagcatatatcctgtgaataacataatggctgttatcagagaataaagatgacgctgcattggatatgtcttcattaagatatattacagtgtccatgcttagcttggactaaaaaaaaaaaaccagaaaaacgtacgtcacagatcacgagaaatgtgctttttaacttgaagggaaactgaattcatggtatactagagctgctttatactggcttatgagataatgtaataatgctaggtagcattttaagctggacaaaatgttagagatgtatatagccctattcctactaatacaaattagactgttgaatctcaggggagttactggagtgtcctaacttccagttcttctgagaatcattatcacccttatgtcaaggtcaaatcatgccctctcacacactccacatcgtttcatttgatactggagagccatcctgtacttcttcacttgttggcattttgcctcatagacaagctgaagagctcttacataaatataagtaacctatttgtatttaattagatgcttacgattcagggtgttcttattctcccttttgaatctgtggattgcaggataaaaacttgctggaaattattaatttgtggccaggcgcagtggttcacacctgtaatcccagcactttgggaggccaagacgggcggatcacctgaggtcaggagttcgaaaccaggctggccaacatggtgaaaccccatctctactgaaatacaaaaattagccaagcatggtggtgtgtgcctgtagtcccagctacttgggaggctgagtcaggagaattgcttgagcccgggaggcagaggttgcagtgagctgagatcatgccactgcactccagcctgggtgacagagcgagcctctgtctcaaaaaaaaaaaaaaaaaaaaatatatatatatatatatatacatatatatatatatatatatatatatatatacatatatatatatatatatatatatatatatatatatatatatatataaatttgtatctcatttcggagtaaatgcttgaacccatgtaaagtatgtgggttattccttggctttagtcagtggtccccagcctttttggcaccagggacaggtttcgtggaagacagtttttccacagactggagcaagtagggggtggggtgggggtgggaatgattttgagatgattcaagtgcattacatttattgtgcactttatttctattattattacattgtaacatataatgaaataattatacaactcaccttgatgtagaatcaatgggagccctgggcttgctttcctgcaactacctgcttccatctgggggtcatgggagacagtaacagatcgtcaggcattagattctcataaggaatgcacaacctagatccctctgatgtgcagttcacagcagggtttgcgttcctatgagaatctaattctgttgatctgacaggaggctgagctcaggcggtaatgccagctttggggagtggctgtaaatacagatgaagcttcacttcgcttctatactggataccggtcagtggcccagggatcaaggatccttggctttagtcatttctggacctagatctttttttttttttttttttttttttgagatgcagtctttctctgttgcccaggctgggatgcaatggcgtgatcttgactcactgcaacctccacttcccaggttcaagtgattctcctgcctcagcctcctgagtagctaggactacaggcatataccaccatgcctggctaattttttttagtagagatgaggtttcaccatattggtcaggctggtctcgaactcctgacctcaagtgatccacctgcctcggcctcccaaagtgctgggattacaggcgtgagccaccgcacctggctagatcattttgttttaaagtatatttaagctgtacctaaaatatcattaagtcttggttttctcatgatctgtcactgttcaccagggatttttgctgtcaagaatgagtgtcttcataactttcatcatttaacttggtgttcagtgtatgcacacaggtaaaatgatgctttattgtgttactgtttttgtttctaatttcaatctcagatggctcttaaaattttggttgactggccgggtgtggtagctcatgccacacctgtaatcccagcactttgggaggccaaggcgggcggatcacttgaaatcaggagtttgacaccagcctggccaacatggtgaaatcctgtctctactaaaaatacaaaaattagctggccatggtggcaggtgcctgcaatcccagctactcgggaggctgagacaggagaattgcttgatcccaggagacggaggttgcagtgagctgagatcacgccactgcactctggcctgggtgacagatggagactccatctcaaaaaaaaaaaacaaaattggttgaccagtattaacatagcataaactaatgcatgttttagtgggatttttatttttaattttattttttgagatgcagtcttgctctgttgcccaggccagagtgcagtggcgcaatcttggctcactgcaacctccgcctcctgggttcaagtgattctccttgctcagcctctggagtagctgggactacaggtgcccgccaccatacccggctaattttttttgtatttttgtagaaatggggtttcaccgtattggccaggctggtcttggactcctgactttgtgatccgcccatctcgacctcccaaagtgctgggattacaggtgtgagccaccataccctgccggatcagttttgacaaatgcatatgttggtgtaacctacatctctgttgagataaggactatttgattttttttttgtatgcacacattgctcatccttggtaagttctattctgtgacagtgttagttttattttatttatttattttttaagtctgtcttttggattacagctaagccttatttttctccccagtccccagttaagcattattttggtgttggttttactatagattaatagtctgtttatcaccatgaggtacattataggatttatctgacaaaattatcagatggtggttgtgttgcaggtgatggtagtaaatatggtattcagtgataattgagatctttaccttgctctcctttgaagaactaaaatactgcctttttcttgtcggtgtgagcagtggggtatgttatggccctttaatggggattttggaagtgctacacaaaacggtttagctgaagagagtacatttcaatcctcaacataaagggaaatggaaagagcattgtattatgagtcagggttctgcctgtgatgccatctagatttgaacctattaatagaatgaattctataatttgtaaagtcagttcttacttgtaaaagggttttcgaaagcccaacaaggtcttaagggttttttaatgtgtagtatatattgatggaatcagtaggacaaaagatgcctcttgttctctgatgtaatgatttgttctaattttaaggtataattgccttttatttatttgtaatgttgataagtacttttgaaataagggaataattggttgaattcagtgtggctaaacattcttttttccctctgcatgcaacaaaaagagtccaatattatccaggcattgcatacggtctcatttaatcattacaccaatcttgtaagttggtgtttcttataaagtatgtgagtcaaagtggttaatttgcctaaagtcacacagctgatgtgtgatttgtacaggtcctactgcatctttcagctctaccagtggttctcaaattttgctgcaaatggaatcaaatggcaaagttaaaaaaaaaagacaactaatccctaactgcaagtattttgatttaattaaattgggatatgacgtaggtatcatgatttttaaaagctccccaggtgattctgatatgtaacaattaataattgttattaatccccaaaatatagtatattaataattaataacaataatttttgctttgctactcacccccatcaacccccatcttttcctagaattacaacctaataaggctatactcttttctttcttttttttttttttaagagttgggttcttgctcggccgcctaggcctggagtatagtggctcaatcatagcttactgcagccttgaactcctgggctccagtgatcctcctatctcagccttctaagtagctgagactacaggcatacaccaccatacttggctaatttttatttttattttttagaaatagagtctcactgtgttgctcaggctgtaaggctgtgttcttaatttatatatttcctcttagaattaattcaggaaatcctgtaataggcatcatgatactggaaagtaccagaaagtacatataatcccatgtaatcaaatgctttgatttctggaaagtgtctaaaatcgatgtatgaaaccatttacctcttcacatgtttcagatgcattcctacaataatgcattctagaaactccttgaaggagagaactgtcttactcatagaggtatcttgtgtttcttattgtgccaagtacaataatgaaattctacttttattatatatctatatacatttaattttttctttttctttttttttttttgagacggagtttcgctcttgttgcccaagctggagtgcaatggcacaatctcggctcaccgcaacatccgcctcctgggttcaagtgatcctcctgcctcagcctcctgagtagctgggattacaggcatgcgccatcacactcggctaattttgtatttttagtagagacggggtttctccttgttggccaggctggtctcgaactcctggtctcaagtgatccagctgccttggcctcccaaagtgctgggattacagatgtgagccgctgtgcccagccattcactgttaggttgagtttggttttgtgtttggctgtttgcccttgattgaaattattaccaccaagctgtacttacagaaatcctagtgttcccatttttgaacctccataatattattttttatccctcttagagaagtgagtgttgttagcttctattcttcaaacgagagctctgatagtttgagactctcttggtgaatttaacatacaacaccttgtacagtacgttgaagagaacaaccatttctttcattcagttgacattcacctgagggtacctaccctgtgccagtcacagtttaagaaactggacagccgggcgcggtggctcatgcctgtaatcccagcacattgggtggccgaggcgggcggatcacctgaggtcgggagttcgagaccagcctgaccaacatggagaaaccccgtctctactaaaaatacaaaattagctgggcgtggtggcacatgcctgtaatcccagctactagggaggctgaggcaggagaatcgcttgaacctgggaggcggaggttgcagtgagccaggatcgcgccattgcactccagcccgggcaacaagagcgaaactccgtctcaaaaaaaaaaaaaaaaaaaaaaaaactgggcacacttcattgaacagacaatgattttgtgaggcttgcattctttttgagcatctgctgtgagcctggcatgtaattgtgaatttgtctcctgctgaaaattaggaaggatgtctaaatctcaaactatgtgaggacataaatgtttacttaagagggtagcatattgagatgagccccaaacagtaccctgaaacatttagagattgccttagttaattgcaacagtaggaccccgttaagactattcatgtgtatccttctaagtcagcatttttccaacctcagctgtgtataaataattaccacttatagagtttgtaaaaaattcaggttacactgctctaccatcagatttttgtttgaccagttctggagtggggaccaagagttattttttttctttgttttgttttgtttgtttttaatgtaattaccacaaggaatttctactaaagaccagagaaccacactgagaaattctgtgctgaggttttggcactccattgtatcaagctgttgagggtagttagtgaattttgctgagtgctatggctgttgtaggaaatggtattgtcttggttgttggcattttatcattgttggtcaactgttttttgtttgtttttcactagagatggagtctcactctgtcgctcaggctggagtacagtggcacgatctcggctcactgcaacctctgcctcctgggttcaagcgattctcctgcctcagctccctgagtagctgggattacaggcgcccactactgcacccggctaatttttgtatttttagtagagatggggtttcaccatgttggccaggctggtctcaaactcctgacctcaagtgatccacctgcctcagcctcccaaagtactgggattacaggtgtgagccactgcacctggccaggcgactgctttttgtaataagaataataatcccttatttatgtaatgctttgtaatttatcaagtgcttttacataaactctcataattaccacaacaccttttgataaataaatagggttatattaagaatctttgaccagtgagcagaaatcacttacacagagtcacagagcaagaaaataacaagccaggactagaacctatgtttctggctgctggtccagtattcttggtactatgttacatatactgtcaacttagccagcttcccattcttaaacctaactgcagatttactggactactttttaatggtctggtcactgaaggacttacttttatgaatattacttagtgctgtattattcagggttgcacagacttgatagctattcatgtatttgaatagccatcttttctttctttgaggttgtatcattcctttctggtagcttgtgttgcttcttccattttccttttcccctttgctgtatgtttgcagcccaggcattgtgtcctttcttctgtatttgctacgtaaaacaaacatatcaaactttggaatgttcattgttttctttttgtattcattttctccactaatgaagataatttaattttgcctttttgtatcgtttttgtctacagtttcttatctagaatacttagctctatccatttaaagaggattttctaagcaaattaattaatgcaaagtagggggaagtgttcccttcatccagttatttgttctcttagtatcttcatacagaaacattgtctgtaatacaagtgctaacttatagtgcaaaaattaccctaaagaaaaccatttgaggctgggcacggtggctcactcctgtaatcctagcactttgggaggccgaggtgggcgaatcacctgaggttggttgttccagaccagcctgaccaacatggagaaaccccatatctactaaaaatacaaaattagtcaggcgtggtggcgcgtgcctgtgataccagctactcaggaggctgaggcaggagaatcacttgaacccagaaggcagagattgtggtgagctgagatcatgccattgtattccagcctgggcaacgagagcaaaactctgtctcaaaaaaagaaagaaagccatttggtggctgggtgtggtagctcacccctgtaatctcagcacgttgggaggctgaggcgggtggatcacttgaggtcaggagtttgagaccagtccccccaacatggcaaaaccctgtctctactcaaaacacacagaaaaattagctgagtgtggcagcatgtgcctgtaatcccagctactcaggaggctgaggcaggagaatcgcttgaatctgggaggcagagaggttgcagtgagccgagattgtgccagtgcattccagtctgggcaacagtgagactccatttcaaaacaaaaacaaagaaacaaacaaaaagaaagccatttggtctcttaatagtgtattaggagatattttataggagtgtgtttgatttctttttttctttctgaaactttttaatgtacatgttatccctttttaaggagtggaggtaagtcacttgagccttaagaatttgaggtttgaattagggagttaggaagggggcccaattttagtattttacaagtatggtgggtggtaatggctttggacatgttgaaattaaggtgaatggcatattgtgttttactcttgtgtagtaaagttagcagcaaatacagaactgagcctaggccagggaactgggattggggttagatctaagcaagatcagcatgtaagtgatagtggagaaagtaaattgagaggtgaggactcatccccttggtggaaattcggaattaataaagcaggaggagagtcaggataatgggctgttgaataaagaaagtaagtttttaggaagaggtaatgtgtatccaagaagtaggaaagaaatgagacttaaagcgtttggggtttggctgtgttagagctcagtacccaacaggtgctcagtaaagtaacttgactcaatgattgggtctgaggataatccgaagagggagttaagtatatagaattgaaaggataagcagaggccatatttaggaattttttgatatatgaaactcttgcttttttagtaggtaaggggcttttttttttttttttttgggagacaaggtctcagtgtcacccaggatggagtacagtggctagcctcaacagccgaggctcaagtgatcctcctgcctcagcttcctggggagtacaggcgcatgccaccacgcctggctaattttttatttttcatagagagaccggggtctttgttggcctaggctaatctcgaaccacctgagctcaagtgatcctcccatcttgacctcccaaagtgttgggattacaggtgtgagctatcgcatggctcctttagtttttataacagagaaatgacacagtaaaaccatagaggggtaactggaactaggagaatatttaagaagctaatacaataatccaggcatctttcaaaatttagcccaggtgctaacatttttaggaagccttcttttttttttttttttttttttttttgagacagagtctcgctctgtcgccaggctggagtgcaatggcgccatctcagctcactgcaacccccgcctcccgggttcaagcaattcttctgcctcagcctcccgagagtagctgggactacaggcgtgcgccaccacgcccagctaatttttgtgtttttagtagagacggggtttcaccatgttggccaggatggtctcgatctctcttgaccttgtgattcgcctgccttggcctcccaaggtgctgggattacaggtgtgagccaccgcgcctggccagaagccttcttttttatcttctaagtaaattgcttattcctgtattttgtatttatggttgcctttatattacacttgtcatctaccagttcttcatcagctttattgatataatttacccacataaaggttaacctatttaagctgtacagtttgtttcttagtatatgtacaaagttgtacaaccattaccataattcaaatttagaatattttcctcatgccaaaaataaatcttgaacccattgtcagtcactccatttcccgtcagccctaggcaactactaatctgcttttatatatttgcctattagaaaacatttgatcaagcttttgtaatttgtgttatgaagactataagtacattttccacttcccaatgaaaaagtgtattttaacatttgtatctccctggaccttccagttctccacatgctgtccctcaataccaccactatcaatgttggagcagtgatgacaagagctgacaaaagttaggtcatttgtgattttttttttttttgcaactacgtccccgctcaattatttgtgatctttgaaataacactttgggtattacggggaaaataactatgttactgggaaccaagaaaaaatgagagtaagatgcaaatataaaccaggttttcaaaaaattacctgaagaagaaaataaggtgatcttacacactataccaacctatgctgtcacttagtttcttgtgagcaccagacttcagcctggtgccaatccaccccttaacctgggtctctgccatctgtcctttgagaatcaaccttacttcctcagagaaactttccctgatgcctcccttaaaaaaaaagatcagatccccataatttgtgcccccacaatagcactcttctctccttcatcatggtgtttatcacccttccccactataagccacgaaagcagcaattattttgttttgtcttgttagctactctaaatattgaatggataaatgaatagtaactttgataatgaacagtggtaaagttttttttgtttgtttttataatttttggagttaaggaacatctacatatctttgaaggcaaagggcaaggaacaaaggtggagaatatgaaaatgtacggtaattcaaggatcttgggggtaatgttgtaagcaaaggattagtagtaacaaggcagcaagaagagggaaaacaaatcatcttagttgactacgttattgctgagcaaaacatacatgattttcaaatattagatcttattctacaggctatttatctcaaaagttggtttggaacaggggctcttaacctggttcataaccatatccaccccccatgagatctatgtatttagacaggtaaggaaaattacatttttattttcatgagcttctcactcaaatctagtatttctttttgattttaagtgtaagtaggaaacctcatgagttttagcagaacctttgactttgtcaccaatagaaatcactgatttttgtggggggtagatggagttttgctcttatcgccaggctggagtgcaatggcgtgatcttggctcactgcatctcctgcctcccaggttcaagtgattctccttagcctcctgagtagctgggattacaggcgcccaacgccacgcccggctgatatttgcatatttagtagagatggggtttcaccatgttggccagagtggtctcaaactcctgacctcaggtgatccatctgcctcgacctcccaaagtgctagaattgcaggtgtgagccactgcacccagctagaaatcgcagattttttttttttttagactaagtctcactctgtggcccaggctggagtgcaacagtatgatctcagcatgagccactccgcccggctgaaatcacaggtattttatatcacattattgttgcaggtatcttaaaatatagtttacactcattactacatcaaaattatagcatttattagacctgctcctatatttaatgcattaataagcagagtgtagggctgggcactgtggctcacaccagtaatcccaacattttaggaggccaaggcaggcggatcacgtgaggccaggagttcaaaatcagcctggccaacatggtgaaaccctgtctctactaaaaatacaaaaatcagccaggagtggtcgcatatgcctgtaatcccaacaggtggatgaggcatgagaatctcttgaacctgggaggcagagactgtagtgaaccaagatcacaccattgcactccagcctgggcgacacagtgagatcctgtctcaaaaaataataataataaggagagtatgtatattactatatcccaaattccttttttttttttttgagatggagtcttgctgtcacccaggcttgagtgcagtggcataagctcggcccactgcagcgtctgcctcctgagtagctgggattacaggtccccaccaccatgtgcggctattgttttttgtttttttttttttgtatttttagtagagacagggttttgccatgttggctaggctggtctcgaactcctgacctccagcgatccacccacctcagcctcccaaagtgctgggattacaggcttgagccactgcacctggctcaaaattgattttttttctttttcttttctttctttcttttttttttgagacagagttttgttcttgttgcccaggcaggagtgcaatagcgtgatctcggctcactgcaacctcggcctcccgggttcaagcaattttcctgcctcagccttccaagtagctggattacaggcatgttaattttgtatttttattagagatgggatttctccatgttggttaggctggtctcgaattgccgacctcaggtgatccgccctccttggcctcccaaagtgctgggattacaggcatgagccactgtgcctggccccaaaattgattgtttagaagtaattttatgctagttcaatttcgctataattgattttctttataatgccttgtattttatgcatttaaaacattctgagaagagatgtatggggagaagaggtatctggttttgagaatacatctgtgtataatgaatggcaaatagctgttaagaatggcatatacaaatatgaatgtataggaaaattgaaaggattttagagaaaagggaacagagtagctgaaactttttttttttgtttatgtgttcttttttttttttttttttttttttgagacagagtctcgctttgtcatccaggctggagtgcaatggcgagatctcagctcatggcaacctctgctgcctgggttcaagcaattctcctgtctcagcctcctgagtaggtgggactataggcgcccaccaccatgcccagctaatttttgtatttttagtagagacggggtttcaccatattggtcagactggtctcgaactcctggcctcatgatccgcccgcctcggcttcccagagtgctgggattacaggcgtgagccaccgcgcctggcctgagtagctggaactgttagcagtagtatcctaaagagacaatttgagttagttcttacggttcagcaagatcttgctaggccaaattccttttctgctcccattaaaaaggagcataaaggttggataatgatgggctggcaagagactaagtttgagagacagtatcttcaggatatcttgtaggtgctattaaaattggatatattatagcactgattcagtgttgatactttttagttgttcactgaagactctgacattaataaccgaaagattggcaaacgactttttaacttttataattatttggcttatttgaactagggataaatagatgcttcctgatgtcttcacttggagtgcagggagtgtttttgcatttcttgttttgttttccttatctgccaaatcaagcactccctacactgttacagcttctaatatgagttttcattattttactcagcaaatgttttgagcatctcttgtgtatgctgggaatacagattgtgaacaagacaaatataatgattgcccctaattaagttaatagtctgaaggggaagatctacattaaatttttttttttactgttattttgtcctggtcatggtgatggaactaacatatatttgggtaaagtgcatattacaataattacactgatttattctggaatattctgggtctcatagtaatacttaaatatttttatatgaaaaatatgtattttttttctcaaatactcccattttcatgaagacatttttcagaaaaaagcaaacccctagcttgaaatctccggctatagtataacacttcctaattggtaaccatgtcattgtcattccttcccctggtcctccatttccatattgtatactgatgccaaggctaataattactgattttaattatgtctcagccacaaactgtagtaatagttcacccaattatttacagcatgtaaagctcataagccttgcactgaagaacctatactgcagcttcaatctatctgccaccttgactcttccctttatgacagcccatgccccaaaatggtttgcccctgcctggtaagcccttttctgccttacttatcaaaacactgttcatccttcaggatctgactggtagcagactattttcctaatacctctttagacagatttagttctcattgatcttttgtgtgaatcatgttagcattttttgtcagcctcattgacttttgcatgtattgtcttacatttgtgctttttgtgtatgtcttaatttttaaattggatttaatttggatatgcgtttagaggaaaggacataagagcagagagatagaccttgccttctcttggcattatcttcagaccttagatactttttttatgctgtaagtaagtaataatggttgtgtaaattatgaactcattcttcagcctagttttaggtaacactgaagtctaaaggtatagatttgaaacaaatggaaaatgagatccccgaacattttatctttttaaaattattattttcactttcacccattaaattacttgattttttttaatgtttcgtaacttaggaagaataaggtccaaatcaactggaatactttttttagtctcataattacctgagtacctgcaatatgcacatcactttaccactgtacacttagtagcaacacgtcttgtacttaaaaatgtctaaaggtaagacctgtgtttctagtttgaaggcctagaaagtaaatgagtgaggtttttgtgttggtgtttcagactataaacttaaatggcctcagagaatcgggttagtgcttgttcatgactcaggttctgtgaaaaggctattcaaataaaaataaagctgtaagctctatcctaccaggtatagagacaaacaccaaagttacagtagatgagtattgtcaaggggttaagactgtggacacaagcaatagttaatggctttgggaattctaggaaataggagaccaatgtgggataggtgacattaggaagatttctttggcatctgggttttaaggttgggattgaaggtagagaaaagctctcagaatagacgtgggaagcatggaggtgaaggtagaaactaagaataagtaagattggaataagcagaagaccatttctggttctgaatctgtgtgtgataatgtctgaatgagttagtccagatggaagagcacagatggagggtgtgacgttctagctttagagaattaagctatatattccttgagaccaaaggaagtgtgaaagatgtaaacacctgtctcttaggtttaaggagttatagtaccagtccatagaaaagaaagtcctagctgttttagaactgcatggttgctccacaaggtaaaatgcctttgagacgcttatttttttttagctattttcaaggaagtatttaatcctcctgactttgagaatagtgaatatgtcttgtgttcataaatttaagcaaggatgaagaatgcccaataatgtgtgtgtgttttaagtgtgcttctcaattcatctaattcttcccagtttctaactattaagggagttagaggcttacatgcaggtgattttgttagaggcttactttgcagatgatttctttatgaaatcatgttaattgcatgaaaatataaagtctgaatttgtgccttttacatttcaggtttgtgtttgggcttagatggatggttataacatttgcttgttttttgtagttttacatctgagccatcagtggaaacctgtctagagctgagacttggtcttataaataagagttgatttatgccttcccttttgcctatttgactttttgcgccttcttacttccttagctctttctggatttggtgttctcgttttcttaaaagcctaggtaaattatatttatattaaacaagtgttgaacgtttgtaatggtaggttcgtgacagatctctagtccagatttgcctatcacataaaaaggaagagggaaaataacaaaagaaaataaaatgaggaaaagggaaaggagaacccagcttatttgctttatcacttaccttttaatactgttatttatgtattacccaaagcatcactgtgagcttctttcaagtaaatgtttcagcgaatgtgaaaggtgttgaattcccatagggagaataaagagtggaagagggaaaataacagcagctttagtatgctgttttaagcaataaggacaaaactggctcttctggccgggtgtggtggctcaaacctgtaatcccaggactttgggaggccaagaggtggatcagctgaggtcaggaattcgagaccagcctggccaacattgtgaaacgccgtcactactaaaaatacaaaaattagctgggcgtggtggcaggcgcctataatcccagctacttgggaggctgaggcatgagaagcacttgaacctgggaggcagaggttgcagtgagccaagatcgcaccactgcactcgagcctgtcggacagagcaagagactgtgtctcaaaaaaaaaaaaatggctcttttgctgtcacgttgacacatttgtttcctagcctagtgggcaagacctctagaaagttaagcagaacttttcccttactgggttatctttttctgcaaagaggatgtggaaatggatttgattttgtgtgcttggcagttatccatgtgtcaggtttgggaagtagttctcaagaacaactgaagcaaaagtcgtaggaaggaactgaactttttggcttataatcctcttaggatctcttactctcaacataagattctagggagcatatttattatacctgactatgagacctatctgaatagatctgaaattaaagctgactgatttgaggctcccccccctttctcaggtgctatgcctgaaatttctgcagttttggtagatgccatcaagggttaatgggtgcccaggaccactagttagaatagactcttttcttaaagaagagccacaagagtagcacatctgtatagttatctttgcattttctagaaaaatattcttaaaagattaaatcctcatactctagttttaatattgattttcttgaatcattggcatttatcagcaaagcaggaaatggcactaaacagtttcctacttgactgatacttgttataattttgacacagattttagttttcttaaaaagctggtgaggtacagtggttcaacttgtaatcccagtgctttgggaggctgaggcaggaggatcgcttgagtccagaagttagagactagcctgggcaacgtagggagactctgcctttacaagaaatttgaaagaccatgtctctaccaaaaacttttttaaaatttagctgggcatgatggcacgcctgtggtcccagctacttgggaagctgaaataggaggattgcttgagaccagaaggtcaaaggctgcaggagttgtgatttgccactgcaccccagcctggcaacagagcgagaccttgtctaaaaataaatgaataaataaataaatagataaataaggaggaaggaagggaaaggaagaaaagcctgttctccccttttgaatatttttaaaacataagctttccagatatggtaaattttgggattggttcttattggagttaacaaagaaatgactgcagtttaagctttaaaataactttttaaacaaaattttaagtatcacctgattttcttagcagaatttaatatctagaaaagtttgaaagaaaagtggtagtgcttattttaaggaaagtactcttaccagaatcataggcatcaaaatttgaaataatttattgcagtgattttcagtccttgggataaatgaaattggcagatgatacttcttattagggacacattgtatacagtaatacagcccaggataattaaaacatgattccagttaaaagcaaataaatgtcattaccttgtgttatatgggttattttctgtgatctgaagccaaggaaaaatgtgactcctttttgaataaggacaagtaattattgattaaatgcaatttggtaggaactggaatcgaagttcagataaaagaaatctttgctttctgaaacattttggaatgactgatagagtcatcttcatttcttcagttacaaagtaaattcaggtgagattaaggaatttggtaaaggccataggaatcagtggccagtgggtataaaattcagctgccctggtaacaggagtgttaaggctactatgcatgtcctatctatataggagaatggagttgcatgacagggaaaaaaaaaagtctcattacccttgttttgtctttgggccttgtagttaattagtgggtttgtcttctgagtaggggaacattcgccttatataatacctagtcagtgaaagaaaactatattattcttagggttgatgatattaagtaatagctttttgtaatatcctctcttctccttttgtttcgttaggtggtatggtcaggaaaaagactacaatgtactagtcatggatcttctgggacctagcctcgaagacctcttcaatttctgttcaagaaggttcacaatgaaaactgtacttatgttagctgaccaggtatgtgaaattttgattagaatataaactgagactagtactgttgactggaatttcattattcataaatcagagtattaaaatcctgtgcatcactatttaaccttagcataggcagaaaaaaaataataatgtgacttgtagatattttcctatgggaataagacaaaacctggaattatcttggtttcttactcatctgtagactagtagttttcaatctgctccttcagatgaagttttagtgtcatatgtagcaggttattgtaagattttgtttggagagtttagagtgtatgtatgcatataattgttgataaatgtttattgacattttggttaaattaagcaaaattgaatattatgtattatgtgtgggactcttagaaaagctatatttttgaggataaaaaggtcctgaagtaatataaggaagaattttttgaccaagtagatgctgcttggagtaatggattctcaaccatttgtgttacttaagacctaggaaattttggtgatgtcatgaattagattgatgcattggctgtaggttagattaaatggtttttacagccaaagtttggatatttcgatcttaagaaatgagaaagatgagtaaggaacaaaccttaagggaaaagataatacattaaggtaatgattggtaaatatcaagacatgtataattttttgttttgatcagtatttgttacctttaagggcaggaaaatgctggaaatgctttaagttaaactcagtgtgcttataaaaatactatgaagagaatgacatttaaaaatataatggagggtttgtgacagctctctagtccagatttgcctatcacataaaaaggaagagggaaaataacagaagaaaataaaatgaggaaaagggaaaggagaacacaggttatttgttttatcacttacctttatttactttatcacttaccttttaatactattatttatgtattacccaaagcatcactgtgagcttctttcaagtaaatgtcataaagtaaaatgagataaacagacatggtatttgaggtggaattttagtaagtttgtaaattcagagggatgaagagaagtaggttaatgggcacaaaaatacagttaggaggaataagttctagtattacatagtatagtagggaaattatagttaacaatagcttatcgtttatttcaaaatagctagaagagtagaattgtaatgttcctaacacaaaatataaatgtttgaagtaatggatatcccaactaccctgatttgataattacacattgtatacatgtaacaaaatatcacacataccccataaatatatacaactattatagatcaatgaaaaaactttgtctataattccaaggattagaaagtagtgcccattttctgtaatcagcacctgatactccccaagcttcttaaccttaaaagtactcagtggctcaagcaaatgtgagcaaattgtgatatttgtggcacaaaacaaactcaagcattaaaaggttaaaagtggcgcggcacactggctcacgcctgtaatccagcactttgggagaccaagacacgaggatctcttgagcccaggagttccaggctacagtgagctataataatgccactgcactccagcctgagcaatagagcaaagaccccatctcttttatgttaacagcctttaatgtgggctgggtttggtggctcatgcctacagtcccagcacttttgagaggccaaggccggtaaatcacctgaggtcaggagttcgagaccagcctggccaacatagtgaaacccatctctactaaaagtacaaaaattagccaggcgtggtggctgacacctgtaatcccagctacccgggaggctgaggcatgagaatcacatgaacccaggaggtggagattgcagtgagccgagatcgcaccactgcactccagcctgggggatagaacgagactctgtctcaaaaaaaaaaaaaaagcctttaatatgttttaactaacatatatgagtgaatcctaataaaagagttatggcttatgtttttgtttgttcagtaacacgtaagcatccatacattgaacatgtattgagagcctaccactgtacttagtgctgggggttggggtggcaaaaaaataagaattagtctcttccctctagaaagaaacttagagtctaataaagaaagatggaaaaataagatgttccatccttgttgtagagttgtagaagtctctgttgggtacacgggtaacaaatgtgaaaaaatataattctgaggaagggagatacaagaaagctttcatttaaggtagttgacacctaagtcttgctctgtggttgacaggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaacttctaagtaagtgtcttatagaaaagatagaggctgggtgtgatggctcatgccagcaatcccagcactttgggaggcagaagcaggaggatcacttgagctcaggagttcgagagcagcctgggcaacataacgatacccccctttccacaaaaaatacaaaaattagctgggcatggtaacgcgcatgtccgtagttccagcttctcagggggctgagctgagaggatcacttgagccccggaagttgaagctgctgtgagccgtgatctcgtcactgcaccccagccagggtgacaaagtgagactctgtctcaaaaaaaacaaaaaaacacagaacttctattgtatacaagaaatgccataagcagtcaaaataaaaaataatttaaatttgtttacataatgacagataaaagattgtttgttttatgacgagaactcctaaaagctaacaagaagacaataggccgaaagaaaaataggcaaagagtggagcttgacagtacatagaagagtaaatcctcatagaagggccaggcgcagtggctcacgcctgtaatcccagctctttgggaggccgaggcaggtggatcattttaggccaggagctggaaaccaacatggtgaaaccctgtctctactaaaaataaaaaaaagtacccaggcatgtggcgggtgcctgtaatcccaactactcgggaggctgaggcaagagaatcgcttgaacccaggaggcagaggttgcagtgagccaaaattgcaccactgcactccagcctgggcagcagagtgagtgagactctgtctcaaaaaaaaaaaaaaatcctcatggaaggattacttctaaatcgaggccgggcatggtggttcacacctgtaatcctaccacattgggaggtcgaggcaggaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaaaaaaaaaaaaaaaaaagaagagtaaatccaaattgttacagcctattgtggaaggcagtgtgatattatctatcaaaatgaaaaatacacccttcaactcagcaactccccataattatatgggatttgaagcccatagaaataaaagcactagtgggtaaagatacatgtctattaatggcattatttatagtaggaaaaagtggaaaacaatgtgagaatactgtgagttggggaagacataacatctctaccacagaatatttgtagccattaaaaaggatatttgagctatagcgtttgactttgcataatttccaagaaattaaggaaagcttttaagaatggcatgtttaatatttaacttttggaatgagattatataagaattataacaactacttatagcttaatctgccaatctgtcaacatcctccactcccaagtatatgtgtatctgtttgtgtgcatatgtatatcttataacatggaattaggtctgggtaatacaaggccattttaacaggttactttagaaggcctaggattgagtgtggaaagtttttattttatttcctttattgtagcaactgaaactattatacaggtattccttttattatttgaaaatcacaaacaccaagtcttcctatggggttagaccctgccatggttttaattattaatactagaaggtaaagccaaaggacacagcaggtatatgcttagatatccattaacctagaaataaatggagaacttagttgtcctttccatttcattttctttagcgctgtctttgtgaactctaaataattgagatactgaaatacttaagaaatgtgttgattttcatttactacttaactcaattatctctcccttcttttttttccagatgatcagtagaattgaatatgtgcatacaaagaattttatacacagagacattaaaccagataacttcctaatgggtattgggcgtcactgtaataaggttagtcaaatgctctttgcatgaaagaacaaagagtaaagtttcgacaagaattgctttggtaaacttttcaatcttttaaaaagccatagtaagttgaatttgctgttgacagttgctttaaaagattgtgctatgaggataatcagctaactccattaacttagtaacttgaaataaattatcttcaacttacccaaccgaggttagttacctatatggaaatataaaattctaagggctgtataatgaactgtagttgtctaagttatttaactgttgaacagttgtatctatttttcattcacaaaaatagcaaaaacccccatattcttttcttcctgaatgcttaaaaccagattttaacctttggctctgaagtgtgggtttttataatatatgtgcttgtgccagtgtgggaacactgacttatctgtcaccatggtgttaacatttgctgactgagcatggttgataatgagaattcttcagtccttgaatttgtgtatttaaaagggtaacttttgggcctgcttcaaaagtagttgacagttttttacttgggtgccaaattgggtgagttctccacccctccctctccctttaaaggaaaatgtagacaagtgaaatgaacattcatacaacaaaactagtgttcatttggggtctctgagagtggttcaacttatggggtgattgggttttagctagtggcgcatgattgcagttagaaactaattgtgttgactttttttctgtaatgattagtcttactgagtgaattgctttctttatcgatactatgttgagctcgggcagacaggcagcattggcaatgcactaagcatgttgtgatctgatgatctatctgatagaaattctcaacttcaggacaacttgggggctttttttgtttttttgtggcttttttgttttgtttttggaaggaagatgcccatttgttttactaaactattaggaaatgtttggtgtttttaggtctagctataaatgtttacctttgtttgcctgtatgaatgccaactgggagacattaccattagaattggtgttatttgtcaatgtgagatactgatgttggtctgattaggttttaggaaattaaatttttttgttgagctttaaataatgaaaggtgtttaaatatacacataacttatcttgtcattcccaagttgcattaaaaaatattttatagcttttctctgaagtatccaggtttttattactgtaaagcctggtaattcaattgaaaaaaaaattactggtcttaagttttggggcagttttgtccatttgactccaatcttcttggccatttcccagccctctccttcctgttttcttaccccctaaaaacccattatcaccatgtgattcctattctgcatcgttgacattgcagtacgtggtttttgccttaaatttaaatgatgacctagatatcactttgccttccccccctcccccacaacccccttaagaatagcttgttaatcgcatagttgtcttaaggaagtgtaagttatctagtggtgaaaacctttttaggaggtttaggtctccttttctccttgagatattaaaaataattttgtggagctgcttgctgcttaacactgttttagagaggccatggggaagaagcaaagtgttttactcaactaagattcaaatgctaaatgttgctcttgaacattttagattagtgttttgtttatgtagttgatttttagtgttttctgtattgtagtttgaaaaatgccagttgtatgagactggattctttggtcagcttgttccagtagttttctattcatggggaaaaaaaggttttggggggcttttgaggacaatttttaaagttaaatttcttatttggaaaattgttctgaatttgatatttaggagtggcactccaatcttagtgaatttgctcatctcttccagtaatcagccctgcatgcttacgaaaataaattttaaggtgactaaatgccttctacctcttccttactgaagatttttttcccccgtacaatatttttttgggggggaagggcagattgtggtaccaaagattgcagatctaaattccccatttttgattaaaaatataaaagagccaaatgtcaccattgctatccctgtttcaggcagtgacacaaaatagtggcattaaaaacctgagtaatttccagaattcaaatgttcttgagcatgtgattcttatttggaaaactgagaagctacagtgcttggtggaagaaggatggcatttggctaccctgttctttctctaatgcctcggtgttgcctgtctgcgccggccattgttgcaatgtaagcaatactgtttgatgcactgccaccctctattgtctgtttagtgtttagaatctccagtggggaagaggaaaagaagcatgactgttagtacttctcaggacccatctttctcaggattaaaccaggtctgaaactgtctcctattccaacctcaatcccaaattcatgtgcttttcttttttattgttttattttgatgatttttgttttgttttaattctggagaatgtagatcttgctcaagcacctcttacgttggcattattcagacatacttggcaaacataacattactaagatatttctttgtggcttttgcttaaaacttataaagtttagaaaaaagctaaatgaaaataggatattatgtttagctctctaacatacatatgaggaaatgatgttggtctagtactgaaattgtttacctaatagtaaacttgagatagatcgttagtttttaaaaatttatttggagttacacaacttaatgcacgaaatatatttaaattcagttcattagtgctgtataatgaatatattctacctcacctctcttccccttccctaaggaacttcaggtaagtgtagatcagatttcagatctagtgtttctagaacttatttcctcagtctgtattctcaacttctagcaaatggatatttacagagcattataggctctggaactagaagatactgcattcttaacaatataacaataacatagcttaagcacttatcaagttatatggtagattaccattagtaatacattgaaatatattaaatttagtttttggcaggctggataaacaccctactaattttctaaatttgtaagtagaactcttcatattttgttacacttttgttgaagttaaatagcttttttatcacaaaatttaagttcataaatgttcatgctcctgagcaaatgaatcttaatcattcagtttagtatacagtgaagaggaagtattggcatgaataatcaaaaaacaaaaaacatgctttgtaataccttaaattatccacatgtatcatctggataatcatttaacccttttccatactgcccagctttattccaggaaccacctccagctattaaaaaaggtttcagaaattcagagttatttttattcaggcaaagaagtaccaagtattgtgactagttagataaggggtggggggaagacagtagatggtggatcattaggcatattataagaataaaactagttttatagtgcctcatttttacttacccattcacatattttgcttacatttcgtagcatcatttaataatttacaaagaaagttgtattacattgtttagattttgtacatacaggttagctaggtttttagtaaagtgaccttgtgaatgttttagaagggcaagggaaattatgacccctggttaggaaaaaaaaaaaaatgctgcaagtactaaacactaagattagccacagtgattttgaagaaaatgtgcctctattgaatggaattatggaattatccccctactttttttggtttttggttttattttttgttttttttggggggtttttttgttttgttttgagacggggtttcactctgttgcccaggcaggagtgtagagtgcagtggtgcgatcttggcccactgcaacttccacctcccaggttcaagcaattctgtctcagcctcccgaatagctgggattacaggtatgcgccaccatgcccggctaatttttgtatttttagtggagatggggttttaccatgttggccagactggtcttgaactcctgacctcaagtgatccacctgccttggcctcccaaaatgctggcgttataggcatgagccactgcacctggtcaaattatcccctatttatcaactcagttccctgtgcctttgaagaataggctgcattgtttaaaatgggcgcagattttactcataacatgtagttagtaaaaatccacagaaaaggagcttgattcactgaaggaagtgcctgtgtctttgcacataaaagcctatagtaaaaatgcattatcttacgcttatttgatactgacttttcctcatttggttctgcctttacatatttacagctttttggttgtatctttggcatcatgtggtttcatgtaaacatttccattatatgtttatatttattagttttaaacagcaaagcatacagagagagctactaaagaagcttgataggtacccgaaggtaatgaaccaccaatagttttatttccttttttaatttcaagtagttttcctttcagttgtttactgagaataggctatctttgttcagtactaacatttttttcctgatgtattttcagtttttataagaggagaacatttcaaattatttgctctttagatttttgtttttagattgagatgtttaagaagatcgtgtttacatatttgtagtttacttgataaataaggtttcctcctttagcgttgtgggaggaaagaactctccagcgaacactgaatttttataaagcagtcttttggttgtgagaaagtgtctggttattgagtcacaaatgaagctattgaatgtaggtttagacatgaatgaaactgttagacatactcatgtcagagctcttcccttttgtccttcattttaaagtaccaaaggaagcaatcctagaaaatgtgaactggaggaaattctatgtactaatcactcttcattcaatgtctacatatttcttagagatattttttaaataccatgaagctgaatgtccttttgtgtttattttccccatgttttcttttcactatgaatctgcagaacttaatcatcacttttgttttgcttaacaaatgtattttgctcattttaatatttgtgtactgatctggttttcatatcaagagaaacttaaagtataagctttatttcttagtgttttacaacacaaattttcctgtaatgacttgattgcttaggaagggagtttaatctttttactttgagagtcttcatcatccagttaacatttactaataatttaatcttcattcttttatagtagactaagtaaaaatcagtatctcgttgacatggtgactgaagctcaactgtcagtgtctttactgtccaaagtataattgagaataggttataatgcttggctgaaatagatgttactcatgctcctaggagaggtactggtcagatctttataacctaaatcagtaacttgctttatttattgacatgaaatctgcaggttaggtgatcaagtttcccagcacatcacaaattataaactggcaaaagggacccagtagtctaatggagagaagaactacaaaatttaggagtaactagagaacaacagactagggctatatagtgtaagggcacatagacctgcctagcttaatatttgtagattaacttttattaaaatatagcataataggtgattttatgacaaaagccaaaattttaagtaaagattatttcttttcatatggtaggtaaatatgaatatgttttggatttctttttcataaaaatagttatttacttataaaaggcttaagttctggagtgtaaacttgaattacatacaacaattagctacattataaatgaataccttattccctgagtaccatatagacatgataacactaaacgttattttgttctaaacactagtttttgtttttagttagctcacttaaactgctaattgtaagccaccttgatttaaatgctaagcgctttttggggggatttttatatcaacttgttaaattttccagaagtttaacctgacccatttgtataatgtcagtgctaagtagtattttttattaataaaaagtcttggtttcattggcaatgtcagacttttagggtagataacaagtattctgttggcacatttaagaatggcctttgtaggagggaagagttcagatagtttatatctggattttttttttttttttaagaaagagttttgctctgtcacccaggctggagtgcagtgacgcggtcttggctcactgcaacctctgcctcccgggttcaagcgattctcctgcctcagcctcttgtgtagctgggactacaggcatgtgccaccatgcccggctatttttgtattttttgtagaggtgggactttgccatgtttggccaggctggtcttgaactcctgacctcaagttatccgcctgcctcagcctcccaaagtgctgggattataggcgtgagctaccgcgctcggccattatatctagattttgaaacctcatgtttgtttaccagtagtaacaggtgtacagactatcaggtgtcattatgacagatagcacacttgttgcttctgctgtcaagcatgtatacatttctttctttataaagacaggttcctgagtatgtaatgaaatgggcctgtgaaatctgcaaacgacaaggataaactactagactttttttttttaacttgatttattgatgaagactagtaaaagcttatgggggggtgttaagtctgttcattatctgttctattaatacttaggatactttattttgatatatttgaatgcatagaatagataccatttaatgaataagacgcagtttaattgaacaaggttggaaacctaatgtttctgtatttctcttttaaagttattccttattgattttggtttggccaaaaagtacagagacaacaggacaaggcaacacataccatacagagaagataaaaacctcactggcctgcccgatatgctagcatcatgcacatcttggtattgagcagaggtaagttcgaaaatggaatgtgcttatcatagccatagcagaagccatcaatgggtttttgaaatattttagtttcttacaatgtctaaggatgtttcttggctgaggatttgaaggatgcttattaatcattttacctgctgctttaaccagtgtagagaagaccgttaaatgaggtcttctggatttttgttgttgttgaaggttgtctcttggggggaaaatactgcgtgatagaaagttagaagcataagtgcaatgttgacgtttctttttgcagctgaagatagtacatatatttttagagctatttggggctttttatactttagtaattcacgctgagtttgggaagaatgcattatttatttttaaaaggaaaatgttatcagtgtcctaataaaccaaaagtgggttgatggaccatctcctgttatacttcactcaaatatataaattaataggatctagtttaaagtaaaaaaagtaacagtctctgctctcttcctatttcttcacatgagttctagagtttcgagttcctttcatcttttacagtcactttttgctccttaaaactagcatagaagtaataagtagaaaaaacaatgatatgcctccaggttaaagaacctcataccaagaatttcaggcttaagaaatatccatgaatatctgaatgatctaggttaaactgtaatgtcactttttctgtacgccaaggcattacctatccttaaatatatatatatctaaatatatatttgtatgtatgtgtatatagatatgtatgcatgaatacattcatatagatgttcaattagttttaagttgtaactccttttcagtacttctgaagtttttttttaatgagtttctgcaaaacatagaaatgtcatcctgcttggttcattaagctcatttagagggttgtttagccaaatcgtttctgttcttttaaaattaaattgtaagacagttgtttgtcagattttggattccatggaaaaagttttgtttagaggtaggtaacacatgaactttttaaaatcaccttaaataagtagcttcttgcgtaagacaccaaatagtgttccctcctcatttgggaacatttcttctgggtacttgactttctttcatatgttttttcataataatagttccagtttataaaattacgttctcttttctagtcgccgagatgacatggaatcattaggatatgttttgatgtattttaatagaaccagcctgccatggcaagggctaaaggtaaaccagactcacattatcagatttttctctctcttttttagaataaaaatatatattggagaagataagatttaaggtcccttctaagtctgagatttttctgagatataaagaattaaccttaatttactttttaccttttatctgggaaaatgaaaccagatcattttagtaagaacttagttcagctgaagaacagtgtcctctaagagacagtaagctggtacccactggtagccactagctctatctagatggaagtgggcatggactaagaaaggtggagactttctcattttgatgtgttgccattatgttgaaaatgtatgtttttatgtacagcaagacctgtttatccagcaatacatgtcctaacattttgtttctattagctaggagtttactgttacttttgtgagtgtatgttaatgataaatcaccgtatcctaattttgggtgggggtgggggcatggggaatggtcttgctctgttgcccaagccggaatgcctggctcactgcagcctgaacctcctgggctcaagcagtcctcctatctcagcctcctacctgtagctgggactacaggaacatgccaccatgcccagctaatttttaaattattttttgtagagacagtgcctcactgtgttgcccagactggtctcaaactcttgggctcaagtgattctcctgcttcagcatcccaaagaactgggattacaggtgtgagtcaccactgttggtgtgtcctaaattttaatggctattttggtaccttaccagttctttgaaggaatacctgtatttattgagtggctgtgagctagttgtagtgctcagtccttgggtgggtagctttatctaatatgagtatttttagtttagaaaaatattgtgacttatacagttaactccatttattaatgtcactaattgatgaacaaatttttttgtattaatctgatgcctttgcccttgtgttgaacatgggttaagaaaatgcttttcaggctgagcatggtggctcatgcctataatcttcaacactttgggaggcccagccaggcggatcacttgagcccaggagttcaagaccagcctggtcagtatggcaagacctcacctctactttaaaaaaaaaaaatagcagggtgtagtgtcacatgcctgtagccccaattactcaggaggctgagccgggaggattgctttgagcccaggagttcgaggctacagcgagctataatcgagccactgcactccagcctgggcaaccgagggagaccttgtctcaaaaaaacaaacaaacaaacaaaaaaacaaagaaaaggaaaaaggaaagaaaatgcttttcagctgggtatgatgatgcacacctgtagtcccagctacttgataggctgaatcaggaggattgcttgaggccaggagttggaggccacagggaattactgctgagcctgtgaatggctactgcactccagcctgggcaacatagtgagaccccatctccttaaaaaaatatatagaaagaaagaaaatgcttttcaattttggccccagccatttttacttaaatctaatatccatatattcctattagactcaccctttccctatagctaaaattaaattcttagagaagaaacttacatcagaagttaacagtttgggaaaaattttttttagatgtattatactttgattttttaaattctgggttaaaatttctcttgaatctcacaggtatatgtttatatgtctagtgcgttaaactaccatggttcttctcagtagcactgagtatatcttttttattttattcttttccacaggctgcaacaaagaaacaaaaatatgaaaagattagtgaaaagaagatgtccacgcctgttgaagttttatgtaaggtaagtatgcatgatgaatattaaaaaaatataaatgaagccaggcacaatggctcacacctgtaatcccagcactttgggaggccaaggcagtaggtcacatgagcccaggagttcaagaccagcctgggcaacatagggaaaccccatttctaccttaatagataaatgatccggctgggcacagtggctcaagcctgcaatcccagcactttagaaggccgaggtgggcggatcacttgagcccagaagttccacaagaccagcctgggcaacatggtgaaataccttatctaccaaaaatacaaaaattagctgggtgcagtgatacacgtctgtggtcccagctactcaggagcctgaggcaggaggatcacttgagcccgggaggctccaattgcagtggtgaatcttggctgtcttacaaggatctgagattgtgccactgcactccagcctaggtaacagagtaagactctgtctcaaatgagtgaatgaatgaatgatccaggaagaaaaaggaacattttatttgccagctctggaacttgtaacattgaattaggtagctattcaccattttaaatttacatttttattattctaaatatctttaacaaggacttttaacataggggtctttttaaataagtgttttgctaggcacagtggctcacagttgaggagccacttggtaggctgaaggagggtggatcgcttgagcccgggagttccagaccagtctaggcaacatggtgaaaccccatcgctacaaaaaatgcaaaaattagcctggcatggtgacgcatgcctgtaatctcagcttcttggggatgctggggcaggatgcttgagcccaggaggtcgaggctgcagtgagccaagattgcaccactgcagtccagcttgggtgacagagtgagaccctgtctcaacaacaacaaaaataagtaaaataataaaaaataagttaaataaacgttttaagtaagtaaaataagtgttttatgtttctggtttgttagggctctctaatctgttgaaaactaggggtaaataaacagggcaggtaaacattttcaatagaacctcattaatctataagaaaaagtaagaaatattctccttaccctaaactagtgctggaaaagaaaggttatcaacaattagtacattaaggaacagggaaacatgcagacagattggagcaatccaaaatagcagctgtccaacaatacaggaatacagaagacagtttgaatcacactcattttttctgaaattttcaacttcatagaaaggcaattgagtttagaatagagaggtatttgtgtcatgatgaataaccatgatctcatccataaaaagaaggccatatggtctttcagacaagaaagaattgtatacctgaaattaagtacaaagcagtatacaaataaatagttgagggaagaaatcagtgagagttaaaatagtaattataaagtggtgagattgttttcagtctcattgtcatactgtttaccattaacacgggccataaatgtatataaatgttgagttttagaaagatgtataatatgtattattttacatcttttaacatatgtatatgtttcaagtggtcacccaatttatatcggtgcaatcaataaaaaatgttgcaagcatttccattctatccttcctaactccaggacatgagaaatttctcataaggttgtagaaggagattgtaactttaactctacaatcataaggttgtagaaagagactgcctcctttaactttaccactctccacattggcatttactctaggagaggagatatagaggtttgtgctcttttaatattttgtatttccacattgctgattggggaaatccttttggtgactgatacctagagccttgaaaatgtttatacattgttgagaatctttcctaaggagctaaatggaaaaattctatgcccacagatgtacttagcagtattattaataatagagaaaaattagaatacatccaaatgttcaattataaagaacaagttaatgatgtatatactaggtagaatatcatgcaaccatttagaaacttctgaaggctgggcatggtggctcacacctgtaatcccagcactgtgggagaccaaggaggccaaggggggcagatctcttgagctcgggaatttgagaccatccttggcaatctgacaaaaccctgtctctactaaaaaatacaaaaaattagctgggcgtggtagctcgtgtctgtagtcccagctactcaggaagctgaggttggaggatcgcttgaagcctgggaggtggaggttgcagtaagctgagattacactactgcactccagcctgggagacagattgagaccctgtctttaaaaaaaaaaaaagttcacgaagaggcgcgactttgataaaatgacaggttttaacaagtgggctatgtaagttatttaagaacatagtactgtataggaaaagcactatatgggaagaacatatgtatttcttctactaatattgtacataatagggtaggtagggtcatgaaattttatttaaatttatgaggagaccaagccatcattttagctctcatatcttcctatgaaatggtaaaatatcccgcccaaaaatatctttttgcttatacttaaatgcatttatttttctatcttgaaatgtttgtttttaactttgttttaacccttgaacctataggggtttcctgcagaatttgcgatgtacttaaactattgtcgtgggctacgctttgaggaagccccagattacatgtatctgaggcagctattccgcattcttttcaggtcagtttttaaggtattttaagattataaactctgtgagggaaattggttaaatttacctaacaaattcattctgataaatactaaagtaaagcagatctagctaacatgaataaaaggtttcagaaactgatttatttgggactaatttggcatttttctatttgtagtgtaaataggtgattttagtttggagtggatagagagttgaatcatactcaaagtagaatgtaacttttccagaatagttataattcatattagatataagtggctgtcagtgccttctggaactctccaactttgtacagtaccaaataaaaagcaattaaaatatcacatagtcatggagtctgatcaagtggtagcagtcctaaactagggtagggttccttaggcacaacccagaactggtcttgaaaaaggggggggaatagattacatgtggctcaaactcttagttggaagagagtaagaattgaggtaatccgcccaggtacggtggctcacgcctgtaatcccagcactttgggaggccgaggcgggcagatcgcttgaggtcaggagttagagaccagcctgcccgacatggtgaagccccatctttactaaaaatacaaaaattagccgggtgaggtggtgctcacctttaatcccagcgactcgggaggctgaggcaggagaatctcttgaacctgggaagcggaggttgcagtcagctgagatccccccagtgcactccaacctgggtgacaatgaggctctgtctcaaaagagaaaaacaaagaattcaagtaatctgccaggtgcaatggctcacacctataatcctagcactttgggaggccgatgggggtggatcacctgaggccaggagctcgagaccagcctggccaacatggtgaaaccccgtctctgctacaaatacaaaaattagctgggtatggtggcaggcgcctgtaatcccagctactcaggaggccgaggcaggagaattgcttgaacctgcgagacggaggttgcagtgagccgagattgcaccactgcactccagcctgggcaacaagagcaaaacatggtctcaaaaaaaaaaagagagaattcaggtaatcttttaaccccagaaaagtgtcttccccaggtaccagtcagacatcttattcccaaacttccagttgaatatttactcttacttgtttttaggaagtacctcctcttatgagtattcccctagataactgacagcttgatttcatgtttcagttttcatgctgcctttttcatctataataagaaatattttagaagctgccacacttgaggaaatattcgttgtgtaaagaaatgctgtcactgtcttaaaaagttagtaggttatataactggactctgttattaaaggattaacataaaatattttatgtgttccaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcacatcttttctagtcacaaaaataattcttttatttgcagtttacgtatgatcttaatttcaaaacgatttctttgtttttggcttgatttttcacaatgttgcaaatatcaggctcccagggtttaatgtggaattgaagtctgcagccaggccttgcaaattgaaggtaactggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaataactcagctgggtgcagtggctcacgcctgttatcccagcactttgagaggctgaggcaagcagatcacttgaggccaggagttcgagagtctggccaacatggtggaaacccatctctacaaaaaatacaaaaattagccaggtgtggtggcgtgcacctatggtcccagctatttgggaggctgaggcaggagaattgcttgaacctgggaggtggaggttgcagtgagccaagattgtgccgctgcactccagcctgggtgacagagtgagactctgtctcaaaaaaaaaaaaaaaaggaactcatacagctcaatgattcattgatcccaataataaatcgttttaataatgatgaaaacatcctactggggttttcttgttaaaaactttaggacaggcgcagtggctcatgcctgttattccaacacatttgggaggctgaggtgggagaattgcttgaccctaggagttctagacttgcctgggccacatagtaagaccctgtcccagctccctccaacatcgtccccaacccccccccccccaaaaaaaaaaagcgccaggcgcagtagtgagtgcctgtgatcccagctgtgttgggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagcttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtattttaaaactccagaacgtcagaaatgtgtagcagaatgaattctgttataaggaagacaaaacaattcagtctgttttttaatgcagtttaggaatagtgtatacctcctatacttaaaattgtcatttatctttcccaactttaaatactcttttagtttctatagggaaggaagagttattacaggttttttttttttaattattctttaactttagatactgccaatctgatttaaaattctccaagcttaattctgtgcaacaaacagaaccacacaagcagccaggcactgtggctcactcctataatcccagcatttttgaggctagatgggaagatcacttgatctcaggattttgagaaccatccggacaacatagggagacctcatcgctattttaaataattttaaaaagaaaagaaaaaaaaaggccgggtgcggtggctcgcttctgtaatcccagcactttgggaggctgaggcgggcagatcgtgaggtcaggagattgagaccatcctggctgacacagtgaaaccctgtctttactaaaaatacaaaaaagtagctggggccgggcgcggtggctcatgcctgtaatcccagcagtttgggaggccgaggcgggcggatcacaaggtcaggatatccagaccatcttggctaacatggtgaaaccccgtctgtactaaaaatacaaaaaattagccgggcgtggtggcgggcgcctatagtcccagctacttgggaggctgaggcaggagaatggcgtgaacccaggaggcggagcttgcagtgagccaagatcgcgccactgcactccagcctgggcgacagagcaagactccatctcaaaaaaaaaaaaaaaaaaaattagctgggcgtagtggcgggtgcctgtagtcccagctacttgagaggctgaggcaggagaatggcgtgaacccaggagacggagcttgtagtgggcggagatcgcgccattgtactccagcctgggtgacagagcgagactccgtctcaaaaaaaaaaaaaaaaaaagaaaaaaagaaaaaaaaccccacaaccatgttataggaaaagttagtataaatgacatagcataattaatatattcaaaataacttttaaaaagttgtcttgtagcttgaagggatcctaaatatcaaaagcccatcacaaacttacaagccttactgctacgtaaatatccctttgaactagtttctggttctatttaaaaagtcgaaaactgttgaaattaatttacgaataagaacagatacacactttgtggggaggctgaggtggtaggatctcctgagcccaggagttttaagtccagcctgggcaacataacagcaagaccccatctcaaaaaaaaaaaagcatatcttttgtttatttttttaatagacaaagtctcactatgttgcccaggtttatttggaactcctggctttaagtgatcttcctgcctcagcctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttagggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtc

SEQ ID NO: 15564 - DNA, 7482 bp, Human
ccttccttaatcttttcccccttctaacctcttttgctggcctgtgctcccagagttcccagagtctgtctacacaactccctgtatgtccttggcctaggaattttttcctgtgtttctctaaccagctccttagaacctggaacttgtttccatggtctatacttcttttctctatttatccatctgtcttctgattgaaaaaaaaaattatttatttttgaaaatttttaaatttttatttatttatttatttatttaattttatttttgagatggagtcttgctctgtcgcccaggctggagtgcagtggcgcaatctcgcctcactgcaagctccgcctcctaggttcacaccattctcctgcctcagcctcctgagtagctgggactacaggcaccccctaccacgcccagctaattttttgtatttttagtagagacggtgtttcaccgtgttagccaggatggtctcgatctcctgacctcatgatccacccacctcagcctcccaaagtgctgggactacaggcgtgagccaccacacccagccatttttttttttttttttttttttttgagaaggagtttcactcttgttgcccaggctggagtgcaatggcatgatcttggctcactgtaacctccacctcccaggttcaagcgattctcctgcctcagcctcccaagtacccgggattataggcatgcaccaccacgcccagctaattttgtatttttagtagagacggggtttctccgtgttggttaggctggtctcaaactcccgacctcaggtgatccacccacctcggcctcccaaagtgctgggattacaggtgtgagccaccgcgcctggcttttatttaaaaaaaaaaatttgttttcaattttttgttgttattttttttgtgtttttttgagacggagtctcactctgtctcgcccaggatgaagtgcagtggcatgatctcagctcactgcagcctcccccgcctgggttcaagcgattctcctatctcagcctcctgagtagctgggactacaggcatatgccaccatgcacagctaatttttgtatttttagtagagaaaagaatttcaccatgttggccaggctggtctcaaacccctgacctcaggtgattcacctgcctcttcttcccaaagtgctgggattataggcgtgagccaccacgcctggccttaattttttttttttttttaaagaggtgggggtctcactatgttgactaggctggtcttgaacttctgccttcaagcaatgctcccatgtcagcctcccagagtcctaggattacaggcgtgagccactgtgctcagcctgaaaaaatatttactgaagccctctttatggtagatgccgggaaaatattgttagtttttgctagaccttgctgagatggcttgggtaggaaggcatcttagagactggttggggtgggagcagagcaaagggtttggagcctctgaagaggcttctggtcccttagactgaaaccatcttccatctttttttttttctttctttgttttgagatggagtttcgctcttgttgccgaggctgaagtgcagtggcacaatctcagctcactgcaacctctgcctcctgggttcaagtgattctcctgcctcagcctcctgagtagctgggattacaggcacctgccaccacacctggctaattttgtatttttagcagagatggggtttcaccatgttggccaggctgacctccagctggccaggctggtctcgaactcctgacctcaggggatctgcccacctcagcctcccaaagtgctgggattacaggcgtgagccaccgcgcccagttcatcttccatcttttcacctccactgcatagatgtgcctgttatatttctgagcccccttcccccagcattgaccttggggtggtgacagtagaaggctgaaaccaacatagctgaaacctctgcttctctcacctggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttgggaggccgaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcaggcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtaaggacagcaagcagatgagtggtttaggggttgtctgctcaagagcatgagggagcagacgatggatctgcttaagggagatagctagcaagttgtcagagtgttggtgcagaagtcctctgcataaaggtgggcattgaagcagtgggagagaatgaaattgccgatgggaaatggtgagaaaagcaggctgaaggggagtggaggagtcagcaatagggggtggtccagacatgcatgtctgggatgggccaagcaagctgggtgtcaccacttcatggtgatgggttattctttggctcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtacttggtaatgggttctatcttctttagctctttgggacattttcttggccctgactctacctggctaaaaaggcagtgttgtggaaccccagcttctgctcacaaagctggctttcttgaaccccactctccatcctcaggtgtttgacttcacctttagcccagaagagatgaagcagctaaatgccctgaacaaaaattggagatatattgtgcctatgcttacggtgaggatgtatcagcctcctagacttggggaatgtgagatttggggtgggattctggcccaggtgtgacctaaggcttgctggttgtgagaaggacacaatgttgtgggtgggattgctatgctggacatagtgccctcatttctctttattgagctcagggaagtagtatggctcagggataaggcatataacctgtgagtcccagtcctgcttcttgatatcttgtaacctagagcaagttattaaacttctccaagcctcagcttcctatgtgtaaaatgagcccagttcctgacatgtagtagattctcagtaaatgatatgaggagagcccagaaggcgttgttgacctcactcgagggattggggttgggagggaagtcggctgtacttagggaaataaatggttcctggcctcttgatctcagttcagactgcaaactcttaggggcaggggtagctacatatcaggctatgggtttggtgctagaatggtgttgatactgtggtgttctctgaggatggggatcccagccaatgccatctggcatagtgctgtacacaggtgagtttgtttaggaagatttggggaagatgcctggagtctttggaatggcaactcctgctgatggagtaatctatctgtctctctttccaggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccatattgcttgcttgtcttatttgcctggtcaggcctgagttggaggctgtttccctcagggatgacagacctcgggctgctggatgtgacctgcccttgaagcccaaatattcatatcctggttctggaggaacctgtgaggaggctgagtaattctgtatccttgcattaggcacgttgggaagtagcgccatctactggcacatcttaagcactgcatgcttccctggagtcttctcaagaatgcctcaaattggccacctcaggagtgagcgatcagggcaatgattgtccgttggtttcaaggcagtgctggacctgggccttaagtttccatccccctgtcctgaccagtgcctaggtttagtaatttgaagagtccaagcgacttacattaagaagttagggaatcctagcttgcaaaatcacaaaaggtggggacaggggctttctccatcagacactatagtcagtgtgcataggtgacctgcaggaggcaacagtcctgcccagaccttgtcactcggcccctaaggccctatcttatgcactttttattggtgggcaccagagaccactgataaacaggttttaggaaggtttatggcaaatctctctaacctccagtcacacgaaactctttactttcccaaaccattgctctttgttcaagaagtatttattgggtacttatgggttaggcatgatgctaagccctggggatatagctataaccaagacacataagtccctacagcctacttgaggagacagactaagtaattgcataattagtttaattacagtcggaagaagtgttatgagaagtgcagggcgagtagcctacttatttaatcagctaagatctgaaagatgaatagggattaattagttaaaggaggtaagagtgggaacagcattccatacaaattggacagcttagggaaaagtcttgaaactggaagacgctgctggaaaagcctaaagaagacttgtaggacagcaactaaaagtaagggggacctggtggtagaggcgatggcataaaacaatgctggcattggtaggaactgatgattggaaggcctaaaagactgttgagatttctattatttattttttgaattgaggtctctgtcaccgaggctgtagtatacaaaaattttaaatttttatagagattaggtctccttatgttgcccaggctgttttttgtttgtttgttttgtgatggagtctcgctctgtcacccaggctggagtgcagtggcgccatctcggctcactgcaacctccgcctccttggttcaagcgattctcctgcctcagcctcctgagtagctgggattacaagtccccgccatgacacctggctaattttttgtatttttggtagggatggggtttccccgtgttggccaggctggtcttgaactcctgacctcaagtgatctgcccgcctcagcctcccaaagtactgggattataggcgtcagccctcccaggctgattttgaactcctaggttcaagactcctaaattcttggcctcccaaagtgttgggattacacgtgtgagccactacacccagccgcttccaaatctttgtgaacagtgctgcaacaaacatggaagtgtagatctctctgatacactcatttcctttcttttgggcatatactcagcagtgagattgctggatcatatcgtagctctatttttagttttttgagaaacctctaaaatgttctccatagtggttgcactaatttacattcccaccaacagtgtttgagggttctcttttctccacatcctctccagcatttgttattgcccgtcttttggataaaagccgtttgaactggggtgagatgatatctcattgtagctttaacttgcatttttctgatgatccgtgatgttgagcaccttttcatatgcctgttttccatttgtatgtcttcttttgagaaatgtctattcaaatgttttgtgtattt

SEQ ID NO: 15565 - DNA, 15632 bp, Human
caaaggtaaaatttaaattatgtagaatgaataagttccagagatctaatgtacaccatggtgacgatcattaataatactgtactgtatacttgaaatcttctgagagtaaatcttaagtgttttcaccacacacacaaaaattctaactggccaggtgtggtggctcacccctggaatcccagcaatttgggaggccaaggtgggaaaattacttgagtccaggagttcaagaccagcctgtgcaacatagtgagaactcctttctctaaaacaaaacaaaacagaaagtatgtgaagagatgaatatgataattatcttgactaataatcaacatcaagttgtatatcttaaatatataaaatttttaaaatagtaaagaaaatataatcatcattctcagtaatctatttcctctagttttcttcataatttaccactttctgaaattacattacacatttgttcatttcttcctccattagaacatatgccctacgagaacaaaaatttggtctgttttagtaaccactgtattcttacaacacttaagatatagcctggcatatagtaaacagcctaaaaaatatttgttgagtgaatgaataaaacaaacttggaagagatttgagagataataacaaatattgaccaaagaagagggaaagctaatatctgaactgatgaaaaagatctttcctaattgtagtggtttttgttttaaacctaagagagcatacattgctccctagggttcctaccatacgttttgatttcctaaacactatctaagtcaaattagatttaccttcaaacaattacacatggtgcagccgtgcagcagaaaaagcagtagatggggagttaggagacatatgttctagatccagctttgcaattaacttgctttgtgactttgggaaaatcacttccctcctgtgggcctgtttcctcatatgttggagtacctcgaggatgagaatggattttgtttttcctgctgtatcctaggcgcttagagtaatgctggccctaagaaatctgttgaatgactgaatgaatgaacaaacaaaaggaggaggcagtacttcattactgaaccttgcttgtgaagaaacacagccggcaaatgagtttagtttaccaagcgctttcatgtgtttgcagacaacacactcggtgtctcgcacacgaggttaatcctgcttgcttaataaataaatgaatgagtgaagtgaaaaggaaagggggtggtatttccgttataaaatgagaaaactaaggccgagagtggaagagactgggtcccaccactcaatgagtgcttctcaactcgggaccctaaccggacctccttgtccttgctctgatcaggcgcgggaccacgatggcgtaacactctattttgaattcgtccctaatcctccttaactttccttgaacatgacccaccgtccaccataaagctttacctgaatcgagaccaaaattctctacatggtgtccctgagactgtccacatgaagactcttctggtaatgcccgacacagatcgcgccgccatcttcgatgagatccacgggcctgagcgcagccttcagccagcagtgacgcgcccagaccagccaatcggatacaatcccagtggcaagagctttctttttcctgtaggctccctcgccctttgcacgctgggaaatgtagtccagtagctgttgctggcggcgtctggaccgcggcgctctttccgagcatgacgggagttgtagttgagggggcctcgggaagaatctgggtgacgccttctggtccgggggcgggcggtcatagcgttacttggctgcaaggaggaggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggtaagtaagcacccccccggggatcccggttgtctcgccgctaccccagctaggccgcaccactgctttctcccccaggccccccaccaacctcctgaccgcctctttagggccagcgccttgcaaggaactccccactagtgcattggggtgcggttcgcgaacaaactgcccactggctccctttttttttttctttttctagagagacttgataaatcggcctgagaaaataagtaatgctccagactagctctctcatttgtgagttctccaggtgaagcaccatttttgaccttcccttgtgtcttctgttcctggcacagtgcctggaccccaaggtacacgcttagagaacctcaaggaattgaattgaatagagtcacaagccagtgcaaatggaaaattgaagtaggcaatgaggtgagggaagcttggagaggccttggggcagtttactaaaattaaactctcagggcataataaatcagaaaagccttatccgtaggtcctttctagtctgagatgtctgtcagttacagttcgttcccagaattgggcaacatatggaactttcagttatcatgttcctcctagcctacttggccacaataagtgattgcctctgtcacttttagtggtagaattgtccttgagacaacaggaactgactacagaaatcatactatttcaggggttgctgacatttgaggatgtggctgtgttttttacccaggaggagtgggattatctggacccagctcagagaagcctgtataaagatgtcatgatggagaattatggaaacctggtctcactgggtaagaatctgctgtttctctaattaaaatatctaagaaggtagagagaaatcagactaacagaacatttggacggaaaccagtaccaaaactgctttgttccaaagttctgattcaaaccttttagccattaattgtttccataactctcatccctagcttccttgaggtgaccaaactgcaagcctttcgggcatcctgtcttcataatctcattcccatattgttctgtactttccgtcctggctcatcctcccacagctttcctcccaccccttttcactctgcgttctggaacccctgttcgtcttcacataatgttccttccctcctggccttaactgaaacctggcactatcccaaggacaacgtttctctggcagtttttcaagtgggggctgcttattctcccacatcctcctccttccccatcctttgtctcaatgttggaagggggaagttattgttcactcagcttttaaatgctgtccccaaagcattagttttccaccttcaaacaaaatctctccttctttgaggtctcagcagtcttgctttttccactcaattccttttcactatctgtcaacttttagtttggtccttcacacataactttgtcacatgtttcatagtctattttaactcgtgccatggatgacccagttaatacttcagcctcagtggatcttcagggaccctgctttccacttttactcagcaccttacatcattgatcataccagttttgtcataacaggcaaatcgtaaatcccaataccctattctctgaccagttattcggaaatggaagtttattgactgtgactagacgagggtaaccaaaacagacaggctttctccccttgtggagcttactacaacttctctatctttcctactcctttccacctaaacccattcattattaacgatgtttcctgtcccttgacgtctctgttttttcactgaggtgtccaacctttctgggcttgtatccccatctaatcaccagcaagctctcttgctagcttgtcattattctctacccattctgcaaacttcaaatcctgtatttgttataaaattcacctttctctctttcctacccaaattgctaaacatagcaggagaaattctctaaccagaaagattgatatcctttatataagtatggcctttttcttccactctccactgggtttttatatcttagcaatattttttgtcactgatatgctcactgccctgttctttttagtgactattccaaaagcttatccatcattaagtagtgaagctcaccttctgtttctcagagaaaataaaggccaataagcatgaactctcaacttctctgcctcttatctacacacttaaagctgctctcatcttctcacctttccagaaactaatcagtcattcttttttcccttttagtttcagtcactatttcttctcccttggtacccttattctgatgattggtatgttcacaactcttcaacaggagaaaagagaggaaaaaagaaaaaatccctcctatgagtcagactctccctcttgctgctgcctatgatttactacttgttctcttcatagtcaagattttgtaagagtagttaatgtgtgttctgtatttctttacctccccttgtgtctgagcccctttgtcttgcctctaatactccctttaaattgtttaacagtgatctgtaacacgtcattgtcaaatgcagtagactcttttgggaccttattttagtctacctctctatgaatatgtgaaactctttattgtttccctccattggcttgcattctcagacttcccctcagtctgtactctttccttgggggaccttacctacactcaggtcatcagctaccgctctgtgaaaataagtcccattttttttttcaagtcatagcctcattctgttgcccaggctggagtgcagtggtgcaatctcagctcactgcagcctccacctcctgggttcaagagattctcctgcctcagcctcctgagtagccgagacaaacaggcgtgcaccgccacacccagctaatttttgtatttttagtagagaaggggtttcactgtgttggccgggctggtctcgaactcccgatctcaggtgatccgcccaccttggcctcccaaagtgctgggattacaggcgtgagccaccgtgcgtggcccaaatctttatttccacctaagaaaggtaatgtggagcctaactgcctaggtttaaatccttgttccaccacttacttagcctggtgagtatagtgatttaatctctctttgcctcaatttatttttttataaaatggaaataataatagcacctacctcatagggttattgtgagcattgactgaattaatgtatgtaaaacacttgacacactaacatgtagttaagaacaatataaatgttgacttatattgttgtcatcatcttctctgttgagtttccaattcctagtcatcttttgaagaccacatgagtaattcaaacctggcaagtttcaatccattaaaatcaagggccttctctttctttgttttaccagagctaagcactcctttctttgttttaccttgtatatactcctgctattgaatttatcatactatactacaatcattctatatatgttacttttctaacctcactgattactgtgaggatggtagatatacctgttgcatttgatttctccagcacttagcacagagccaggcctatattatatgcttcttaaatatttatatgactgagtaagtacagttaacttaagactcagtatctcttaactggattattacattaacccctaaactacccccttgccactagtctccttttttaaaatatattctctctactgccaccaaagtgattttgtattagttaactgtgtaaaacttctgatggttcctgatagcttaaatgataaaaatcttaatttcttatcatataggaccttccaagtatagcctctgcctatctttcttgcctcacctgttttttcctgcacaccactttagtcttcagccatatcagctgctgatatgtgtgtgtgtgtgtgtgtgtgtgtgttttaatataccatgttgtctctcagtcactgccagcttatccatacatatggtattctggttgatagaaccaagtaagtgcctggccctgccttctcctagaactgcagcatgtaaataccatatggacaaggtgtgacagtgtgcccacagatgatcttctacttgtaggctgtcttctttatttcagcttaaatacagctttccatattcatcatttctcctcccacagtcttttcatcctcctcaataaacactatctccatccctttggtgagagctcccttgatgagagatcactattactctactgttgcaatgcagtattctcttctacatcatcttaactgcttttcataatgcaactcttgtctagctttatagttttggcttttcattcatacttttccttttcaagcttatttttaaaaaaactttaatagctacatcgatgatacagttgatagcttaatttctcagatctttgacatcttcaattttaatgactctttccgcaatgacttgcagattgccaccttattactgtgtcttcacatggcagaaggggagagagatagagcaaacgttctggtctttgttcctctttttataagaacactaatcccatcatgggggcccaaccttcatgacctcatctaaatttaattacttcccaaaggccccgcctccaaatatcatcacattgtggattagggcttcaccatatgaatatttggtgggaacacaaacattcagtctataacactgtcttatctcttttttctccttgacggtttagtcttttctccttatgttcacattcttctgtccttttggcttctggtttgataggttacaattctagctaccttccgaataactagcgatttcagttttaattccaggttctttggcgaaacccactttgagacaactatctgtgtagaaaaattggccatgaccacaggatgggaagatattgcataagcattgccaagcccagatctaatggatagtcacttcaaggctgctctgtgtggaagccttactcttgtttttttcacctgcctatcctgttgacctatttatttttatgtgaatgtcattgttttattcgctttaacaatatattacattttgtgtctggtaatataagtcattctttaataatctttttcaggatgtacttcactagtctgccttcttctaaactttagatttatttacttttttattggttcatgtgatttttgattggaatgattagtttcatagattgaaaggaattgagatccttataatattgaatctctttagccatttggttgactctgtttaactgtatccttttgtctttcagaaaaattgtatggaatatttttatggatcttacacatttcttatgtttattcctaggttttatgttttttgttactattgtgaagcatttatatcatttctgtataatatttactaactttttttgtactaagaacaagctttttaatcttgttatgattatattttcatttgcttcttccaggaattttaggtatatattcatatcatcttcaagtaatgatcattttgtcttattcatttgaatgaaattgacagaacagtatccactaatccaactaacataactgaacaaatattctgaagagactgccttctcacaaagaatttacaatctagtggaagagacaaataacgaacagttaaaaaatgcagtgtaatcatagcaataatagaattatggtcgagggctggtaataaaaaaatagaacacctgaatctgtctagtggacttagtaaaggctttgtagaggaactgttgctttaaacttaaagattgctttgaatcttaaaaccaaaagtttgccaggtaaacagtgttgagggacatttagtaaatgagatatgtgaagataagacatgaaagactgtaacacaaacaatttgcctacataaagtatgataaagtaggtaggaacatgacttgaggcttagagactgtgtcatgaagagttgtatcatagcaaagagcttgattcgatcttaaaggtgatggggagctgctaaatctacaggtgatgacttgagtagaattctgttttatagagatctcttctagaatcagtaaggcatatataatgtgttggcagcctaaagactggagccaaagattataaggcagctacatgattgtgagggatgaaagataggtgctagagagaaatccaggatttggatgattgattaacgtgagaagaagggagaaatacaggatgattgctgctttgagactatagggtaatggatgatggtgcctttcaagagataattaaaggtggggaaaggcatgaaagcagatgatgatgaccatgttaattgtgagccctttgtgaggcatttaactggagatatctggagggtgtatatacagaacaagtaaggatgtaaatgtgggtaacaataacaaaagtcagttgacaaaggaaaagaaataaatgagggaaatttatcagaaaaggccaaagaagtagggaaggaaataaaagaatgtggtagtgtagaaaccaaaaacagataatgtcaagaaataggggtggtcaacagtgttagatgctgctgaataacataaggactgaaacatgcccattttaggccaggcacggtggctcacttctgtaatcccagcactttgggaagctgaggtgggtggatcacctgaggtcagagttcgagaccaacatggtgccccatctctactaaaaatgcaaaaaaattagctaggcacagtggcgggtgcctgtaatcccagctacttgggaggctgaggcaggagaattgcttgaacccgcgaggtggaggttgtagtgagccaagatcactccagcctgggcaataagagtgaaactctgtctcaaaaaaaaaaaaaaaatgcccgttttatttttatttgagtcattggtaatctaatgagaagtttctctagatgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaagataaaattggacatatttatgtaatggtaggaaagtgtcaatagagagtgtgtattgaagaaagaggaaagacgggataattaagcaaatgcccagaggtgagtaggatcggtaagtgatggatggattagccttgcataagaatcagatatatctttatgtaccattggcagataattttataggtagaggacagaaagttgagggagttctttcatgttttttcattatgtgaaagaaaatacagcccactgaaaaatttgagaggggacactaaaaagccttagaagaaataaaatttctagtagtttcttaggggaataggaaaaggttattttagaataaaataatgaagtaagcaaatagaaaattcaaagatgactccacaaaaaattgagagaaaagaggatgtatgaaaaaggagcttgtttagggccaaatataaatgtggtcattattgaatcttctagcggaattatctaatatctattccagcaagagatggaaaatcaggaagatgtccgaagcaggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagggtttagaatcacatgtacttgaggtatggtttgtggtaggtaaagtcataagctaccacagactgccctttttggttgttgctcccatgaactctgaccatgtttcttaatacttattttattctgcatctcgatatcatagactctctgtcacctaaccctttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgtttctggagtgcttttgatgggcagtgagtaaatgcttgttaatgaatgaattattgtttcccctggatctttgtcttttatccttcttagcatctttttttatttttatttttatttttttgagattaggtctcactctattgcctaggctggtgtgcagcgacgcaaacacagcttgctgcagcctcaacctgttgggcttaagtgatcaatcctcccacctcagctacctgagtagctgggactacaggtgtgtaccaccatgtctggctaattaaaaaaaaattttttttttgtagagatgaagtctcactgttgcccaggctggtctcaaactcctgagctcaagtgatcctcccacctcactctcccaaaatgctgggattacaggcatgagccactatgcctggccattagcatctggtcccttctgttaattatttggtctgatcatattccaataatgctttctcatccttaattttcttgaacttagtggagttttttttcatcctaccctgttttccttgatagactgattaatcccaccttgactttatttgtttctttgtttgcccatcttactttgtttctccttgcttcaaagaccttggttgatctttgtatttcctttttattattccagatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttgtgtaagagttgttactttagtgtaaaaccaattctgtcaaacgcattactgtgtttttaaaattagaatcaaaaataggaaggaaatagctgtcatttgttctgtgtgtgactagttaagcttttctggagtagctcaattaagcccaggttcttcagtttctgagtatagaattccaaattagcagaattctgtaattccagcttcctaatagtttgagcaaatgacccctccttctcctgtacctcagtcattccaaaaattacctccagactttcatcttcccatctctttatgtgtgtacctgcatgtgagtgtggagattatggtacatgtatagaaagatacatatctttgtgcactcccttattcaaattaggtactcatagttactatacagttgacatttcaaaacaatttgtagtccaaggaaaagtacaaaaaacaacatactgcacctgactcatataaaattttcctgccctggaccttcccagttgtacttattttacactagtggttcccagatcaggatctcaactaatgaggttcttagacctgttctcagtattttaaaaatctattgtgtatgttttcactgcatgtacactgaaacacatttctttgctttttgttgaagtcacatcagtttcatgtacggttatattccatagcagaagcactggctgctgttgacctcatagtagtttgaggctatggttgtatgaggtagtcctacataatttttaatatccttggacatgaatctggaatttatagaaatttcttaattttaaaatccttggacaactcagaactccagtaacagtgaacagttcttgactgcatatacacatcattgcttataaaaaacatagaaccctaaaaaatcatttttttaaaattatactttaagttctgggatacatgtgcagaatgtgcaggtttgttacataggtatacatgtgccatggtgtcattctgcatagtgccatcgcagaaattttcttccattctgtaggttgcctgttcactctgatgctagtttcttttgctgtgcagaaactctttagtttagttagatcccattcatcaattttggcttttgttgctttagtgttttagttaattttggtgttttagtcatgaagtctttgcccatgcctatgttctgaatggtattgcctaggttttcttctagggtttttatggttttaggttttacatttaaatctttattccatcttgagctaatttttgcataaggtgtaaggaaggggtccagtttccgctttctgcatatggctagccagttttcccaggaccatttattaaatagggaatcctttccccattgcttgtttttgtcaggtttgtcaaagatcagatggttgtagatgtgtgctgttatttctgaggcctctgttttgttccattggtctatatatctgttttggtaccagtaccatgctgttttggtttctgtaggcttgtagtatagtttgaagtcaggtagcgtgatgcctccagctttgttctttttgcttaggattgtcttggctatgtggtgggttcttttttggttccataggaaatttaaagtagtttttttctagttctgtgaaaaaagtcaatggtagcttgatgggaatagcattgaatttataaattactttaggcagtatggccatttttacctaaaaattcatttttaaaaaaaagcagtgctgggcgtggtggctcacgcctgtaatcccagcactttgggaggccgaggcaggtggatcacctgaggtcaggagttcaagaccagcctgaccaacatggagaaaccccgtctctactaaaaatacaaaattagccaggcgtggtgacacatacctgtaatcccagctacttgggaggctgaggcaggagaatcacttgaacctgggaggtggaggttgcggtgagcagagatcgcaccattgcactccagcctgggcaacaacagcaaaac

SEQ ID NO: 15566 - DNA, 26764 bp, Human
tacagtaacagactggagcaatcatcaaagttttgctttccatcatgaaataccaaattcaaactatgtaacactgatgtaacaataatcatatactgtccatattcaaatttcaccaatgtcctagtaatgacctttatagcaatttcacttccaatccaggatccaatcctggtttattgagttggtcgttaattattgtttcttggtctcatttattcttcaataaattttttcaagtaattgatttcatgtaagttaccaaattaattagcataaaattgttcataatattccctaattaatgtcagttggatctataataataggcccactttcattttgagctatttgttatttgtgtcctatcttgtttttatttaatcaatctaggttgtggcttatcaattttttagctttggcttcattttataattttaaaaattatattattcttcctttatcattcagtttgaaatatttcctaatttccagtgtgatttctttttgactcatgacataaatatgtttgattttcaaatatttgggagttttctagatggcttaatgttattaatttctaatttcattgagatatatgatttcagtatttttacatgtatcgagattttatggcctaacttatggcctatcttgttgaacatgccgtgtacatttgaagttgttgaggcgattagggtaaggtcattatagtgttcaaatctatgcctttactgatttttttcaagttttctaccaattgttaaaagggatttaaacaccttcactcatggttatggaattgttatttttcctatttctccttttaattctgtcaatttttgccacataaatcttgaaatccattattcggatttatggtttttatgatcttgtcatatagatatatgatatatatatattttataatcttagtcattactactttaggtttcttatgcttattgttgcatagtatgtgttgcgggaagtcagggaccccaaatggagggactggctggagccgcggcagaggaacatgaattgtgaagatttcattttaatatggacatgtatcagttcccaaaactaatacttttataatttcttacacctgtctttactgcagtctctgaacataaactgtgaagatttcatggacatttatcacttcccaaataatactcttataatttcttacgcctgtcttattttaatctcttaatcctcatatcttggtaagctgaggatgtacgtcacgtcaggaccactgtaattgtatctgactgtacaaattgattgcaaaacgtgtgtttgaacaatatgaaatcagtgcactttgaaaaagaaagaataaccgtgattttagggaacaagggaagacaaccacaaggtctgactgcctgtggggtcaggcagaatagagccatatttttcttcttgcagagagcttataaacagacgtgtaagtaggagagatatcgctaaattcttcttgtagcaaggaatattaaatattaagaccctaggaaaagaattgcattcccagggggaggtctataaacggccactctgggagtgtctgtcttacgcagttgagataaggactgaaatacaccctggtctcctgcggtaccctcaggcttattaggatggggaaaaaatcctgctgtggtaaatctgaggtcagaccggttttctgctcttgaaccctgttttctgttgtttaagatgtttatcaagacaatacatgcacagtggaacatagaccctcatcagtaattctaagtttgccctttgccttgtgatctttgcattgccctttgccttgtgatctttattggcctcagaagcatgtgatcttgttctcccttttgccctttgaagcatgtgatctttgtgacctactccctgttcatacaccccctccccttttgaaatccttaataaaaacttgctggttttgtggctcggggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggtatgtatttttttcatttacttacttccattcttttaatgtaatttttcaccacaatccagactctcagtaatcctttccttgcttttgtttaaagatttactccaaaaatgtggcctatagttttagttcagcaaatacaaatttgaaagatttatttatgtgtatttatgactagtttctaacgacattatgtttataagattcatccaggttattgcatgtagttgtaattcatttatttttattctctagaagaagaattgctgggtcaaaagttattcatattgtcacatttattagacaatgtccaattgctttccaaagtggtggtaccaatttatattcccttagtagggcttgagtctgagtgattcacttcctaaccaactcttatttttggaatttttaattgttgccaaccttttaggtatgaaatacacaccatgattttaatttgcatttctttgataatgagattaagccttttcccataagcttatgattgtgtcctattgtctgttaagtacctgtttaagactttttctcatattcacctgagatttttagacattacttttttaggaatattttatgtatcccagttaataattcttaatcagttgtatctgtagcataagtcttgcaaggtagtagcttaatagttttcaagttttttatggagtatttggctgatcagacttccttaaaattaagttgaatttaagtttcctttaagtttgcactttttaaatgctctatcacctcaaaaaagatccagtacttttatggagatagtccttttattgtcatgtaaaatcctactaacactccgttctgtagctatttcaagaaaccatgtgaattagttgaggaggattagtaggagatttggtcctccccaaattctgaaagtggggcttgagtattttattactcattactgtgatcacatttgtagttttcatcttttgttgtctcaggaaagaaaccatttgcaaatgcagagccctccagaagttaccttgagtattttattgcagaagaaaaatatgccctaatggtgccaataggggtcaaacaacttctataaagaaaattattaaaataatgtgagtaaaatgtagtggcaatccctaagagggacggatttagagagaacagaaaatgaagagggaaaatagtgatacatttattgggttcaataactgttaaaaattaataggaaactagagcaagaggtatgtggtgacctagcacttaagttagctctgttatacttccaaaggcatatttgaggttttggccttctgggcaagttttggtagggtgtctgtcattttccctctactgctggaaaagaaggctcaagaggaagaatccaggtactttgtattttaatcaggactatttatttgggccgattggaaataagttaaaatctctgctcttgaattaaatcagagtttatttacctcagtgtttggaattttagcagttcatgaggacaaatagtctttttgttcatttcataatctcagctgtagagttgcccagagtgctcagataagtgtgtcttttcattttgatttgcttagaaaggatgtcagtagggacttgctattatgatgatattgagctgaaatttatatttctgaggaaaatgaaaggctatcagaagtcatttgttaaaatttctttattctgtcttccccatccccatcaatatttctccctcttttaaaagactattgcctagaattttatagaataagccctcctattctgggaaactgtactgtggtcctatttatattttgtttgaagggtaattttcttttaatgtaagactaatgccatgttagaattagattctgtgaaaatatttcttgaagctttgaatatatgttatacctatttatgcaattcaggaatgctttctggtagtgaaatgtaatgttaaaaaataccaaaaaaagcaagtataagtttgagctaaagttaatgactttctaattgacttatttctgtttgggcacgctggttgatgcatgtgatatttgtatagaaataaattgaatggataatattgttaggggtggtgaatatctgagttactggtggcaaatctgtatgggtctgcagcaatctcatttcttgcctcctcgaaagaaagaattcaactgaggggcataaggcagtaaaagagaccaaggcaagtttcagagcaggagcagaagtttattaaaaagctttagaacaggaaagaaaggaaaacacacttgggagagacccaagcaggcatcttggaggtcaagtgcctcgttcatccttgaacctaggattttatatgctggcctacttctggcatcttgcacccctttcccttcatccttcccttaagggttatggggagccacccacatgcatggtgccctgcttgtgcttgggatgtgggcatgcacagtgtgtttactggagttttatgcatgcttatctgaggctttctttcaaattctggtggaatgcccctggaaggtcatactctgccattttgactcttaatgtgcatgtttgagctcattcgcccagttcctgaaagctgccaattatcaatttcaggtgtttttatcagttgagaaactgcctctccctggtgctggctgtgaccaattgttattttagagaagcagagtgaccatcacctgatagtcacctgacattctggtgggtgggggcaaccctctcctgccccactcatgcatgactagctacctactgtaacaatatgtagaagaaatactataccttaagcttatttagagtaggaactgcatcttatctgtcagtgactatgacatgtagactcttgataaattctttttgaagtactaatcaatttgactaagagttggaaatgtagattccatttctgactctcatgtatttctgtatgatcttaagtactcaatttcttgattacaagaaaacaaatgaaatacggtacttggaagctatagtatcacttatttttaagcttctcaggaaacatattcaatgtttactcaccactgaattatcattctcaggacttctctctctgtaggctcattcttgtcagcatgtatttatgtctgtgtctgtctcatctctcatctatatatacacatatatgcaacacaaacactgttgcatatattttcttttactttcaatctgtctttttttgacaatgtgtttctgaaaaataaccacttgctttttcaattagtttgacaatctgtcttcttttttatttttatgtatgtatttattttagagataggatttcagctctttcacccaaggtggagtcagctctttcacccagtggcatgatcacagctcactgcatccttgacctcttgggctcaagcaattcttctgcctcagcctctcaagcagctgggactacaagtttgccccaccacacccagctaatttttactttttttttgtagagatgggatctcactatgttgcccaggctggtctcaacctcctgggatcaaccggtcctcatacctcagcctcccaaagtgctaggattacaggcatgagtcaccacgcctggcctgtgtcttctaattggagtgtttgatctgtttgtatttaacgtaattattgatatgtgtgggtttaaactcccatttccattcatcccatttattatttgctcctttattcctcctttcctcttgtggcagattgcatttcccaaaaatgtatacacaaatacacatacaaatacacacacacagccaggtgcggtggctcatgcctgtaatcccagcactttgggaggctgaggcaggcggatcatttgaggtcaggagtttgagaccagcctgaccaacatgctgaaaccccatctctactaaaaaaacacaaaaaaattggccaggcatggtggtgggtgcctgtaatcccagctactcgggaggctgaggcaggagaatcacttgaactgggaagtggagattgcagtgagccaagattgcaccactgcactccagcctgggcgacagagcaagactccatcttaaaaaataaaaagcaaatacacatacacgtttcatccacttaaaaaaattttacaatgtgattgacatatctcctactgttaataggtatcaacattttctccacttgaattttgatgggagcttgtggctgctattaaatggcagagattatgctatgtgatttccagtgctaggatataaaaaggatacagcttctacctagctttttctctcttgtgttgcttgcccttccaacccagccaccatgctgtgagtaagcttgctctgtggtaagtgagcaggtctgtgcaaacctacccccaaaggccaagggagctgagacactgaacaaagagagtgacaaaacagtttctcagagagaaacatttaataggggcttacaaacagaagctgtgtctcaggcagctgtgagacaaaggatcccctcactgttactccccagacccagggttgatataccatagggaaaggatatacatgcttcagcaggaatatgtaggaatttgcctaagggtaggatttatggtaggtgctcttatacaagagatagtagataaggcagaaatcttaaaggcattcctagaagtgggattaatcagatgtcaactggcagattagaattcaagatggagttgctataacctccacactccagctttctaattgggcttttagaatctcacacactgtcctcttcttcaatggtctttgagtttagaggaagggtgcttgatattgtacagctttagcagcagtgcactggcaatgggaaacagatcaggcccagtgggatttcagatgagaaaaaatgcataggctttcttgaatcatctctagtctttggagtaccatgattttgattttcttggatgaagtaaaacaatgagagataaataacattaatatgcacacaagggactacaatcaaaaacagaatttgtatgccagaacaacaacaacaaaaaagaacctattccattagggagccaactaaaaacaacatgaagaaaattaaaaccgggtttgtctttagagacttcttgtagccacaaaataatttaggatttagtccaaattgtaggcaagtaataaaaacaatggttaagactagaatctaatcatgggtgtacaatagttttcttctgaaacaatttttttctaagtttctctatttctaccaaggataaattattgtaggaccaatttatttgcaaaatgaattttagtctcattatgcttgacctgattatttgcataaagtgcagcaagaatagtgattggccatataggttcttgtaaaattggcttttttggaacttttaaataaagaatctcagatttttttaaagccttgaggctaacaaagccagggatttgccatcaggctgcaatagctgtataaattgggtgaattcttctaaagatttccaaataactggaggttcctgggcatgtcaaaatgcgacattcgccggatgcggtggctcacgcctgtaatcccagcactttgggaggctgaggcaggcggatcacctgaggtcaggagttggagacctcctaacaatggtatttctggttttagatccttgaggaatcaccatactgtcttctacaatggttgaagtaatttacactcccaccaacagtgtacaactgttcctatttctccacatcctctccagcatctgttgtttcttgactttttaatgatcaccattctaactggcatgagatattatctcattgtggttttgatttgcatttctctaatgaccagtgatgatgagctttttttaaatatgtttgttggctgcataaatgtcttcttttgagaagtgtctgtttatatccttcacccactttttgatgaggcagtttgtttttttcttgtaaatttgtttaagttccttgtagattctggatgttagccctttgtcagatggatagactgcaaacattttctttcattctgtaggttgcctgttcactctgatgatagtttcttttgctgaacagaagctctttagtttaattagatcccatttgtcaattttggcttctggtgaaattgcttttggtgttttagtcatgaaatctttgcctgtgcctatgtcctgaatggtattgcttaggttttcttctagggtttttatagttttaggttttacatttaagtctttaatccatcttgagttaatttttgtataaggtgtaaggaagaagtctagtttccattttctgcatatggctagccagttttcccaggaccgtttattaaatagggaatcctttctctgttgcttgtttttgtcaggtttgtcaaagatcagatggttgtagatgtgtagtgttatttctgaggcctctgttctgttccattggtctatatatctgttttggtaccagtaccatgctgttttgtttactgtagccttgtagtatagtttgaagtcaggtagcatgatgcctccagtgttgttctttttgcttaggattgtcttgactatatgggctcttttttggttccatatgaaatttaaagtagttttttctagttctgtgaatagtattgaatttataaattactttgggcagtatggccattttcacagtatcacttcttcctatcaatgagcatggaattatttttccatttgtttatgtcctctcttatttccttgagcagtggtttgtagttctccttgaagaggtccttcacttcccttgtaagctgtattcctatgtattttattctctttgtagcagttgtgattgggagttcactcacgttttggctctctgcttgtctaatattggtatagtaatgcttgtgatttttgcacattgattttgtatcctgagactttgctgaagttgcttatcagcttaaggagtttttagactgagatgatggggttctctaaatatagaatcatgtcatctgcaaacagagacaatttgtcttcctctcttcctatttgaataccccttatttctttctcttgccttattgccctggctagaacttccaatactttgttgaataggagaggtgagagaggacatccttgtcttgtgctggttttcaaagggaatgcttccaggtttgcccattcattatgatattggctatgggtttgtcataaatagctcttattattttgagatatgttccatcaatatctagtttactgagagtttttagcatgaaggggtgttgtaaacattttagcttttataatcctatcaatccttatattttatgctctagtctcaggaacttctgtactccacccccagaccattttaccctctcttgtgaaaaaacctctgggttcccagcaaggagttgagccaagggatgtgggcctttttgtcaatctttatctgattagtctgtctccacattgccccaggaaattattaatcagctttctcattgtaatttttgccttctgatttttgaaacttccccaatctggtgtaaatatagaaaactgatttggggctctttaatgttggggaaccagcagggactccctttggtccacccaacatttgatagtgttgtattaagactcaaaaggtaaacaaaaattttattatctctcattaatactatccaaaaatcttgttcaaaagagaaaactaaattttgctttgtattagagtattatcaatagtaaagctaattttaataaaattttatgaatgatttcattgactctcactcagcttttgaccacacaagaattccataaagcttttctctatccaaaggaatataaataaatcactctaccataaagacacatgcatatgaaagttcattgcagcactattcacaatagcttttcacagtttcaaagacatggaatctacctaatgcccattaatgccctcttacaaaattgctttctatgtttctctttctctaacttttagatctatttatttgtatctatatcatttcttccattcattttgaaacaatctttaaaataccactaaaccgggccagcatgcctacatgctcctagtctttgtgcacgagtgggaggtggcaggcctccaacaatgcagctagtctttgtgcgtgagtgggaggtggcaggcctccaactgtggccttctctgctgactgttctagtgaggcatccccagccatgaaccattttggtacctggttggtgggaggcagggtgaccccattgctgccactgaaagcccgcaacaatgaaaatctcaacaaaattggtatgtctttggatgatatcatcaaactaaattgacagggaggaaagaagcataattttctaactggagcctggcaattcaggatgagcatatgatggagaattcaacagaattctggctttggtaagactagtctgagcacagaggatgagtaatgcctggaaagagacagctttatggagttatcactggccttgcatctaggaaagcaactggaattcacaaagaaattaatcctatgaatcatccgtctctaggtgacaggaatatagaacgatattttctagtgttaaaaaggaaggcaaaccttctgggacaaatatgaagtgcagaaaaaaaccagttgcagttctcaagggacctaaccagctaaacagaaaaaaaaaaacattccagccaattttaccaagaatggaaataaattaagccatcagaaacacatgcgtcaggcaacttttcatttcagaagagacgtgaaggttcagacccagttgaacacaacagcaactgctggataacgtagtcggaaagagaactcatcaatggcagatttttgttgcaggacttctttttagttcagctaaagatgtggtccttgtcccacggccacaaaaatttaggctcacaatttgcggagtgagaaaaatggaacttattgggcaaaaaggagaaaagggggaacagttactttcggcaaagccggaatcgcagctagtgcgctccctgcctcgccatttgaatccaaggttccacacaggaagaggaggggccaggctcctccctactgcaaatagcagaaacttcggtggcaccccagtgtgcattcctcccagttcgcccgcggttggagtttttccatggactccttcccactggctgtctcactttcaccacaaacggaggaattttgactctatctttggacaatcctggagcagtgcaatgcctaacacagaaatcaggattaattcatactgttgtatcttcatttttaacaaaatggaagcaatctgacataacgaaagttcctaaagtggaaccctacaattgacataaattgtgctggaaaacagacagagatgactttgaatgagaagtttaggatcctgaaggaacaaagagccactctgacaaacaacaaaggaggaagctgctttgtaactgtattagtctgttcacacactgctaataaagacatacctgagagtaggtaatttataaaggaaagaggtttaatggactcaaagtttcacatggctggagaggcctcacaatcatagcagaagacaaaggagaagcaaagtcatgtcttacatggtgtcaggcaaaagagcttgtgcagggaactcccatgtataaaaccatcagttcttgtgagacttattcactaccatgagaacagtatgggggggaacaactcccgtgattcatttatttccacctggccctgcccttaacatgtggggattattacaattcaaggttaagatttggttgggaacacagccaaaccatatcagtaatcatgggatagatcccatatcaaagggaattttgagtgatgacgctgaaaaattgaattgcttgaagagttcatcacagaaattcaagaaactatgcttcaaaacattcacaaggctaactcatttttatttctgaaggtttttttttttaaataaagcaggtatgatataatgccctgagacaataacagggaatatacctgttcttaaagatttcattgttggctcagacagaacaattatctatttgacttctttggttcctcttatagcagaaggaagatagaaatatagaaactgattatttttatgatagtggtatttaggatctcattgcctttgcccatttttttagattttatcatgacaaatcttggccttctgaaatatgggtaggtccctttgttgctatcagttatcctttaatagtgttgatgcagtaaatacagttgccttgtcttcatgagagatatttttaaaaatattggaattctagtttggagtttcaagatttatgaaaatatctgaaacttggttcacttttcaggtacattttaggctaataccccagaattatgaatttttagtgctgaacttagaaatgtggctctaggcattagtctcagcttaaaatgttggtgcttaaagactgaagatgcatatttacaaagttaatctgatagggccttggaggagagggtccagtttaagaatctgacagtttgtatttagtgaatgaaagcatgagagcaagtagcaagttgaaagacaggtaactgagatgagaaacttcaaaacttaggtcatgtgtactgtttggatttagtgtagtcttgagtctagtgtccacaaataattcttcaaatgatatttagaagaattataattatttaaatggagtccttcagacattttgatagtaaaattaataggcgtaaagtcctaaactttatttgaaaagttacttctcatttgaaaagttaaaatttatgagctttgaagcttgctaaattaatttatagctccaaaaccaaaaatatacttgtatatgtcacaaataacagaagcaaaatatataatagaattacattgtaccttgttgtttacctttcactgatttcttgtatggtataaagctcagtattgatggggagaaaagggcttcgcccctacccccgagacctttgatgggtgggaggagttagtctgtttgccaagatagtgctgagtcctcagatgttgaacactataaattatagtataatgacaaattcagcaaaatgttccagctataagttacaggtttagtcattttgaagcttgacgttttagtttgctataatgttaaaaacatccaagtaggtgatagtttctctggagtatattattagtgttgacttttcctataaaacaaaacatcgttatcgttcagcctgccttgcattttatactagacttcattcttgtctctcatgcttcttgggttacttaatggtttatgctagccctgaaagctatcagtaaaaatttcatgcttatatcaaagaattaaatctgatcctttaatatctgatattttgccagtacttctagtgataagggatttttggaagtcagtcacagaatttaaaaataaattctagtctttcctcagctatttgatactcatccctgttcctgcaaaagacatgatcacattattttttatggctatggggacaaataggccaagtactcattgccaagcatttttgtaagtatgcatgcttatatttggtccagaaacaatgcattctagattggtttagaattactggtagcttattttacagcaaggaaaagcagctgagcaagaatttgctgtctttagaacagtttgtgaaatatgatataagggtgttttcatttcctattccctattctctctctactctgctcctctgaccccattcattgaaaggcagctgccttattttacatgaaggtgtgcaatgcctcagatttctttcagcttgcacccctgatctcggtctgagcacatggtgaagctctacggaaagttggcagatagagaaagacttactctgtggctacagtttcttggaattctagtttatcaaaccaatccacacatatccattaaaagtacattaaattttctgttgatttctccttatttttttctgttgggtttattttttgctgctttatcataattgtaaatcagcatgtaggagagaaaactttctgtttcctatggagcagcttgtcacttgctggagttcaattcatgtagattctttgcattctcagtaatctaatgagttacaaacaaaacaaaaataaagaccaaaaaaaaaaaaaaaaaccaacaaccccaaaactaattttgtagtttatgcagatagttgtgtttgttagagagagaacagtggtaactcttgtggctttcttcacactaatcaaaaggagatgggcatttcttaatttttaaaaagttacaaaaagctcagcaagacttttatgtacctgaatggcctgtcagcttctagttttgctttcctttgggtaaatcctaagtacaaagctatggatgttttttctctaaagagcaatacacacaccaccccttttgttctttccaaagattttattctcattcttttgagaagatccttctgggtttttttttttttaactttcattttaggatcgggggtatatgtgcaggattgttacataggtatattgtgtgatgatgctgaggtgaacctgtcaccctgatattaagtacccaataggtagtttttcagcccttgcccccatccctctctctgtcctcttgcagtccccagtgtcttctgttcccaatgtccgtgtgtacccaatgtttagctcccacttataattgagaacatgaggtatttggttatctgtttcttcattagttcacttagggaaatggcctttagctgcatccatgttgctgcaaaggacatggtttcattttttcatggctgtatagtattcctattccatgatccctctatttttttatgttctgttgcaggtaaactcttggatgcaaggcattctgtttccaggacttggggaagggattagcgtgaagtcaaatgtctcatatatatataaacgttcaataaataaccatattttcaaacccacatcttatttttatcctccattgtacctgatttcttttaaaggttctgtataacagattgtgttatcttcctagatgtattgataccattcatgcatattttggctgctgcttctttaacagtggttcattattgttataaaatttgtcagcttgcttactgtcttctggaaattcattgaaagctctcaggtgtcttgtactagaagactatatcaggaagtttctaaagaactagagggttagaactgactcctaagtggtctgactgctgattcaattcacctttcatcaacccttatctctactttattttactgctcctctttctttcttttttgaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggtgagtagaattactctgcttattgttattcttgtttttccactttaaatacattatccgtctagaaatttagcttgaatagcttgtagaattactctggttattgttattattgtttttccaccttaaatgcattatccctccagaaatttaacttgaatatggataatacctagagcactgcttcctgccttacaatcaatgttaaccttgggtctgaacaagaatgtggtaatattctactccagctcaagtttcatctcaacaattctgaagcttgtctaagaatgtgactacatatagtttatggagtccctacattatgggctttacatagctttggatttatgctaaatttttctgcactgaagccaagatgggaggattaatagaggccaacagttcaagaccagcctgggcaacatagccaaactctttctctataaatactaaaaaattagctgggtgtggtagcaggcacctgtagtcccagctactcagcaggggctgaggaggaaagatctcttgagcctcggagattgaggctgcagtgagccatgttcctgatactgcactccagcctgggtgacaaagcaaaaaaaaaaaaaaaaaaaaaaaggataatgcatgcaaaatgcttatcatagaacctggcaatactaagcactcaaagatgaacaaatgttagacaaaactttctatgatctgacttctgcatacttcttcagccttatcttatagctctaatcttatagctatatgaagaccctcatcttgatgtgatggaaaccatatcccagatccttgtacaggctctgtcaggttgagtttcagtttaggcatgggttattaccttgttgccacaacaagctggagataagatggactgaaagattgcagcaaatatagaggatgcaagaaactttgtaacctctagcttcataaatattacatatttatagactattccatgaatctaataatatagcatgcttcctaatggctataaaacttatcagaacgctcatagtttcccacagaaatctccaaataccaataaataagtggtttaaacatgttttggtacatttctcagagtttattgtggggccaaataaagcaaagttaatttctcagaagaaaaaaaagcaataaaagctttcctttccaaattcaccataacccatgtacttgttcggataaatttgagtttttaaaatacccagtaaatagcatatagaccactttattatgtatagggaccaagaattaaatggcacaaattgctgtgcctctattatcccaccccagttaaaaatctgcttattggtacaggccttccatcttgggatgatgtgctggtttagggtgtgctgtttgtgaatcctcttgaacactgcatgtgctgggtctcccgcttcaagtgtgttttctatcgggggaacaaaagagagctgagttgtgtgaggttataaggaggttgagtcagatcacaaatatttcatgactgtaacattcttccaagataaaagactcagtacttttaagtgttcccccattcttgtcaatcagatggtaaaaacatccttattcatttatgcaaatgataatttaaaactaagatatattcaacttcactttatttattatttattcattgtacttaattatagtaatttttaaaaattcccaatactcctttaaatcaagccacttctttcaaatatggatgggatcactctgtcttagttaaaaccacttataaaagaatagaatatccctaataagtgcatcgtaagtttctttcagtgtgtgggctctgctttattttggaaaaaagctgcctatacagagtgactgtagaatgatactctggccgtccctactttttaccacgtgtcagcctgcaaaaaatgaacatggcgttattgaataaaggggctcatcatttacataagcttaggtgtaaggtttcatcactgtatagtcaaatgaatgtagcagagcagtgttaagtcaggattttagctaatacaatcatttaaaaaatgtttttgaatcatgtatttctttgagaaccaaattaaatctgtggaacctctcataagtaaaattcacctacaaatatatatataccatattttgcatatattgtaatttcaggatcttcacagatttcctaaagcttatttgtatacttctttataggttaagaagccctggcctaatttatatgcctttctttacaacaagagtatagaaactactgtgaattcccatttcctcagctgcagagagtaaatatgtctctgaatgtagttcctagtcaaacgtctagatattgtgttccattatatattcaatggaccttaattctgccccaggtagaaggctgaaagtgttggaattgtatttgaatatttaaatgttaatttcaaaattacatttgaatgtaattttgcatttctgctttgtgttctcatgtttttattatcttttatttatttattttatcttttattatctaatcatttgtatttctgctttgtattttcaagttttcttatcttttccacaccttctcttcatgtacaattctgttttgttatttttcaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtaatttttgtcttttcagtaggtttgagtccctggggtttttttgtttctgtttttgtttttgttaaaagacagggtcttgctccgtcacccaggctggagtgcagtggcatgatctgacacttggccagaagccagtgccttttgatactacaatgtgcacaggctaacttcctatgcattttgtctttctgagcaaaagacactggatgagaaataaatcatgtgaattataaataacatgggcatgaatagaatttcaagttcactgagaatcgtacttggaagttaagagaagtcataggatattatggttattttttaaaaagggactggctgggtgtgatggctcaagcctgtaattctagcactctgggaggccaagatgggaggattaatagaggccgacagttcaagaccagcctgggcaacatagccaaactctttctctataaatactaaaaaaatagctgggtgtggtagcaggcacctgtagtcccacttacttagcaggggctgaggaggaaagatcgcttgagcctgggaggttgagactgcggtgagccatgttcctgccactgtactccagcctgggtgacaaagcaaaaaaaaaaaaaggataatgcatgcaaaatgcttatcatagaacctggcaatactaagcactcaaagatgaacaaatgttagacaaaactttctgtgatctgacttctacatactgcttcagccttatcttatagctctaattattaactagctatcatttttctcatcactatacttaactggacagataatctgtatttctttgaagaatgagtctgaatttttagttactcatgagcccttaaacataatactattagtgctttccaatccatatgccttttaaaattttaaaacatgtgctttgctactatgatatgggatagagttggagtttattaaaccttgttaattgcccaatattttttctttcctttccttttttttttttttttttctttttttgacagagtctcgctctgtcacctaggctagaggcagtggcacaatctcagctcactgcaacctccacctcccaggttcaagcaattttcctaccttagcctcctgagtagctgggactataggcgcgtgccaccatacctggctaatttttgtatttttagtagagacggggttttgccatattgggaaagctggtctccaactcctgacctcaagtgatccacctgccttggcctctatttttttttttaataagaattgaaataaaattaaatctccatactacatgtttttttatataaggatcaccaaaatataatcaggtttgcagaaataagataagcaacaattactgacaatctactgatgtagtgaacattttaaatggctatttttgatgcatataatggaactgccctcgaaatgtcagtcaatattatcattgtgagccttcttcttggcttagatgagaagtggagaggttatgtgattctcttttttcacggtctttgcctcgttccccttatatttgctgcatgactttttcatcactgttcttgccagtgtcacatagatagctagttaatgattaatccaggcctggaaaccagatttttttccccagactctgagaaattccattaaacctacttcacattgtctcttctgcaggatgatagaacagagatctttcttgcaggtcttatttctctatgtgttgattttaagtaacttctaagaactcataatttcctgatcccaaattttgtggtagaagttgtaacaagagttactgttttggcaagggacagaaacatattaaaaagcctgcacagatatgagtcatgcttttttgttctttcatgttatacttgcttttactttatctttcatggccaaatccactctgagttcccatctttccttaacataactgtcgctctctatcttatatattaagatataggattgggaggggtgggggagaaaggtaggtcaaagggtacaaagtttctgttagacaagaagactaagatctggtgatctgttgcacagcatggtgactatagttaataataatgtattgtatatttccaaattgctaaaagattagattttaaatgttcttaccccaaagaaatggtaagtttgtgaggtaatggatatgttaatcagcctgatttgttcattccaccatgtatatatgcactgaaatatcacattatgcaccataaatatgtataattattatttgtcaattaaaaataaaaattaggccaggcacagtggctcatgcctgtaatcccagcactttgggaggccgaggtgggcagatcacctgagatcaggggttcaagaccagcctggccaacatggagaaaacccaactctactaaaaatacaaaaattagccaggtgtggtggcgggcgcctgtagttccagctcgggaggctgagtccagagaattgcttgaacctgagaggcggaggttgcagtgagccgagattgagccaccacactccagcctgggtgacagaatgagactcagtctcaaaaaataaaaataaagtaaaaaataataaattaaaattaaaattaaaaaaatacagaatttcagagcttgaaaggaacttttaattgattcaagccacccctgttaaatatacagggtaggaaatagagagtatatatgactcattccatttgtttagttttttttttccctcttaccctaagaatttctcacattttcatcagcttggcatgagttgtatattgattcatgtgtttctaagtagtagggaaaatatcccaaacattggtttataaaatgcctttaaaatataggagatcaattaaaataaatacaggaagtcaacaaaggttttagaaaagtgatgcttctctctaggactctgtccttgccaggagccagtgctcaaggagaatcggagctttattttgtgacacaacaattttctttaactcctccttagaattcccaaccaaattggtaactgggagcaatacactcaatactcaaaaataactcatgaacatgtagtttccttttcatttttactgctgttaccttagttcaggacagtataattttctgcttttatcagtgcattaatctgtggcttttctgcctccatttatgcaagtcagagttgtaaacacaactattttactcgcttgcttaagagtctccctatttattataggataaaggccaggcttcctagcatgttagacaaaacttcctatgatctgacttctgcatacttattcagtcttatcttatgcccatccttaaaatttgtcctaattttcctccttagttaggaaaaaaactgaagatgcttaatatatctttcaaagctatgcaccataaagttggtgttttctgtttcagacttattatgttatttcccaccttatactctaaattaaaataatgaagaatgacttgtggttcctctaaatgccttgctcttcattgcctctcagtttttgcatgagtttctcctatggtgaatacattaggaatgttttggctacatttctcagaaaagtggctgatggtggcttaaacatcagcataaggtatcttattctcttacataacaggtttggtgataggtggttcaaactttggcttagaaactcagtgtagttttcaatcaaggagattagattgacatttctgcaattttctagccttactctgaaggtcacaaaatgactctggcagtttcaggaattaagtcaacaggccagcatcctagtctgaaaagaatgatcataaacataggctttctcttcatgattctgtgtcagtttgcacggggggcaaaaaaagtccttaggtagaatatgttggccttggaagagaggctgagaaagggaaatagattaggatccatcagaatttatcccttggggctggatatattgctatgccacacaaaatcaaggtcatattagctttgaaattgtggagaatggctcctgtgtaggcaactaacagagtctgctatactcagcatagaataccattccttcttgttgactttcttgtaatttttatttcttgagacagggtctcactctattgcccaggctggggtacaatagcacaatcatagctcactaaagccttgaactcctgggctcaagtgatccttccacctcaacctgagtagctgggcctacaggcacacaccgccatattcaactaattttttagttttgtagagatagggtctcactatgttaaccaggcttggctttcattttttaatacgaagactcatttgttttgtagcccatttcctctgagagcctttctttgatcctgcctttattccctgctaatctgggttggcagtctagcctacatacattctcatatcatagaatttatgatgctccaatcatctgttgtgtttttttttttcctcctgtgtcttcatctggcagtgagttccttaatgacaagagattgttccttttctctctgtgactcccagtgcttgccgtaggatagataatttaaggatgcttatttgatgactgacaatgagggaggaagctgagccaagcctcctttatgacatttttctccacaatgagaaaacttttggaaaaaacaaagcaaatctagaatcctctgttcaactctatcctactgatctcactttctttctcagtctcttcctacaaggtgccctttcctctgaagggaggaaagtgtaccaatcatctataccctgacccacattattcacaatagtcatgtgccatttcttactttccctgcgacatttgcatttctttagggcattttaaactcagaacctaacacaatactgaatccgtaatatatagtcggtaaagcttgacatatttttggagtatttcttttgaatacatattatatattccagaactctatagctagggatgtgggtaggattaatacttgctttgttctcattagccagtgaagttctttggttgtttgagattgtggagttttcctaaatgaaggctagaataatttctcatttctattatttttttcaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgataaccaactgaatatatgaggactgcatgtaattcaaccacatggttgtttgctgtacagtcctttgcaaatattaaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattacccagtctcaggtatttctttatagcaacacaagaacaacctaacatgaatgattcaccattttcccaagtttcttgttttggccaagattctggcaataatccatatttgaaatcaaagtatctggtatcaattcatacttgaagtcacttgaagtgccaggcatcaaaccatacttattataaaatcatgtgaagtt

SEQ ID NO: 15567 - DNA, 9208 bp, Human
aaggtatgggagcaggacctgggaaatgttgcttattcagagattcagaatggaaaaatatattacagagttgacatgcatcattcctgggcccaataccagccaggaggagggccatgaatatctgtcctaagaaacctaatacacacctgcctgtcttccttcttcccttcctcccccacttttccttcctctttcttgctctgtccttccttttttaaaactcgtcctaccatcttcactgtctacctaacctctttgagcctcagtatcctcatctgtaaaatggggataatgataattcttaattcatagtctgtatgtgaagattaaatgcatgaatgcatgtaaagcatttaaaacagggccggacatgtagatagccatttttgagtgtaagtattataactcttttcttcttcactttccttcaataagtctttttcaatgtccccctgatccctcatctccacatgtgctcagcacgatgctataccaatcccctagaagaccgaggccttgccattgaggtgctcaccaggacatccaaccagaacacagattggtactgtgatgagtgctataaatcaagaaagcaagcaagtggctgtgggctggagaaggcaggaaagcctctgagaaggcaaggtcaaggctgggtaggatctaggagatagaaaagcagaaaggaatggccaggcgccgtggctcatgcctgtaatcgcagcactttgggaggccaaggcgggcagatcacctgaggtcgggagttcaagaccagcctgaccaacagggagaaaccccgtctctactaaaaatacaaaattagccgggcgtggtggcacatgcctgtaatcccagctactagggaggctgagacaggagaatcgcttgaacctgggaggcggaggttgcggtgagccgagattgcgccattgcactccagcctgggcaacaagagtgaaactctatctcaaaaaaaaaaaaagaaaaagaaaagcagaaagaggccagataaggatgagaccgtgaagggttacgagggagtctggggcttgggatcctggcatggctggctgtttggccagtcacatgaggggtctggcctaggtggttgccaaagagtttatattgcagacagaggtaatgctgtcacctgaaagcaagtgagaggacagggtctcagtgctttacctgcattattgtttctgatccttgttttttttcttttttttttttttgagatggagtctcactctgttgcccaagctggagtgcagtggcacgatctcagctcactgcaacctctgcctcccgggttcaagcgattctcctgcctcagcctcccgagtagctgggactacaggcgtgtgccatcatacccggctaatttttgtatttttagtagagacggggtttcaccacgttggccaggctggtctcaaactcccgacctcaggtgatccgcccgctttggcctcccaaagtgctgggattacaggcgtgaaccaccgtgcccggcctattatttctgatccttacaataactgcatgtcgaagctttaccaatggaaaaactgaggctcaggctgggcgcggtggatcacttgaggtcaggagtttgggaccagcctggccaacatggtgaaacccccatctctactaaaaatacaaaaactagctggacatagtggtgcatgcctgtagtcccagctacatgggaggctgaggcggaaggatcacttgagcccaggaggcagaggttgcagtgaagtgagattgtgccactgcactccagcctggatgacagagaaagaccctgtctcaaaatagcaacaacaacaacaacaaaccccgaggcacagctagtgagcagcagagccagaatttcaaccaaagtctgtcttgcagacttcaagtctcctttacctttcaaggcattccctcacctccccctcctcccaagaggccacatcattcgtgtgtgctctgtcttccagaaacccttccaaccaccaagatggctcagaccaaccctacgccggggtccctggggccatggaaggtaagcccacccccatcacatccaacagggcaggggtgacatgctgcacagagcaggccccaggcctgtgctcgtccataaggcagtgactgaccagaaaaaccccagtttgtaggggaaaggtccacacaagctccagtgctgtcgaaggaaggatctctcaggatgtcccactggacaaaggaaggatgactgtggatgccattgatgggtgggagatgatacctagtttcctaactcctctctcctccccactaaagtcatcttaaaatacagcagcccagcaacagttatgtccatggagaaaatgagggcccataaagatatttactactagatcccaaataaattacaggactcagcctcccatcctgaggttggctttaaccattggccgaagtggctgatcctcaggcctctcactggcctctctccaacactccccactctcctcattgggtcaactctgaggccagctcacagctttgcgagtggtcctctggccaggtccacgagccaggttttagttcaatgtacaaaaagggttgaccataactctcctttacactctaggtttctatagggggtatggctggagaagctaagaatctataaggagctcctgggactcccagaatcctggcctctgggccatgcttatgaaggaactgtggtggaatgggagcccataagtccttggcctgtccattggtctagatattatccctggcagaccatttctatcataaaccaatcctccctccacctcatccctactctgggcaaatgaacaccaaccagtggcattaattcaaaccccttcctgccctgtctacactggaagagacctcatcaggcatcccaggctacagctggtaacagaaagcacagagtcagactgaagttaagctgttgacctggacctctgtttttcctgatgttctagctctcttgcgccattcaatctcatttcagataaccatctatgatcaggagaactttcagggcaagaggatggagttcaccagctcctgtccaaatgtctctgagcgcagttttgataatgtccggtccctgaaggtggaaagtggcgcgtgagtatggacttccgcagaaccgcagccccttatttcaggtcccttcagacaggggaccatagagtggggataggggaagaaggatgttcccctaggctctagtcatttctcggagacaggcctcgaaagaaatcactacatgcataatttagtaagccaaagctagaaggaaggaacatgaggttcttagtggcttggtactagatttcaggggctggataaagaaatacatacaatggggtgggacagtggcagtaatcaaaattttgcttctggagctcacaggctgctacctagggtgccctcagaacagccacaagacccttgagtttttcttgcctgcagaaaattggtagagaagaaagtgtcaagtggctgcctcttcatggctaactctcctcctgcatatcccagagcagacactgttagctaatttctttatgaaaaaaaaaaccttaaccccacgactccagagacatattagctcctgattcatctttcaggcagtttcttgttgatggttaatcttggtgagggagaccctctcatttttgtcctctgactcttggcagagtagttgaggcctttatcattagcctgaaaatacctaaggaaaagactcacccttgactaggcagaattggccttgcatgtggataggcttccacaagttgcttgccaccaaaattaagctcttcagtcctttaaaagatgtaacactttaaggtgtcatcactaactgagacccagttgtgaaaaactgagctgagtgtttcaagttttaagtacaggtatggggcactaggagaaagaactcgcaagtcacaggaagaaaaaagactagtaatccatcagttgcttgttcatccctgtgctttcttaagaagaagccaacaggtttggcttgagccaaagcaatagtccaggggtgtctaatctttttggcttccctaggccacactgaaagaattgtcttgggccacatataaaataccataacgatagctgatgacctaacaacaacaaaaacaactcataatgttttgaggaagtttacaaatttgtgttgggctgcgttcaaagctgtcctgagctgcatgcagcccttgggcaacaggttggacaagcttgcaacagtcactagatcctgaaacaggtagagaataggtgatttggagaaaaagaaaaaaaaattttttttttttttgaggcaaggtgtcactctgttgcccaggctggagtgcagtggcacaatcatggctcactgcagcctccacctccaaggctcaaccctcagccccctgaatagctgggactgccagtagtgggtcaccacgcctggctaatttttgagttttgtagacggggtttcgccatgtttcccaggctggtctccaactcatgggctcaagcgatctgcttgccttggcctcctgaagcgttggaactacaggcgtgagacaccacacccagccaggaaatataattttagattggctttgctaatacacttcactcagaccagtgaagtagatagaccttttcagtgataacccccaaacaaatattacattcactaacctgcttagtatacctgtcaactcattcctcaactcttgtgacaaattactttgtacagctctactgggattggcttgatattttaccccactattgacttatctaaaacgaaagatgccttctccccaaggccatataggctttgaacaccatgaacaaacactacatgtctttggcagctggattggttatgagcataccagcttctgtgggcaacagtttatcctggagagaggagaataccctcgctgggatgcctggagtgggagtaatgcctaccacattgagcgtctcatgtccttccgccccatctgttcagctgtgagtctctgaaatttccacttccgtgcatatgagggatgggacaagagggtgtggacagactgacgttcatgctatttatcatcagttatgctgaatgtggcaggaaaaaagacaaaagtaaaaaaagagaaaacatcactttcttctctaagcctgctatttgatttttctccaccaggtggtacttcccttaagctaaaactaagggtcttacaagtggcaataagtggatactcaagagcccagtaaacttgtgaaacactagtaaatgagtgaaagtgcttaccctgcagcaaaaagtaaatccttggccagttaaatttcaatctgtgtaacatttttactgcagaaacaggaaaatgctgaagtaacctttcagtaagtgggaatgactgacgaaataggcaagtcttccagtatcgatctacactgattgataataatcttcttgttctgaacacttaagtattactcaataatgcatcaggctgggatgtttctggtctttggaaacagttcaagcagaaagcagaatgaccttaaggggtgtgttgaaaatgatccctgtattaggagttaggttgggctagaacctttccaaatattcagtctatgtgagagtttctcgtgattttggttaataatctcatcttggttcaaagtcttgccaaaattcaactggtggagaagttaacctaaatagttctaatccaaataaatagttgcctgtctggaaattatttcaatctcacttttaaaaacatttcatttgcccaccctaaggtataactgacatacagtaaaatgcacagaccctaagtgaatattctcatgagtttttgaaaaatatatagatccatgtaaccaacaccctaaccatataaagaacattccatcatagttccctggtgtccctttccactcaattgctcccctaccactttctattaccaaacagttttgtccatttttgaagttcatacaggttagtctctgtctttttaatgcttgtgtagtattcatgtcccctactggacatacaggttatatccaacaacacacatacacacgcaagcgcacacatacatatttgggcttactttttgtaataatctgtgagatcttttttcacattagtgaatattaatcccttggttggctgcattttgttagtactttttctcactgtcaaatcctcttcattgttccaaaatagtatatcagttatttgtacattcaaaatgttatggtatttaaattggaataaacaaaattatgggtaacttttttctcacaaatctgttgccttaatctttttaaattatcatgtgcttccttgtataatccaaaagtgtttcaattttgaaaaacatgaagaatgatagccatagcactagtactaaacattttaaaacaatttctgaattacagaatcataaggagtctaagatgaccatctttgagaaggaaaactttattggacgccagtgggagatctctgacgactacccctccttgcaagccatgggctggttcaacaacgaagtcggctccatgaagatacaaagtggggcgtaagtacaaaaacagggttggaatatacttcaaagtaactcctgaggttgcatcaatagttatgttttaatcagatttcatacgtatcggtatagatgtcacattctagttctacataattttgaatctcaatttctttataccaactaccactttaggttgcagatttatctcccccagacatgcctctatggaagaatttacgttgactacttatacctgttttgatgattaaggctaattaactagctatagccatattatgcttacaaatagtgcctgacacatttaggatggctattttttctaagcctaaaagcatctcataccattgtgttgagtaaagaggctcaggttttggggtattaaccagattcctaattagttttaataatgaaatgtactttgaatttcctagctgggtttgctaccaatatcctggatatcgtgggtatcagtatatcttggaatgtgaccatcatggaggagactataaacattggagagagtggggctctcatgcccagacttcgcagatccaatcgattcgccgaatccaacagtagctgattaaaagctccaagtacgataattcctcaagcatgagaccttgctaagcactctagaataagttttatgttctgctcacagacattgctttcaaatgttagctgctgaaatccacaataaacgtcatttaaaaaaaaaaaactttgtagactgaattaactaccatgcttcacataaatcacacctaagtggatgagaattttttttttttttttagttattttgctcttgttgctcaggctggagtgtaatggcgctatcttggttcaccacaaccttcgcctcccgggttcaagtgattctctgcctcagcctcccgagtagctgggattacaggcatgcaccaccacacctggctaattttgtatttttagtagagacggggtttctccatgttggtcaggctggtctcgaactcccgaccttaggtgatctgcccgcctcggcctcccgaagtgcgggattaccggcgtgagccaccacgcccggcctgtggatgagaatttttgttgttgttgagacagggtctcactgtcacccaggctgaagtgcagtggtgcgatctggcttactgcagcgtcattctcctgggctcaagtgatcctgcctcagcctcctgagtagttgggactacaggtgcctgccactatgcctggctaatttttgtactttttgtagagatgaggtctcactatgttgcccaggctggtctcgaattcttgggctcaagtgatccacccactgtggcttcccaaagtgctgggattacaggtgttgagccactgcgcctgtctggatgagaattttttaagtcaagcttccataaaactccacattctcttttgtgtccttgcaagtcactcaccaggccaaggacaattattccttatctcaaagaacaataaagcatatgacctaaatgttatcaatctctatagcgactgacacttttggtaaatgtttttatgtcctttcctcccgtctcctgctctttctaataatgttgaagttggcattgattttcctttcaccttgtgacaaatcagtactaaagaaacaggaagtttctccagtgtgtactgccacatatttcaacataaagttatgaataaatccagaatcttggcaacttaacattctagttgctcaactgcttagctcaattttgatttatttcaattggaagggcataaggcttaatgtcctgcaaaaaggcaggatagctctggatttttcaataagcaagctaattctaagcactgtaaaaacctgtatgattaaaaaatttttttaaaatcataggaccatagtatactgaagacttaaattcttcacatatttgaccctttggaaaaaaatcattatcaatgtcacaaacttagttttcggtttgtttttctttttactttttatcagctgaatttaagattagtcagtaaagactttttaaaaaattaaagcacacaaaagataacaaacacctcagaaactttaaaattttttattcaacaatgtacacttattgtctctcaatttgatctacaaatttctcaagttttttttctgataaaataagtaaatctgggtatggttgtagagtgtttgtaatttatatttttaaaacactgaacatgatgaagacatcaataaaggaagatcatcacgtaaatgacacttcctcagaatccatgacatcagaaacagctatagcaaatacctaagcatttagcaaaagggaaaatttctggtgactgttcttatatgtagaaaagacctatatttttgactgggcaaaacaaacattgaaacttttttttgagcggggggaacatcctttaacataactgtactccacttattatccattcccccagattaagaggtaactcagctccttagtgcctctgcacgagacagagaaattacttcactcctccagtaggttctaagactgaacataagtgaactactgacagatgcggaagaggaaccatag

SEQ ID NO: 15568 - DNA, 91772 bp, Human
  misc_feature (1)...(91772): n = A,T,C or G
aagaactaaagagcaattgtataaaattatgcaaatgatcaagttgaaagacaaatttcatctttataactggtaaaataactcgtattttgccatagaactctgattcttatcttcagatctatgatccgtttaagaaacactaaggcaaagctgaaaccttggaaaatgttcctgcatcaccccaaggtaatacatttttattttttctgatttggtgtctaacaactttctgccttggagtagctagtaatatgtagcattttcctagaaaacataagctctttgaagacagggaccacattttatttattttttatatgcaccacacctaatacacagtacatcctcagcaagtactggctgtaaagcctatattccatgctcttattttgtagtccaaatcactttaaaaatcacacttcttctattgttcatactcatagaagagcatattactcaaatagctctgctataaattaacagtaagtttcagaagttataccaagtcacgagactcagatttttaaaaagtgccacaaagtgtctcttctgtgtcaatgttaatagaaccctttctttaaatgatcagtaggcaaattaagaatttccggataaagaacaaactctggaaaaacaaagctagtgggagaggccctgtaaatacctacctagtcttacaagggctgtctctaactcagcttgtattttaggcagcgtcttcagtttttcaactaatgtgtttgagaaaactgttttcctcggacatgcaggcgtggactccttacttcaggtaaggtgacagcagcttgacagagagtgccttccctcccacggcatttgggacgaggctgaaggaaagacacaggcggggttacgggaaacccattctctgcgccatctgggcaagctgaagtcagtttttccgctttctcacgaggtaatggattatcatgggctcaggtccccttcagctctgaaacaggtattctatggctctaagtaaacacggcaagagacaggttatttctttggtaagatcagttgtatttcccagagaataaaacgggcaacaaaccatttatcgatatgtgagtcttccccctaggccctagctatttggggttggataaagaaaaagagggtttgcttcctttttggcgggtcctccaatgacagggctcctggcccgctgcgggtccaactcccacctctcgtggctcccccgaggccgagcgaggctccgtgcgaggacagcccctcaaccgcactccccagagggagcgctgggactcgcggaggagattagtccccggtcataaacaacctctcacttcccctcccccgcccgcgcccgctcgcgccggggcggcgcgccggggcggccctccgaggcccaggaacctcctccggcgcccgcgaggccccgagtcctcctccggagggcggctgcgggcctgccctcttctcctaaccaggtgtttgtccactttactcaacccttcttactcgtccacgctacggccacctcacaggggcggctgacgccagcccctttttccctcccctcgacccctatcacctccaacagccaaggagaggccggcggccctgacgcgcaggctcaccgccgcggccgccccgcgcgcgcggacgcggcccccgcccccacctcgcggtccttccgcagtccggccccgccccttcccgaagcccgcctccgggtcggcccgcccgcccgctcgcgcgcacccgacgccccgcctctgcgcgtgctcaataactgtccccggagccggcctacaagcttcccccgcccctgagctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccatcggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaaggtaccgactgaccgagcccgggcggcgaccccggcccggcggcccgcgggcggcagggtgggggagggcggccggggcgggggtgtcggggacctgactgcgggagctgccgggctcggggaccccctcccccaccgcgcgggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggtaacagccctcgccctccccctttcctcccttcccttccctgttccttcctcgctcgccctccccgcccccccattcacccttcattatgctcccctcccccacccgctgcgctcccagccgctgaggtctcttccctgcgggctcccaccccctcccccgctcggcagcgtcctagcgcggcgcggagtcgcggggccaccgccgtcccctcccggcccggcccggcagcggcggcggcggcggcggcggcggcgctgctatcaacatggccgacatttcccctccgcggcgtgagcggcagcaatgaactgtgggggatatttattcaagttagccggagtgacagccgggcccggccgcgcacagccccggtttgcattaaaggggaatcggcccggccggcccggaagccagatgcggggctgccaggattggtcttgtcagattcgtcctaagagggccggtgggacagctgcaggttaacttcctaagtccggctcccatctgcttccactagtaccttcacatacccaaattttgggtattagattaggtagtaaatttgtcagtgaagttataaagtattaaggcagttaactaccaaaacctagagaggaagctgggttattcctgggccacctttggaagagagtttcctcagcagcggtacagtattaacacgttaaccaagccaaaccaaccaaaagtgaagctgctacttggtgaacgtcagattataacggctctgtgtacatggctttaaaaaatgaaaaaaaaaaatcttacatttttcttttcaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcaggtaggttgaataataaggtggcaaaatagttgatttttcattttgtggaaaaacacagtccagtccaaaaactacataacatgaaatgcaagtataaaacattccaaattaaaatagaatatgcacattgttcaaaggcaaaactcttaccctactatatatattttacatccctcattttttccccctctaaaatgcattggtattcaggattagaatctgaatcttttgctataaagttgacatacattggttttaatcccttgaaagttcagtaaagacctaaaaggaaaagcatcctaccacaccacactcatgttgtatgtgcaactattatagtggcttagagacactagttcgtgttcttcgtttctatattagtaaagatgttagaggaaattaatctgtttgttgcatcagggtttaatgtgaccatgttgtataactattctgaaaggtaagaagtttttcactggagtacagtcactggctgagaacatttaagttttcttttgaagcatacacagttaacaactattgcaggaagaactctgaattaaatttcaggcccagagttttgatttaaactccaaacccttggaaaaaaagactgctggaaaatatgaaagaacccttcgtttcttaacccccacaagtccttttattgcacttactttcatgtatttgaggatgagaggagctttaaatcaacaataattcactaaggaataatgcaaggtggtctattgtaacattttatgatattattgccctggaaataaaagatactgaacaatgtataatgttacatgtaacaaaggaatattatttccaaggagctcagttcttatgttgtagtgaaaagcactattcctaattatatattgggtatatgttgtattttcccaagtcccacagtccctagttttgtgagtttcgtacatttcagggaaattctttctgtgactacaacttttatttgcttcctattgaaggaaattgacttgtttctgttttaggaaattttaagcttcttagggataacttcagtgcttaagtgtctttggaaataactgaatttagttctataacatttaaaatgtacactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttcttaaagattgcttccttcgaaaaactgcttgtcatggagaggctgaggacatttgtaatttaaacctgtattttccttttcccagttgatatctgcccccagagaacactttagttcttgtctataaggcttaccaaaagtttgcgggaaaggtggtcctgtgctgttaccactttgaccaagagaagaacctggagattgggatgtttttgcatgtcaggatttattaattcaataacagagagggatgatgcttctcacttattctgatgaatcagcaaagattgcaaagcataatattaatgcttatgtcttgaattggcacattaaaaatgacactagcattaaaataagccactgttttcaaatgaaaatgataatttgagtaaagagtattgaattggaagaaaacattcttccagaagatttttttcatcataaaactatctgatttaaacatttcatgttttctattcacaacaaggataaatgattaggaattttggatgtctcaaatatttaatactgaatattgttcatgtgttttcttctttgtaaaagtactttgtatctgcctgtttgctgtggaatacttttattttgtaacttcaatgtctttacataagtatttcccctttcctgctctatactaggatctgtggtgttcacagtactaaatacttgtatgtaacgttagtagttgaaggaaatgagaaaagattaggtggaagatagaacgtatatattttatagaacatctaaaaactttaatgttctgaattactttcttaaatgtctgggttaatatatatatttgtatatttatgtagatatccaccattctcccacatatatgcacatatatgatttttcataactaattacaagactattaaatctatattgcatttgttaacttagttaacatacctacagataaaacatctttgaattattagctaggatgctatcagaatttgcagggcattagtaaggttaagtaactgagaaaaaagaatggttcttagtgaatgttttcctcaagcactttgggtatcccactaaaaaattccatgcctacagacattgttataaatatttaattttgataatcagtaccatttactgatatttctacagtaatggagcaatgtatagcctttagtcaatcttttcctttatagcagtactttaagttgcatatcattgcagataaatttgatacataagtttttcacgtgtgttcaacagagtttcaaataatgctgatcctttgagacctgctgaaagtctgaagcagccttaatatctaaaattaggaaatgtataaaatgtgagaggtctgattaaagttttatatgtagatgagttaattttcttattgttacaggtcatcctgttttccatcaatatatatgtatattttttttgagacagagtttctctcttgttgccgaggctggagtgcagtggcgcgatctcggctcaccgcagcctcctcctcctgggttcaagccattctcatgcttcagcctcctgagcagctgggattacaggcttgagccaccatgcctggttaattttgtatttttagtagagactgggtttctctatgttggtcaggctggtctcgaactcctgaactcaggtgatctgcccaccttggcctcccaaagtgctaggattacaggcgtgagccacagcacccggcccgatattttcaacattgacttttttttttttttttttttttttcagtaaattatgttagttaagattagccaatatatctttactctggcctgcaagtccgtttttgttactgacctgattccacacccctgctacctgaagtatgttagtactgattaaattgttccaggagttagaatggcacctttcctactatgtgcccttggtgaagacaatccttgacagatatcttaaaaggagataaaatatgtgcttaattttttgaggattttctatggtgaatgtttacctcattgaaaaatggtggctttcgtacaatatcaaatttaatgattctcagggaaaagaattttaaccaattttatttttgagcataaaggtctattttgtaaacttaggagataatacagttatagttctaatactacttttttttccctttacctaaatagtacccatttaataggtagtgtgaaatacaggcttctttttgaaggctggcaggtgaagtagtgagaactccatttccatttgggtgcttggtttctcttagattatcaacaaatgtatgaataagagtttgatatttattaagctatagacatcttttcaaatgaaagtaagttaattactatacctgaaatactgctgtgttgaatataaactggaaacacaatgatgaatagtattttgtaaattttttaattcctttaattaaaatttttttttaaattgtggtaagaaacacctaacaaaatttaccatcttaaccatctttaagtgtgcagttcagtagtgttaagtatattcatattgctgtgcaaccaatatccagaacttttttatcttgcaaaattgaaactctatatcaagtaactcccagtccctggaaacctctattctactttctgtttttatgaatttgtctactctggatatcacagttaagtgaaatcatacagtatttgcctttttagatgggctcatttcacttagcataatgttctcaacattcatttatattttagcatgtcaggattttttcatcctttttaaggctgaataatactctattgtatgtaccacattttgcttatccacatatccattgatagtcacttgggttgcttccacttcttggctgttgtgaataatgctgcaatgaacatggttgtgtaagtaactttttgagatcctgcttccagttcttttggatatataccctgaaatgaaatgacaggatcatattgtaattccattttaaattttttgaggaagtaccatactgtttttcatagcagttgtaccattttacgttcctaccaacagtgcacgagggttacactttctttatatcttcactaacacaattttctgttttactttgacattagccatcctattgggtgtgaggtcgtatctcattgtggtttttatttacattttcctaataattatttatgttaagcatcaacatacgcttgttggccatttgtacactgtctttcgagaaatgttcattcaagtcctttgcccgttttaaaattgttttttgttgttgagctttaggatttctttatattttctggatattaatcccttatcagataaatgatttgcaaatattttctcccattatgtagtttgcttttatactctgttgtttcttcagtgcacaaaatttttatttttgtatggtccagttacatatttttacttttattgcctgtgcctttggtgtcatccacaaaatcattgctaaatccaatgtcactgaagcttttctcctgtgttttaagagttttatagctttagatcttctgtttagatctttaatctattttgaattaatttttgtatatggtataaggtaagggtccaacttcattcttttgcatgtggatatccagtttttccaccaccatgttgaagagacttgccctttcccatttgaatggtctctgcaaatccctgaacttttgagcctcaataatttttgttggtggagagggcactctcctgtcaaacttgcttaaatgttttttccccatctttattgtgtaaaagaagagcagtggctagaaatgtgagaattggaatcccaatcttggcctcgccattgaattattatgtaacattgagcattcacattactattttgagcctctgctacttcttattccaagttggcaataatgaagccattgtacctttaatatagaattgttgagaggtttaaatgggatgatatatttaaaatgtaccttattaggatgtctcactagacaaaagcatccttttcctccaaaagattagtatgtttacctctagttttctatttttttcagctttaattttgaaattaaaattataaaaatcttcaaagctgattattacatgctttaaacatctattagtatcacgaagtatatgtttttctttgggctttgtattgtatcccagaaaagcaggtgtgaaagaaaattaatataacttggccaaagttgtctcagtggcatttaataagcataggatgatgtttttaaagaagtgttaaaacaatttaaataatttagcagataagtcagaaagtcattcttttgcaagaatacttatgtgaaaaaagcacatgccttaggattctttcaaatagggagctccccctagtgcgttttagatgagatttacacaagtttgatttgcagggaaccttttaggagcacatatgttgggtaaatcaagggatagtttaataagatttaactgagctcaaagtagtacaaaatggatatgatttatttcctatagagcattaatttaatggtggtataatttaaatgagaaggaatatccccaaacccagattttattttcttttaaaacatttgcaaaatatttcttcagaattttatactctaaaactgttttctaaaagaaaaaattctccagtcatgatctgaaaaaaaaaaaaaaaagaaaaatgaaaaacactatcctaaggatgttattgcattctttttttttttgggatagagtttcactcttgttgcccaggctggagtgcaatggcgtgatcttggctcactgcaacctctgcctcccgggttcaagccattctcctgcttcagcctcctgagtagctggggattacaggctcccgccaccaccctcggctaatttttgtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagaaaaaaaaatatagttggggggtggtggcatgtgcctgtagtcctagctactcaggactcctggagtcctggttggaggattgcttgaaccccggaggtggaggttgcagtgagctgagatggtgccactgcactccaacttgggcaataggctgtctcaaaaaaacaaaacaaaacaaaaacaaacaaaaaaccaaataatatattctactttaaagagcattttactttctttcgatataggagaatatcgataattatgtattatatacagctggaaattaaaagatcaggaacaaatctaatatttgacatcattggacttatttgtgtattttgaattaaggtcatttgtggtcaaaattagttaaaaggattgtttatttagtcatgttcatgtcatagatttctacaaagagattatatagtattttatagcttgaaatgtttctcaaatatataaaatgatttttggccataataaccttgactcagatttatactctacaattaaattagtcttggtggacttttcttgttttttggggctttttaattttaaaaatgtttagatacaaagtctctctgtgttacccaggctggtcttgaactcctgggctcaagcagtctttccaccacgccttcggagtagctgggactgcaggctcttgccattgtactcagcttaaaaaagtaatttccttatataaactttatttttgtttagtcttactattagtctataaaagtttaccatggttgccagactttaaacaaaatactaaatttttaaaaaattttgttttggtttgtattttctgatctctaacatttttattgagatgtaacttaaataaacaaatctgaagtgtgaagcttagtgaattttaaaatatacactcttaaaaaaattgaacatttgcatctactgacaagttttcattaaactttctgtgttttattattattttcatagggctttagaatggaagtgattttagaagtttactcaattttcctcattttgtaggtgaagaaaaggcatagaaaggttcagaggcttaatttcttcacatttatgaaatatttttaaaaattgtaattggtgatagaacagttatggagattttattaaggatttgtatattatttaataacattttatttaaatgtataagcagtggatctgagttgctttcttcagttttgtgtatagttctgtaatgcagtatgatttctttcagttcttgtttgaaagctaagcttttcattttgtctctgttacatttagtctttcttgtaacattctatctaaatactgtttgttacaaaattagctttagttggattccttcctccctttgtttggcagaaagtaaatgaatttagggcagcggtccccagcctctttggcaccaggctggttttgtggaagacagtttttccatggattggtagaggtggttgggatggtttcagatgaaacttttccacctcaggtcatcaggcgttagagtctcataggagcgcataacctagaccccttgcatgcacagttcacaacagggtttgtgctcctatgagaatctaatgctgctgctgatctaacaggaggcggagccccaacggtaatgctcacttgcccactgctcaccttctgctgtgccacccattcctgatggggtccaggggttggggaccccgatctaggggataaaccaggaaagacttcttagaggtagtagcatctgaagaataaaagtttactgagaacccagaacccttgcaggttagggggcaatgcagagtgaagatcatgatcaatggccagatgcgatggttcatgcctagtaatcccagcactttgggaggctgaggtgggtggatcacctgaggtcagatgttcgagaccagcctggccaacatggtgaaactaaaaatacaaaaattagctgggcatggtggcgggcgcctgtaatcccagctacaggcaccctcaggaagctgaggcaggaaaatcgcttgaacccaggaggcaaaggttgcagtgagctgagattgcgccattgcactccagcctgggcgacaagaacgaaacttcatctcaaaaaaaaaaaaaaatcatggtcaaaaacataggagaggctgtccctgtggctcacacctgtaatcccagcactttgggaggttgaagagggaggatcactagaggccaggagttcaagaccagcctggccaacctggtaaaactccatctctgccaaaaacacaaatattagccaggcatggtggtgcacgcctgcaatcccagctactcaggtggctgaggcaggagagtcacttgaacctaggaggtggaggttgctgtgagccaagattgtgcgactgcactccagcctgggtgacagagtgggaatctgtctcaaaaaaaaaaaaaaggctggaggtggggaggcctggggacgtatgggatagttgacaggattttatactgtaattactttaaggcctagattctaataacatacataagtatttaatggcactttttggttttgtgcttcatactttaagtttctgatgtgtagctagttaatatagagctattaaccttgttcattagtcaatttttccaatgtagtatgccaaccagtattagggttacatttataacttttttcctggagagttgatgagttaactaccatattttcatttaacttaaggtagttttgaaaatttctaagcattatatcttaagattcagaaaaataagaccagatccacttatgaatttccattccactcgtgacctgacaagtcgtataacctctcagcctcactttccccattagacaaatagaatgaaaagacctatcttgcagaactgtgataaagattaaggaatgtacaacataatttattattgtaacacaacctattaatcatttttatgtattttctcttatttgaattttaaaaattgaaattatggggtactagaggtttttttaatcttgcttttttcagaacaagcagcatggtggtatggaaagaactgctgtattagaactggctgtgcctggttctgtcactcactagcttatattgtattgaaaagtcccttaatctctctgagcatcaagtttctcatccatagaattgtgattataccaatgcttaaattttgtgaggattagaagtaatatttgttaatcatctagcaaaagtgcctgcctggcatatggtaggggctcatttatgatgatgatcatcatctccagtattacggtaaacacttaacaggataaaagctttttagtctgaaacctttgacaaaaacagaattaaggttgttccataacctatcatacagttatgtatcgcttaacaatggagataggttctgagaactgcaccattaggcagatctgttgtgggaacatcatagagtatacctacagaaacctagatgggatagatgactatacccctaggctatatggtatatgacccattgctcctaggctatacatctacctgtatagcatgtaactgtactgattgctctaggcagttttaacacttacaagcattcatgtgtctaaacagatataaacattgacaaatacagtagaaatatggtatgaaagataaaaaatggtatacctagatagggcacttaccatgaatgtagcttgaggactggcagttgctctgggtgggtgagtgagttcgtgatgagtgaagtgaaggcctgggacagtacactgctgtagactttataaactgtacacttaggctacactaaatttattaaaaaattttctccaataataaattaaccttagcttactgtaactttataaacttctaaagttttaaaactttttaactctttttagtaagatttaagatacaaacatagctgtataaaatatttatatccttattctgtaagcttttttctatttttaaaattgttatttttttaaaaactttttttttttttgagatggagtcttgctatgtcacccaggctggagtgcagtggctcgatctctgcttactgcaagctctgcctcctgggttcacgccattctcccgcctcagcctcctgagtatctgggactactgccaccacacctggctaattttggtggtttttttgtatttttagtagagacggggtttcaccgtcttagccatcatgctctcctgacctcctgatctcctgacctcatgatccgcccgcctcggcctcccaaagtgctgggattacagacgttagccactgcactggcctttgttaaaaactaagacttacactcatttttctaggcgcacacagggtcaggatcattaagatgtcaggaggtgataggaatttttcagctgtattataatcctacaggaccactgtcatgtatatggtggtctgtcattggccaaaacattatgtgatgtcttactgtacatccatcatgagaagccataagtagctatccagttttttctggctaaagtaattttcaaagcaagaaaggttttaaacttctttgagaaaatttagagtttatttctaggactttgtatattttagaattcacgttggtgatggttgggatgggggtttaggggaggtgctctcctccagaagaaaagtcaagtgtaaaatatataattccttttatttgtcgtgtagatttgtgtaggaaaagacataataggataggcctaggaagaatttttttatatgaagatttttttttgaagggcatatataattggaaattgattattggtatatggagagagagaattgtacatgaaaagtactataacttaaaaaaccttacagttaagaggattagttgtaaccaaaggacaaatttatgtcagtctagtgattagtcctatcaaaaattattctagctttcatataacctgttttttattgcctgttttatctgtgacatgttgacatcttccttctattagtttttgcccaaatgaggtgtgggactcctagtgaaggtccttggaaggattatattttctataaaactttattagggacatgataacagttctgaatatgtgagaaaaagtaattgtatactattaggtgatgcagtttgtagctaggaaatgacagagttgatgctggtgtgtcagagtaaaactttccctttgtcttaaagcgagtgaaccttgttaggtactaggaaacaacaacagtcttttggttattctggggtttcaacactggaaatatctaataacagaattattctgaaataattgaaaactattttaaataaggaattgaagataattgaatatgcagtgtgaaaggtcaggctgcaagtgacagtgggtgatgttgcaagacaatgacaaggtacagtgcttttggattatcaggaattagcaaaatgatgtcttggtgtcctctggtaatttctgagttgtgaactatcttgcttatttatatactttggcaggtaatgaaataatgaatgtaaaattttgaattttgtgtaatcacatttcttaaaccaataagttagaaaggaaaaccaagagattgcatccacaagatcaggcctaaataggtagtagaaagaatagaaggtctttattttaaattttatttttaattcagaatgggcagtgtctaatcacaaatgagattatagtgaatgtaaatcttaatgtaacaaaggattatcttgccatgttcttaaagtttccattttaatgagctttagtaacattctaaaacatgtagcaatctgtgcagtcatccgtatgtgacatctgcttcttcatgaagtgcatttctaaggtaaaactattggtttatttgtatgtatagttaggaaggcttataaaactttttttttttaatgataggcacaagtattatgtagttagattttttttgtttctggaaaatgttatctactttgaaaattttaaatctataaacacttgggaaggtgtttagcacaagcatcaataaatgtttcaatcagaatctagcaagaaaggattcttagaaacttttactcctgtacatgtactgtgtaatggatttagagaaatttgtttcctcctaaaaaatcttagcaatgttgggttagtaccatttctttccttgaaaacaaaaaaatccacattttttacgaaccagggccccttaaaactaatctcacattatgtcttttttttaattattattgtttttgagacacagtcttgctctatcgcccaggctagagggcagtggcatgatcttggcttactgtaatctctgcctcccaggttcaaacaattcttgtgcctcagccttcccagtagctgggattacaggcaagtgccaccacacctgactaatttttgtatttttagtagagacagtgtttcaacatgttggccaggctggtctggaactcctgacctcaagtgatccttctgcctcagcctcccaaagtgttggattacaggtgtgagccatcacgcccggcctcacattatgccttacccaattattttcagattggccttcagccatagcatatgggaaacaatatactgttagagttttccaagtgcttttcatgaattttttttccctttttaaaatttaatgctttattgctaactttcctgatctgaaacatttattaggcagttcttcattttcagttgtagcctttaagatatttatatagaaggctgtcatagaatgccatcttcttttgtaggacagttgtgtgtgtgaattgattttttttttttgagaccatatttgtagtgtgatgtgtagaaggaagtaaccagaatggttttatctgcttctttgccctacattcaaggtctgcttgtgatagtatttaaaattgagttcagtgctgagttcaagatgggatttaaccagacttttacaaaggtagcatctgtagattttgtagcagtctactcaaggaggtgattaatcttgagagactagacagatttcttttaggtcaaattaaattttaccattattgctgtataactccattcacctatctttgaaaatatgtttacatcttggtttttatttatacgtttatttttaaaaaacatatttctaacatgttttttattacatgcttcactagaataaaattttcccaagttattattacccagtttatcctgaaatcttagcctcaggcagtcctcccacctcggtctcccaaagtgctaggattacaagtgtgagccaccgtgcctggccccagtccatctaatgtatgtattagattcttagaatattactatttattaagtaaagttatatttctgatagcttaattactccttatatgacagcataaacactatttgcctggcactactttttaggcattccccagaccagtttgttaatttcattcaaactttagattccagttcaagtataaaactcaaattctgccaaattattaatatttcagatatattgagtttatattatcgtcttttgtagttatacttagtcttatcaattattgaatttccctaatgttattattatttttttttacaaagtcaaactttagtgattctgcagttcttatggtgacttacgatttcttacattattactcttcagtctattattaaatcaaattccaggatggagttccttagtcgttacattaaaacagatatatggaactcccccctacttttgcttaagtcatagtattccatctgtttttaatgctgttgtatttttaacataaggaattacgtggttgaataaaggaattgtatcggaacacagtcgtgtaacggagttacttgaaactaaaaatatatttcttatactgtggaattctaacatgttttctgtagctgtagaccttaatgtattctgttaccagatttttatattctagcagattttattttagaataccaaacacatttttaattttgaagagtatttgttttgaacatataataaatgcacatggttaaaaaaaagttgaagtattataaaaagttacccaattgtttacttcctttctatggaggcaaccatggctaatcagtttctaacgtatccttcagagatcttttttatgtggtcaaaggttttacaagggttaatgtcttaagatgaatattttagagtttgacatcaaaagactcatttatactacactacctgagattttaacaataaaaataataatcttactgaaatctaaaacaaatgtgaaatttgtaattctggccttggaatattgatttaaatataagcatgttaggcctttattgacttaagtaattctgttttgtttgtaatatgttattacccagtttgtgtatttatccctataatttaatgaacctcctccacctttaaaaaaattaacagtattaatgacaatgaattattgacttgacaaacatgattagcacatcagaagattttatgacccgtttaagggtaaggtagcattcctatgcccctcctccactacattttcagtttcttaggtaagtgaaaataattgttttcctgagatcaggttagtttatatttggaggaaattaccttttcttagtattttcaaaattttttttcaaaatttgttgtaacattgcaaaagcattttctttcaaaaataacataggttataatagataatatctgtttacattaattctttaaattttcttattattgagattttatgctttaactgagtaatttaacaccatggtaattggttgttgagagaactataataggaaattttaagtgaagtaaaaggttttgctttatattatcttgtggcagaactcttacttgaggtttttgaccaaaattaaaatgaaaaatttttaatgacagattgactcctgttagtaagtagctctagagctagaacattatattttgcattatattttctagtgatatgtttggatttctttatgacaggaaccactgctctgagagtaaaacgtgaatttattctgctaatagcaaaagtaaacttttagtccctctactggctgtctttgttgtagcagagcttagattttttttttgttttaaatatatcattataattatgataaaggctacttataactttatggccaaggtgaatattgacagaacttctaaaggattgtctcccaactgagtgactttataaacatacttacttaggaataacaatgtaaaataattgctcttaaatataaggatttgggaattattaaattgcgtaggcttgacaccagatagtgaataacattatattgcagtaattaagttgtaactctcatttagactttggaggtgttaaaactttatttttttgtaaaacatgacaaaaaacaatactggcagacaactaaaacttttttaatttgctgggtaaacaatgttgacagagaaagatgacattatgcagcaagaaacagtgcaaaacagtatataagaaaactttcttggagctacatgttcactttctgctagtgatgtagaaattcatgcttaaataaatttgttaatgtcaaacatttatataatagagatgggggcacatttttcctgaagaaataataaaacaaccttgtgtgtataaattacattaacttaatcattattctaatttttgtagtaactgattattgcttttcttagtgtgattcttgactaagctctttaatcttagaggggaaagaatcttaggcatggcgggataattggtacaatgaggatgataataatatttttcttttttcttttctatgtttgatctttatctgacttttccaaaatttaaagtcactaaagaacttattattttatcttgtgtttgtgtatatactctctgaaagttgaagttatattgtttttaaaagtaaacattagtatatattgtgttttgtttcagtgtgtgttgggggaagatacactgattttatacatcaagaaattaatggctaagtaattacagaatcacaggaatctaccaagtaaaggaatagttttactatagttaattttattgcagaaaggatatattaaaaacaaaacaatctgattataatgccattccttgttgggtaaatgtggcacaatccaggttagtatggaattatgtccaagagaatttagcagctgccaataggacctccaggtggtacagaaagaccatgtggattttagaattagaatagcttaataaggttctggctttgccaccatctaggccaccttgagttatatcatttaatctccctgaatattttacctcactaagtttttttagggtcaaatgagataagtgctttattgttattatcaagacgatagcagtaatgttattgttattatagtaatttcaggcccgtttaagggtatcctctgtggagagtattttgtgtaagactagtcaagtttcaactaaaagctttgttttgttgtctaagaaaaagtaactttggttttagtgtttgaatttagcttaattaaatttaataactcagactttctgttaagttttaatatattttaacttaattttgtagacatgggcctttaaaaagtattacctttcgggtggatgtcatcatctatatgagtctgctacatggtagattatttttctttaattagaagtatgattaatctcttgcctctgaaagataattctaagtgtgcttatacaggaataaaagtgaatgggtgtcagacttttggtcagaaaatctgatttctttttttgagacggagtctcactctgtcgcccaggctggagtgcagtggcacgatcttgactcactgcaacctccaccttctgggttcaagggattctcctgcttcggcctcccgagtagctgggcactacaggcatgtgccaccacacttggctaatttttgtattttttcatggagacgaggtttttcacagtgtttcctagactggtctcgcagtcctgacatcaagtgatccgcgtaccttggcctcccagagtgctgggattacaggcatgagccaccactcccagcctgattttgttttatgttaaaatgtagaagtgatatagaagaccctactacaaatatttggtccatgctgtggtggcttttagagctttgctgatttgtttttgaaaggcaccaagtcaacaaaagtagtttagcttaagggtggaagcaagataatatagtttcgaagctattaggacctcttggttttctttatctcccttaggcaatttttgagctaaaatactggtagagaccaagagagagatttattgttatgtgtacatatgtttattatgtatgagagtagagattatatatcatacacttaatagtaaccactcaaatctttgaatggccaacacgaatgagtagatagtggatggctgaaagacacaagagggagatagtgctcctttttatactctagtagcccagcaaattcatgagttgttatgcgttgaatttggggagtacacatttatattgaggtaaaggtaacatacattttttgaatctttttgaagtttgagtaattctaaatggttctgtgaacccaggctgatttgtattaagctatattcagtgagtcaatgaataagttgaagtgttttgtgcccagtacctgcttagtggtgtggaaagaaatatgacatattctttgccttcaacatattcaaacacatgaaaaaatagcaagcaatacaagatggtgtttttttttttttaataaattgtggtaaacacaacaaaatttactgtcttaaccatttttaagtgtatacttctgcagtgttagatatattcacattgtgtaagatggtgtgtatttaaattcatatttaaattaaaaattatttgaaaaggtgggaggatagatgttgtagggaagtggtattcaaattgtgctccatggaaccactcaaatccaattttaaagaaacattttatttaccttatttatttaatttaaagtgtaaaaactaccactattagaatatggagatggaaagatgtgattactaaaggccatagtaatcagggaaggcttcgtggaaaatgcagagatttaaactgggccttaaggaatgagtggcagttgggtaggtttgaggagggaagaggaaaagcattctactttagggaaacaatcaaagctaagagttgggaatgaacattgcctgagaagacctatattattagaatttattatatattttgggggtgaatggtatgagagacaatataatgtaatgtaataattccccaaaatgagttctttttaacatgaatattacagaggaaaaggagggataaattaattcatgttttctccctgcaagactcctgtgacattttaatgctgctatgcatttagaatcttctagagattatatctaacatattttaagtttatttaaccaaaggaatctttctcccccggaaccatttttttcttgggcaccaattagaaaagtgcacgtgtcacttacaagttgaatgatttgatcaagacgatctattacatgtcccccttcccactttacgatgattaggttataatcatataactaactgtgaattcattcaataaatattgcgtatatattataatatgttaggaattgagagttgtaagagaaaggttataggaccatagaatattatatgtttataactcttctacattcttgttgttctaagtatggtctgtggctattagtgtcttctagctgccagtcttgttagaaatgaagaatcttagtcttcatcccagacataatcagaaattgcattttaagatctccaagtggctcatatgcacattaagaaattgtcatacacagttctacattttatccaagaaagcttcattcaattcttggtaccattagtggcagagaatttgatacctttgatttcaaatacaaggtttaccctcttgaaatttatatcctttggtcttagttctgtcagtccttcaaatgggagccatttatatgtaaaaggcaagcttatgtttgtcttagtcccttacagatgtgtcgcctagaactcatcgttgtgctagtagagtgggttggccagagatttgaatggaagctattgaagttatctcaccttctatatagagcatttgagaacccgtgctactctgttccattgcttttgctaccactatttttgtacttttctctccaagcattttctttaggtaaccatttttaattttaacttttcatcttgtactgttgttaaatttttgctgaatttagagtagctctactatttccatagaaatagctcttaaaatctttcaaatcatttacctagttatttgcttagacatttcgattacatgcataccttgtggtaatgttcacctactgtcttgccttcctttttaagaaagtttctcaggaaatgttctttttttattgtaacttgtaatatctacaaaaatcaaattattagaattgaactactagggtcccttttaagaaattaaatactcttagtaacataaatatactccctctaaaaatgaaagcaatacacaaatttataaagaagtgaaaaatccacctctttctctacctaatccctctttctcagggttaatcactgtttagtttatgtgtcgttctatatcttttcttaaaatgtacaaacaggtacatactacatgtaaaatgaaactagaaagggagatcgtatatatgctgttctgagaattgactttttactttgtaagccaaagtctaaatctttgtatgatcaatgtgttttttgactttagggaagaaacccttttttcttggagccagcaataattatcacaattactgatgggagcaagttgactaccaccagtggagtccaggatgaggtaagttgtgcttatattacatggattatgcaaatgcagttgaacaatcctttatttttgtaggatactgaacacctttaataggttctctcgttgattatttgatgcaatttagagtcatctgtctcctatggcccatctttgtttgtagcagtgttcttattttcttgaataagaatctcttctgtgagaaatgtttgagcatacccacacctcatttgtatgtgtaattatgagtttatgtgagggtgacagtttcagtctgtcataaatagtaaaatgaattccttagtttttttcagatttaaaaaagggaaacagcgttctagtaatttcttcctatatttcagtggattgtcgttggcagtccagcgactgtggaaactccttggctagagtatagcaaagccaagaagaggtgttaagactaggaaaagtaaggtttttcgacatttttgttttctataagtcaaatgtattatacatatatatatatatattttttttttttttttttttttttttttgccgggagataccaatatcgtctatagaccaaaatcccttgcaagtgccatcattttnnnnnnnnnnnnnnnnnnnntatatatttttttttttttttttttttttgagacagagtctcactctgttgccccggctagagtgcagtggcacaatcttggctcactgcagcctccacctcctgggttcaagcgattcttgtgcctcagcctcccgagtaactgggattacaggcatgagccaccatgtctggctaatttttgtaattttagtagagatggtgtcttgccatgttggccaggttggtctcgaactcctgacctcaggatccacctgccttggcctctcaaagtgttgggattacaggtgtgagccactgcacccagctgtataaaaaatttatagctaaccttatctattctacagcaacattcattatgcagagttgtgtgtggtgtggtataatgaatataatagatttttttaattttaaggtgtttttactatggtatttgaactgctctttaacatgggctgatatagaaaggtgattgttttgatggagctttattgtttgcatttgctttagtatcttaattcccatggtatttataagggtttaattaagcaggaaaagtatacattttaagttcagtagcttttagaattactttatttgtgtgacattgtggaatacaaattggacatggagtcagggcatgtgggtcctagtctttgtttatctactttctagcagtaaactttgtaccagtgacctgacttcctaatttctatccttctccatgaaataaagagaataacatttgccttacttcatagggttattggaagtttgaaataatgtatatgaaggtacttagtaggctgtaaagagaagtatatagtattattctttcatgaggcattggaaccactaaagagatataattctctgctcttatttgggggaaaagagctaaaattgttttatttgaacagttgataataaagggaatttaggatataattcatggagatagagctgaaaaatttaggtagattataatccatgattaaataatttatagtctatatataatcagtagccttggaatgctctgtagctgaacttgatgggcttttgggctttgttagattagttgacatgtacagccaattgtggtcctgctactttcagaaacaggtagacgtggattatataaaaagcaagcaataaaaattcattttagccgggcgtggtggttcacacctgtaatctcagcactttgggaggctgaggcgggcagacatgagatcaggagttcaagaccagcctgaccaacatggtgaaaccctgtctctaccaaaaatacaaaaaaattagctgggcgtggtggcgcacacctgtaatcccagctactcaggaggctaaggcaggagaatcacttgaacccaggaggtggaggttgcagtgagctgagaccgtgccactgcactccagcctgggcaacagagcaagactccgtctcaaaaaaaaaaaaaaaagaaaaaaaaagtcattttaaatttgaagctctcaaattaatttttcttcttaataggacacataatagttaacagcttcattcaactttatatattaataaattaaaagtcttttgaatgtttgttttgtttttatccataatgattttgcttgagaagttatttctgttttctgttgtaaagtattcttatgtgcgaggtgatgcatttgaggtgctgtctactgcctttgtagaaatgccctttggggtacaatgtattttgtttccatatgtctggatctgttttgtttgtaaaatttgttttgtggagacctcttctagcttaaaaatatcttgaaatatacatgtgtattggaattgctcacctttcttcctatgtctttccttgggaaggattttggaaaaatagggcaatgtgtttataacctgaaactaccttgctagtaaggttaggaagattttcctgtgggcagagtttttaccttttagttctatcttttacaatactagcatagtattgacaacagagcctatatttttaaaaagtattgattataaacattggtgtattgaatctggtagtcattgagttcaaaattgattaccgttgcaccttattatctgaggtggaaggttcatttgttttaaagcaaaagtaaattattttgaagttggaacataggccggtgagttgtttcaaggttaggaatgtctttgattccctgcgtgttttcttcttaatgtaccaacgagactctcgttggagcaatgagaaagttatcctagattaatttttgctaaatgttgtgagatattgtgaaatattctagcctaaataattatgggatttgttttaaggagcttttcaattcatagaaaagcataaagatgctttttgtattgttcttctgtgtttgtattgtgcacgtgcatgaatgctagatatgatctgtattctggttcctactagggaataacaattttgcctttatatcactgtcttttcacatctctcaacctttgcctctggcagaacttgattcttttttagatttattcagtgtatgaatgtgtcattaatttccacattagagatatgtgtacataattcctgtttggcttgtggctggtgttggtatgacctattactttttatggagttgtataattccacctgtatgatatcctttgcttaagagtcatgttatccaacattgtatattatatctgttctgttggtgctgtttttcaggagtaaatgttcttgctgctttaaaatcatccttatatcatatgaggaaatatagaactcatttagtcttatattttacaaatgagaaaattgagatccagggagtcagagtgatttgcttaggttataacatttgttactgccaaaatctagattagaatttatcaattccaaagacattccagcacctccagaccagtgctttcttcctgatacggctgctgcctttttgcttgattctaaatttgtgtgttcttaaaatttaccttctatttatctgatttcttatttgtctacttcagctttctatgtaagtgtcttttaggtattctgttcttattcagtgttccatgaaaaactattatgaccagagcatttctaggcaatgaggataacaaagataaacaggacatatctggttcttaatatttaagttcacagtgttatgggggaaatcacctattaaatggttttatgaatgataaaataaggatacatactaagtgtgtgggagtactaaagcaggggaagggttaatattacctttcgtgtgtcaaatcttgtataatgtgcatttttatagtataatttcatttttgaatgactgaattcaaggatcttatggatgatttggcatagggtgtggctcctaccttgtatctgtgaattttaggaagaagcccagtgtaaagttgttttgagcctagaaaatagttttcctagcggcaggaaaaatgtggtgccatattgtctcttgacctggctaagtatgtataggcccaaatgaaccaatttcttataacttgtttgtcagaaaaatgtaggaatactgttctctgggacagctcgtcacttagcaatgtgttatgagttaggaaagaaaagtaatagatacattatgaatgaaaatcttgagctgtatatgatcattttacattaatttatgatttcaattatatccttgggcctcatttaataaaagtccaggccattgtctgaagtgtcatgaatgtatttctagtgtagtctttttggataactgtctaggatttctgatgattacttggattgaattttatgtgtatatatttggctttttttttaatgcagctatttgataaaactggttgtagcattttcacttacgaggagtgtgtttgataggactttgaattctgaaacacgataaaactatattacttacttccttagtagttaccgttgatgttgataaacatacctgtgtccagatactcagtactgtttgtcatgttatataactgatatatcaaatgttttggtagaatcaacaaattagagttattgaaaaggattttcttctgatatctgcagataatcctctctagtactgctttgcaatggaaaactattctgtactatgattccaggaacacatggctaatgaatattgctcaatagaggagcccagaagaaatcctgccagtactttcttagtgatgaatgacattccaggatagtgtagcagttatttttctcttccttgaaagtgctaatagtagtattgtctttcaaatattgagatttctatatgctgacaagtccttctgcatctctttaccaatgttatgattgctgtggaggctaacgttgagagaaggtatttgcagccaaagtaatctgttgggaagagttttacttgcttattagctgtcccagctttttaagcccaactaggacaactacttttgtaacttcatgggatagatattcggtaagggcatgtcttcatagaaagagaatgagtagtctcagctgtgtattcaaatggctgtagattggggtcttctattccaacttgtgggttctcaaaaatggatgcaaaagtccaccatgctttgagatatggataattctaggcattgtaaatgggtttagtttaactggtgaagattataattatgatgtgcatttaattcttaatgattaaaagacaggccagaaatttttgaaatcagtttctagtatctgaaatgattaaaaaaccacagctccctcccctacctcccataaaatgtttttattcactaaaatcactaaaaatatttgccttagggtgtcaaaactctgatttcattgtatacttttaaatatatatttaaaatagttgcttttcctaagacacttagaattttggagaactttctcttttttgaaaagatctgtaaggaattttgagggatgccacagtggtgtgatagaaaatataaaacattttatctgtgttacatgtgtttgaattttcatgtttatcctgtagtagcctcttcatagtgatattactagggactcagtaaaaatctgaagattagctcttgtcttactgatttgcgattcagatgttctaaatacatgcataacactactgtatatgttagtctctgtcaattcatctttctaagaacatttaataagaatttgttgaatgtagaccatttgtatttctttttctactcatatttttggccctgttctctcaacccctggatttattactgctggtatgttataggaatatatacatctgcaattattagtagtttaaaaatatgtaattataataatgcataattaaagaagttgatgaaatatttcaatttaatatagtaagttttcagcaatttacatttgcagtactcttattgatatactttttttcaagatcatgtagtaagaaagactcttcagtacttctaggcaaacacaacaatggagaaatttaaaagaaatgctggttgatcattctaacaaagctgtatggccacagtaactaatccgctatctagaattctttgttaagatatatcaaaatagtttttattcagagggtgaagcaatttcaccctgtgtttattagcctgttagaaccaataagcaataagagagtctacatatgtaaggaaaattttatttagagatgtttctattatccaattctagctcttatatatataaagtactgtggtatttagaacagtagctttgaaatggctgcaggctgcatcaaaatcacctggtgtgccttatagaatacacatgcctttgttcttattctggaaattttgtttcagttgatctgggtaaggacctgggaatctgtatttttacagtgtctcatgtgattctgatgtacagtcaaatttagaaactatagttttagaacacaatctaaccacaattttttttaagctacacaaaaagcatgtgaaaatgaacaactttaacaaaacaggttagaaagttagaaatgtttttgacttagaaggccaccaaaaagtatttttttaggataaaaataattcttgacctttagaattgttaaatttgggaacgggtttccaagggatatggaactggccttctgtgaatatttttaataggataatttctaatttgcttgatattttagaataagttattgaatagcccccaaaaattaacttctgtgctgactgcagtcaatctgcagttactgcttacagtgtgctatattgaggactctccttagaccccatatatgaggagagaggctaagaagagaagagcagttaatttatattatctgtcatgtgtttcttatccctggcttaggaatttttatccaaaggatggtatagtattctggtatccttactaagccataattcctgatttggatgtccatgtaattagcattatacacacacacatgcacacacacacacaccccctaccttaccagatgagagcagtttataaagaattggtgatagttacacttaattttctagacagttgctgcaaaaatacccttccagaatgaattcgttagattttgaattgtgaaagtatattttaaattaattcagcaacagttttccttgtgatacatagttactttggctgtgtataagaatagcggcagctccatacgtttatatttagttctatatttatgttctaggtactggggacacacagatggaattaagcaaggctagaaaacgtattatctttgaagacaggcaagtaaataaacatttgtaatacattaagataaatctcatggcagaaataaacagaaggttctgagacagcgtaaagaaaggagtaaagttttgagggaagagtaaggaattgagccatgacatatcaggaagagaaaacagtatgcaaaagcatgaagacttgaaaacagtgtatcaggagattataaattgtacacctggagtatggaaagtataggtaggaagagtagaagcttgaaatgtaggtagagggcaggtaatagcaccctaaggagacaggacttcattctgttagcatttgcagggaaggtattgaagattttaagcaggtgagtcacatgatcagatttgcattttagtaagattactgtgccagcaaggtgaaaggtagactggagggtggtaagatgggaagagttagcaaactacatgtaacaacctagaagatatggggaatgccaaaacttagctagtgctggacaggaaggcagaattctgagaggttcggtaggtaagctaggcaggttttcaaagatgatttgtaagataggagaaaaaaggcaaagtatttgacaggagccctgaacctagggtccatgcttggtctgaggagagttctgtgaattccctgacatcctgtctacacattgtccatctgtgtgcatgaacttttttctgggtaaagagatccatagctttaatcatattctcaaataagtaaaaatatactggtttagtattattttccactttccaacttgggcatctatgtggatatttggtagtgttaactgagatgtgggtgataaaaaataaaggaggagaaaggaaggtaaagtaattgacagacaaagtatcattacctttcgtgtaaggatgttttaaaggatttataatttaacatttaaaacaattacctcaaagactttttcttgccttttaacattatgttttaggaaaatattttgtatttaaaaattgaaatgagcagattctgatagttaaattttttttttactttgaagcagatttaaataaataagcgttaaatcagcttttaaagtttgtttgaaatttaaggacatatgatatgaacatttaaaattgcttatttcaagcaaacattgaaaattctacagaatgctaggttaagagcagtgtgtgtgtgtgttttactctgtgtactggtgtcaagtaagtcagaggatactagcctaattttttatttaatagattggcacttttctgttaaacttagcctatttgggtgtttcatgcttctccatgtcagatttcaattttgagagaatgaaaatgttgagtatgtggttttctgatggtgcactctcttgtaaataacccttaggctgctagtcatttataaataccttgataatacttatttagctgtatttccatagtgattttatttaacttccactttcacttgttcttttcagatgtaatactgtagatattaaactttttagacttttatattaggaataaccttagtgcagtgactagaaagacattgaaactatgggctttacatcaaggcaaggctgcattttgatctagacaaggctgttttggtatatttttccccacgctctgtcttttcagattgaattactgatttttccccctttgttttgtttgttgtggttttgatgttttttttcctttcagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaaggtgagcagagtagagtgtagttctctctgggggctatgactatttgttggagaatctgattcaacatagaatgacaaccctaaactgataaatccaggttcaattggtaattaactttgagcttataaattggttgatgatgattatcagaccccagcttttgagttagtagaaccaccttgctaagcttaagatctgtaagtgaggaactcggtatttcctggggctcttcacagctttaggttagtatctgttgtcttagaccgaaatagccttgctatcatagctaaggaacactttggttacaaaattgcacttggttgttaagtatggatagttttttttttttttttttaatttagctagcaaggtattctcttgatttgtatatttattagataccagttatttggtattaccaattatcagggtttggaaggataagtttgcatttgctttgtctgttataataaccttttttaaaaaaacatagctacctttgaaccaagtttggatttatgtagctcgtattttattgcattctgttgaagaatattagtactacctgcatcatttcaatgacatttttagcaccagaaaaagattctccagagatgttttgagtattttggaaaaagtttaattctgggcctctttctctgtgatttgaagcactcacagaactcagttattcatgtaataacattgattgctaataacgttgattactaaatttaaatgctaaagcttgtcctaagacttaactttttttttttaaatgaaccacctatattagtaaaaaaaaaaaaaaattaagtatgtaccattcccagtgtatgcacatttttaaatttagaaattatatatgtgactactgcattaatattattatgttaaaaacatatattaaaatagaactttaaaaagatgagaggaaaaaatttatacaaaggaaattctgatctttgcttcttgaataacatggatcatgatttatactaggggtcagcaaacattttctttgaagggccagatagtgaacattttaggtttttcagcctgtatagtgtgtactggaactattccactgttggagggcaaaagcagccatagacagtatgttaaatgagtgagagtggccgtgttcaataaaattttatttacaaaaaataggctctgggctggatttggttggtgggctatagtttgctgatcgctggtgtataccctgttttgtagactactgttctagaccttggagttgtattgtactacttctgttagatccttttcacattagttttagagagtggactttatggaattgatttttcctttatgaagtgggtagaacaccactagtagagagtattcagttaaagtgaacagatgcttattgaacagtagtgaagttcagatgcagggttaggtactggctcatgagtttgatatgagaggtacagttatggcatagtgtaagatgtaaaattattaaagcacaagctaataagatggtacagttgagaaagtgaggccggagctggctctaggaaatgtcttgagttggattttgaaaggttaattcaagtttgtgaagtagatgtatgcaaagacataaaggtcactgaagagagtttgggagaactgtatgtacctcagtattgatagctggcaaagtgttcaagaaaaacagcagcaggaaatgagactagatagattggcatggcacgtcctatattctctgccaaggagtttcgactttgtcttacagattgatgaaaaccttatagattgaaccttacagatgggaaccttatggattgaagagattttagtagaggagaaagttattagatttgcattttagaaagaagtagcgtggactatacaaagagcaggtttttttggcacctcatctgttttcacttcctcataaaagaggacatgattgtaggttgaactataccagacataaaattaagaaacttggagtgctatttagcaataaaaaggaatgaattgtgacatgctacaacatggatgaacttgaaaaacattaccctagatgcaaaggacctcatatagcattattccatttatatggaatgtccataaagttgattagtgcttgcctggaagtgtttgggagactgactgcaaatgggcacagggatctttttaagatgttggaaatgttctaaaactgcatggtggtgatggttgtacaactctgtaaatttactaaaactcgttgaacacataaaatggatgaatttctcaataaagttgttaaaaaattagaaagactttacctttgcaatttgttggggtaaaactttgttgaagaaagtatttcagtattgcaggttgtcaagtgattgctctttcctctgaacaaatattgaccttaaactactagaagctaaaaaaaagttttgattttttaatcaaaaattccttttggatgtacattggatattcctaaggatacacatttttaactgtggagtgtaacaataggaactaacaataaataattgggttggcattaagttttatgggattcactttgactttaataattttttttgagacaggatcttgctttgttgcctagaatttcttaattttcctttccttaataaatatgatatgaggagaaccttcttcattgcttatattggataatagtattaaagttagaaatagcctaagggaaatttacttgatttttttttttcaaggaaatatactaaagaaaaagctgatataggatgcttttaaatttataaattgtttcctcataatcttaacagttataggaaatgaataaagagaatgcaaaacaattggaaaatggttaatttcattcaataaatatgtatttagggcttaccatgtgcctaggcactgttcttagaaacagattgtgaaggactgttactgtattactttcttttattcctggctactaaaataatgtatgaggttgagcttaattattttaaaaaatgtgtaaacttaagtgtttaacttttattgtttacaaggtaatttcacatctcctgtaattctcaattctgtgacggtgaggaaaatgtcttagtaaggctgatttctacctaagaggcagagctaggacttgactgtttgttttattttttcaggtccattgctctttacactctagtgtgggattaaaagaaaaaaacaagcaacagtattgtactgcataaggacagtcatataggtcagtgagatagaattgagagtctagcagcaaaacacatacatttatagtcagtcgatttttgacaagagttaagacagtttaatgagaaaagaataattttctggccgggtgcagtagctcacgcctgtaatcctagcactttgggaggccaaggcaggtggattgcctgagctcaggagttcgagaccagcctggccaacccggtgaaaccccatctctattaaaaaatacaaaaaattagccgggtgtggtggcatgcgcttgtaatcccagctactcgggaggctgagacaggagaatggcttgaacctgggcggtggaggttgcagggagctgagatcgcgccattgcactccagcctgggtgacagagcaagactccgtctcaaaaaaaaaaaaaaaaaagaattttcttagcaaatggttttgggccaactgaatatgcatgcacatgcaagagaatgaaattgaacctctaccttatatgcaaaagttagatcaaaatggatcaaagacccaaatataagagctaaaacttagaagaaaacataggcttaatcttcctgacctaggattaggcaagttttagttagacatgacaccagaagcacaaagaacaactagacaaattggacttcagaattaaaaacttttgtttcaaaggatactgtcaagaaagtgaaaagatagtaacagaatgagagaaaatatttgcaaatcatttatctgtgaagggcatgatatccagaatatataaagaactgtaacaacataaaaataaaaagacaatctaatttaaaaatggtcaaaggatttgattagacatttctccagagaagatacataaatggctagtaagtacatgaaaagatgctcaccatcattagtcatgagggaaatgcagattataaccataatgagatagcagtttacacctactatgacatataataaaaaagatggacagttacaaatgttggtgagaatgtagagaaactgtaaccttcatactttgctagtgaggatgtaaaatgatgcagctgctttgggaaatagtttggtggttcttcaaaaagttaaacatagagttaccttatgctaactccaataattctattctggggtatatacctaaagaaatgaaaacatgtctacacaaaaacctgtaagtgaacatcatattaatgtcattcataatagccaaaaggtggaaacaacacaaatgtctattacctgatgaatggataaacaaaatatgatacatccatacaatggaatattattcagccttaaaaaggaatacaattctctcacatagtgcaacatggatgaaccttgaaaactaagtgaaagccagacacaaaaggctacttgatgcaaatttccatttatatgaagtgtctagaataggcaaatccatagaaacagaaataagtggttgccagaggcttgggataagggtaggatgctaatgtatatagaagggtttcattttcaggtgatcaaaatgttctgaaagtagacagtggtgatgattgtacaactctgacttcctggttcagccactttaaatagatgaatgaaacaaatagaagaacttgtatctttactctcatacacccacactattttcctctctggtgcctatcttctctatttccttttgcaacaaatttagagatcatttctgttatctccttgacttctctacctccttttaaatctattacagtctgacttttgattctacctttgttaataagatcactaataatgtccttatcttccaaatccaaatttgctttttagtttttctttcatgatgttttgccagcactattgaacactgttttttaaagcttctcttgacttctgtgtttacactttcctggctctgctttggctttttgttttgttttaatttccatccttgaccttagtgtatttgcctgtccctgagtgttactggtttagttttagattttcttacacgtttactgacatactcttggacaatttcattcccgtggctttatccgtgttcatctgcacagaagtgtgtgtatttggcctaaaaggcttggtgactcaacttactctcaaatagtttgtcaaatattaataattatatattactctactactccattttcatgctgctggtaaagacatacccgagactgggcaattaataaaagaaaggtttaatggacttaaagttctacatggctggggaggcctcacaatcctggtggaaggcaaggaggagcaagtcatgtcttacatgggtggcagcaggcaaagagagagagcttgtgcagggaaacttcctgtttttaaaaccatcagatcttgtgagacttattccctatcatgagaacagcatggcagagacccatccccatgatttaattacctcccatgggggtttctcccacaaaatgtgggaattgtgggagttacaattcaagatgaaatttggatggggacacagccaaaccatatcaatcaccattattattattgttattatataaaagagaaagaagtaaatgtgacaaaatgtaaactgtctatgaatctagatgaatgggaccctggagctcatagtacaatcactgcaacttttctgtgagattgaaatttttcaaatagagagatttttaaagaattttttttttaagtgaacggttctgtgccatttagtacatcctttcctttaaaaaaaaaaactctcatacttgtcagggtattaagttgctataacagaatgcagtagttctttaattgtgagtttcttatatattctaggataggcagatctgtttagtatacctttttccactgcatcatttcagtttggatattcttgactttcgaattgttcttggaaataattagaaagaagtagggattgggattgttggacggtgaaatcatagggagagaaaggaagttgaggaattcaatcttgagtcttagaactgtgtgtgtgtgtgtgtgtgtgtgtgtgtgtgtgtgtatagaagaactacatacatacatatatagaaggaagaaacggaaatgaatctataaaggcctgatagtacttacatattttcttgttattgtctgttatgttatgaataggacctgcggctgtattatatttgagaaataggatttaagaaatacccactcagtttcaccaaaaatgttaaaattttatttgctttaaaaaaagcttttattaagcttcttttccatctacattatccaagcaaatctgaataattgggactagagttggactagatgttggagggaccaactttctatttattaaatcacggaaagatttagcattagtttgattagaatgggtgctttcctgcccttaacacacatacagtgcctctttgaatgcatattttctgcaacaaagaaaaacaaattaacaaacaactagttgaaccttcaaggattctgaaaagcttctggcaaggtatattttttaggatattggttcagcttctctattgggacaaaaatagctggtttaaaaatacagaaggcttttcctttcacatcaaagatagaactggtagtagtcagggaagtggagtggttctgctctaagctattgtctagggttccaggtttcttctactttgttcctctatctttgcttttatctgaatggttgatgctggtttcacagcacatcatacaactggatttcagcctgtgggaaggagtaaaggcacacagcttcctaatataagcatgacctaaaacataaatgacgttgcaatgagactccatcaactagaatttggccacacttagctgtaaggcagagtggaaactaatccctgcttgggtggctgtgagtccagttaaaatttggggggtttaattagtagaaggaaggagagactagatgtggacgggcagttatcagaaattaaaggggtgataaagtaagcttgaaagcttctttgctttctagtgtgacagcttgttctgagcttatcttgtacatttttgcttcagacctgaaatcaggtcaggttccatgtattaggacgtggtatatggaaaccatagcatgggttttagaaaagggtgcattgccattgagttaatcatcattttcaggctttttcagtacagagctaggaaatatttttttctgaaagagaaaataggtcatgaatccatactactatttgcatttcacttttaaggtagatatttaaaatgttaaagaatgtgtttctgtcataaaaaccaaagtttgattcctggttctgcaacttattagaggtataatttttttgctcattttgagtttcagttttctcatctttacaatggggataataactacatctcatggttgtcatatgattaaatgagataagtgctcagaaatttttactgattttattattctctatcacaatacaaaaaggagagacccctaattcttcttacaggggttagagaagacttagagacacttgtgccatcagggaagattgaattttaaatgggatatggaggtttagtgagaagaaatacccaggtaagggacccagcagaggctgtgatctgcatttgtcaaggctggtgcataggattctattttgaccctttaaaaaaaaaacttttttcttatagtatttatcatagtgtgtaattaagtagtagtttgtgtgcttatttgcttactgtctgactgcctttctgtcccacagtgacaaggaaggactatcctgtctttctttttgattaccattataccttcagtacctgccacataatagtcacacagttgctgttcagaccctgaataaaattttgaagcatttataaatatcacgaaatttcgcatttgattatatacataaataattctgcacttatttcagtgttacctactgagggttgcctactagttgatctagtttcttccaagtcaataactttaattactctggagaattttgcacacttgatagcattagttctttatcaatttttattgaaagtaaatgaatgaatttgctggtgttccagtctgtttggatcagattctgagccacaatgtggatatactggtatgttgtgaaatgtgtgccaagtaatttattgttaacaagagtttaaagtacttcaggtatcccttataatgaaaccactctggtttttccattttattatgttgccttaagagggagagagctgcacatacaggttattctcccaagaattacctgtagtactcccatgggagagagagagctcacgtgtgcgcttgtgagcctcagcacctctgtgctgcatcttttgtgtccgcatggaaagattcagaatgagaattctcacctggatctttagggaagtattctgagaaaggaggcagcatggtacaatataagacactagatcctaagtcaaatggcatttgcattctagaaccttttcttgtttggctactaaatacatgacactcacattttgcatatgcttatttttgttgttgttattgtcccctttgttgaggtataatttatatataatgaaacagcaatttcaagtgtaaaacttcatgaattctgacaaatgttaagtaatgtatttaatactacaacaatagtataaaatatatgttactccaaagaaattttctcatttccctttgtagttcctatcaccctcccttgacaactgacctgctttctgtcactattgttttgtcttctctagaatttggaattatacagtggacacaaaaaattatacactgtatataatatgtggctggcttctttagcataatgctcttgagattcattcttgctgcatatgtcagtagattgtttctttttattgctgagccatattccattgtatggctatactacagtttgcttatccattcaccagagggaacatttgggttttttgaccattatgaataagctactgtgaacattggtatacaagtctttttgtagacctatgttttatttcttttgggtgtatacctacgagcataattggtgggtcatatgataagtatatatctagctttataagaaactgcaaaattgtttaccaaagtgtttgtactattttgtattccaaccaggaatgtatgagagtcctagttactctacgtctttccaacacttgaattttttcagtttttaaagttttattatctctttttggttttagtttgcatttcccaagtaactaaatatattgaaaatcttttcatgtgtttcttttcttttcttttttttttttgagatggagtctcactctgccacccagactggagtgcaacggcacgatctcagctcactgcaacctctgcctcctaggttcaaatgattctcctgcctcagcctcccgggtagctggggttacaggtgcccgccaccatgcccagctaatttgtgtatttttagtagagacgggtttcaccatgttggccaggctggtctcgaactcctgacctcaggtcatccaccctcctcagtttcccaaagtgctgtgattacaggcgtgagccactgcacctggcccatgtgcttgcttgcttatttatttatttatttatttatttatttatttatttatttttgagacaaagtctcactctgtcacccgggctggagtgcagtggcgcgatctcggctcactacaacctctgcctcccgggttcaagcaattctcgtgcctcagcctcccgagtagctaggattacgggcacccgccaccacacccagctaattttttttatttttagtagagacggggtttcactatgttggccaatctggtctcaaactcctgacctcaggtgatccacctgcctctgcctcccaaagtgctgggataacaggtgtgagtcatggtgcccagctccatgtgcttattttctatctgtatctctttggtcaagtgagcatcctgacctcttggctgttttttattggatagtctgtcttcttgctaatgagttataagaattttttacatattctggataggatacaagttctttattagatatatgtttttcaaatactttctcccagtctttagctgcctttttatattttagagtgtcttttgaagagtaaagttttatatttattttttctttttagtttgtgttttctgtgtcttatttaagagatcttttcctagtctgagatactaaggattttctcctgtattttctccaaggagctttatagtttgtgcccttactttgagagaaataattcatttagaatttctgtgtatgatgggaggaaagtgttgaggtttatttttgacatatggataattaattgtatcagcatttttattggagagattatcatttcctcattgctgaagcatctttattgagtcaattagccatgtttttgtgtggctgtttctggactttctattctgttttgttgataacctgtgtcttcggcaatacaacatggtgtcaactactgtggttttataacgagttttgaaatcatttagttaagtctccaactttgtttttatccaaattgctttgtttattctaggtcctttgagtttacatgtaaatttagaatcaggtttattagtttttataagaaagcttactgcaatttttattggaattacattgaatctataaatcagtttgagggaaaaatgacactttttaccttattggctattctgatccatgagcatggcatatttttcagatttaagtgtttgattttttcagcaatatttgtagttttcagatgggagtttatacatatgttgggtattttatatattttgatgttattattgattggtctttttactttcaacttctgatgatttgttgttagtacataaacagttgatttttttgcatctttacctggtatcctgtgacctttctaaattttcttgttacctagtagcttttctagattccttgaagctttttacgtacaaaatcatcttgtctgaatatagacaggtacacttcttcctttccaaatctgtctgccttttatttctttttcttgcttcaatgtactggtggaagtagtgagaatggacattgttgtcttgtcttgaaatctagaagcttaacattaatttgttaacattaacatttaattttaaggaacaccaattgttccttaaaattaaaaaaaatactacctatgatgaattagcattgtaacaaaaaaaatacaaataataaattacctaacctatatcagacagcacaaataaaggcagttgacattgccaaatttctgagaaaacaaataaaactatcaaagctatgagatggtatcataactgtttcactgactatgaaaaactgttactgaggaatctaatatctgtccaaagccaacatttaaaagataagtgttatattggctggtagtttgtaattgaaataagaatataaatattctcctagaaagtacgaatgaaatactcagagtctttagtataccttgaagttatactattattattattattattattattattattattattattattattattatttgagacggattctcactctgtcacccaggctggagtgcagtggtgcaatctcggctcactacaacctctgcctccactgtgcccagctgaaattacatttttcaaactcatggtgctaaaaaggtcaagatcattaagcacacgttataaaatatgaccctgatgctctgcttaacttctaatggccaaaaggaatttaattagtagacttagtctggggaaggcgtagactcaaactctgtgatactcaaatgctatggagctatgatatggaagaagaaagggatatgcagctgcctagataattttatgctatagttggaaaaatttttatgcacatttaatgttaaatttggggaagcaaagaaatatattaaagtgatgatacaccttagaatttaagttataggttttaggtttgttggaggattaaataagatgattaaagcaaggtaactcattgaaaccttgtcacattataagcattcagtaaatgatgaattatcagtctcttaacttgtgtgattatgggcaatatttggtgtggtcaaaaggtctttaagtttttttcctacttctttgagttatcaagaaagagattattattttttaatacaacctagtttcacaaatagggacatacataacatactacagaaggtttctgttgatgtttttgtgcttgaggcattaagtgctctcagttacctggaaaaataatggctctccaaaatgattcaaagcttttcctttataatttttaagattcctggccaatgtgctttaaatgaactttctgacttattaataaaactcaatgaccgggtgcagtggctcttgcctgtaatcccagcactttgggacaccaaggagggtggatcacctgaggtcaggagttcaagaccagcctggctaacatagtgaaaccccgtctctactaaaaatacaaaaagttagctgggcatggtggcaggcgcctgtaatcccagctactcgggaggctgaggaaggagaatcacttgaacctgggaggcagaggttgcagtgagtcgagattgcaccactgcactccagcctgggcaacaagagcgaaactccatttcaaaaaaaaaaaaaacccatctcaatggtttattctagtctaaatgttttatggtagattctgaataatttgggctattatttaacaattatctatagttatactttagcattgaaaatgttattgtacttttttttttttttttgagaccgagtctcactctgttgcccaggctggagtgcagtggcacgatcttggctcactgcaacctctgcctcttgggttcaagcgattctccagcctcagcctcccgagtagctgggattacaggcgtgtgccaccatgtctggctaatttttgtatttttagtacagacgagcttttgctgtgttggccagactggtctcaaactcctggcctcaagtcccaaattgctgggatttaggcatgaaccactatgcctggccataccgtacagaaacactcttatggtgtatgtatgcgtctatttggaacttagttttgtagtctttttttaaaatcatactttattatagtaccttgttatcattttgaatatgttaaatcaacactataatagttaaggtagacagaacattaggacataccgtattctatattttttcctctgtatttggtatcagtccctggatttttgcttttatgagtctgtttctttcattcctattatttttgttatcaatcatcctagtgcttttttaaatgattgtgttagctttctagcttgtcttggctgctttcagtctgtcctgcaggttgcaaaattattttaaagcataccacttgagtgtattactctactgttcacaatgtttcattgctttccattgtctactaggttgctcagtgcccttcacaacttagccagtcacattatttattcatccatccatgtattcattcagccatatttattaggttctatgaaccagacaggatggaggaatatgtgctatgagagcttataatgaattagatctggtcaaggaggtcattggagagccaagatctgaagagagtaggatttgttactcaaaaaatagaaaagaggattgtaccagacagagggactagcatgtacaaaggcttttttttttttcctctgaaaggaatatattttgagaatgaagaactgaaagaaggctactgtggcttagacacaggggtgtccaatcttttggcttcccaggggcacattggaaggaagaacaattgtcttgggccacacataaaatacactaacactaatgatagctgatgagctaaaaaaaaaaaaaaaatcacaaaaaaatctcataatgttttaagaaagtttacaaatttgtgttgggccacattcaaaaccatactgggctacatgcagcctgtggaccacgggttggacaagcttggcttagagcataaaagaagagggatcgtagtacaagatggaaaagaaggttggacttgaccatacagggggcttccagaccatgctgagtaatattattaatataaaagcaataagaagccatccaagggttttatttagaggtagggggtggaggagagggagataaaagtggtctccgttggagcattgttgtttagtcttgacaatagcttggtcaaggaggttggtgatggcagaagagtttcagtttcaagagatacttaggaggttaaatcagtaaaacctgctgacatataatgcagttgggggtgtaagaaacagggaggaggtgacgtaagaaacagggaggaggtggttatccattattcgataaatgatgccattttactgagttagggaatattggaagaggaccattttgggtagaggaaaatcttaagttcagttttgaacatgtttagtttgacataccctttgagccattcaggggggtgtgtcatgaggcagaatatttggtgctcagagagagatagaggctcaaaatacagtttttattatttgattattgataggaattgaagctgtgagtagtagggttgggggttgagactatacattgggcaagacctaagactgattcttgcggatctgcagcacttactagttaggtattggagattgtgtctaggttaggggtgaggatggaaggcagtagcagccagaggagagaaggaaaaccatgaaaatatttcagcatgaaagccaaaggaagattcctttcaaaagactgggaagtagttttgaatgctgcttggaagccagatttgaaaatctccaatggatttaatgactcaaggagagatctgctgctgtgtaacaagtcatcccaaaacttagtgacttaaaacaacagtttattatttcttaagaatttgtgagtttgttacataagccccaggcttatccaggactggaacgtacaagatggtcttatttatatgtctggggctttggtgctgccagttttctgggggaccttgcttctcatctctgtggcttctgtctccatcatttagtagcataattcaagcttttttacatggtagccagcttccatggaagtggaaataaggctgctaggcctagtaagacttagactctgaatacctttgagtgcttcggagtactgtgccatctaccagagtaaccaagccaaaacaaaacaaaaacccattgatgacttagtgtaagagttgtttatgaaaaaaaaattaacagtagggaaatccaagaattgataggctaagtataactccaaaagacagatacattgagaggactggggaacgaagaaaatttcctaattattcctctgcattttctttaagcttgacctcaactgggctgctgatttcctgaacacttcctctttctttcctcatgtactccttttccctggacgttatttctctatctccctatattaaaatccaacccatccttaaaggattaaaggctttcttaaaaatctttctctcctcctttgcactgtattctccaccagttctgaagtttaatttagttttcatcccagtatttattattattatttcttgtctcctatgtgtttgatcatgatcttcactcttcattactccctaacttgcatgaggttctggattctcagtaaacttattattcttcacacttgctcagatgctacttcctctgagaagtcttccctggtttgtcccctaatcatttattcttttgtactttatgcatatttttattgttgtacatatcataacacataattgtttacttacatgtttttgaaagtagaagattacaatgtgtaatgtgttgcctttcattaaataaatcctgagttatagcttgatttctgatccctattttaattttttttaaaagtccccacatgttgacaataaaatgtgtatatttatcatgacctaattatttctttgatactgtgctgagttcattggtactaggccactgcagtaaacggtaaagaaaagttatgatttggtatatgaagttaaaaattacaagaaataatatatggtcaagttttttatatctcttaataaggcaagaatgaatatatgaggttatgtttcatgtgggcctcagtggaagtatgtacatatgtaaattctcagtatacatcttatacattgagctggatggagtgtttgttatggtgccagcttatggaatatgtgtttttccacaccttgttcaaggtgtcaggtaggctttgcagctcatgtgtttgtattctctatgtatgggcacgtacaagggccatagagatgaactggttacacacacagggaaagaataagacttccagctcttggagataagactggttctgtgactcgtgacttacattagcatggaaactttgtatctatgtgtgttggggtggagggagcacagttttgttttttttttttttttagtttttgcttgtttgttttgtgatggagtctccctctgtcactcaggcaggagtgcagtggtgctatcatgactcactgcaatctcaacctcctgggctcaagctatccccctgctgcagcctcccaactagctgggactgcaggtgtgcatcaccacgcctgggttgtctctctctctctctctctctgtgtgtgtgtgtgtgtgtgtgtgtgtgtgtgtgtgtgtgtatttgtagagataggatctcactatgttgcccaggctggtctctaactcctggcctcatgcaatcctgcctgcctcagcctcccaaagtgctaggatgacaggtgtgaaccaccacatctggccaggagcacaatttttattggcaggacactgagaggtgcttgtgatctgattataactctagctttgcatctcttttactttgcttagaccgcatgagtggaacctcatttattatttcatatgacaaatactgtgggggaaacaaaagaatcagatccttctcctttcccttttccaaactcgtgggataggctgcgaagtaaataggtcattaaaacttaagtgggaagcatgattatgagaatacatataatttgaattactttgataatagaaccagttggcagaacttccaagttcaagaaaggggaaatctttttctttttttttttttcttttttttttcttttttttttttgaaatggagtctcactctgtcccccaggctggagtgcagtggtgcgatctgggctcactgcaacctccacctcctgggttcaagcgattcttctgcctcagccttctgagtagctgggactacgggcacgtgccaccacgcccggataattttttgtatttttagtagagatggggtttcactgtgttagccagaatggtctcgatctgctgacctcgtgatccgtgaccttgggctcccaaagtgctgggattacaggtgtgagccaccacacccagctaaggggaaatcttgtgttggtacagatcagtcctgactcatggtgggctcaggtttgatcctcatccagccaattaggttgtatgctaggagacatctgtttagattcctgagttgaagatgttttaaaaataaacttcttttatctttttttactgtttgttggtttctattttttacattctacagtttaaaaaataagtaataatgtatgagaattttggttatctgagattttataatagcttttcttacaatgagctagctaaaaggtgatctcaaatcttgtttatttggcgtagtttatctacattaaatcctgaaatcgtgctgtgtttatggtaggtgctccatgaataactaaataattaaaatttaagttgagctttagtctaattttagaaaagtcacaaagaggaaattgcacttttataagtacataaaattgagcatacctggtgataactgtcacctgcctaatctgccatttgtttttcagaccaatggagaagtaggttttattctttttcttttggtaagaagttgaagatggactcaaaggtgaaggggcagtaaagtctccaagggaagctaggaaaaataggacagtcttcccaaatttaaattgaagttgcatttccttttctgttggctacgaagatgatgacgtaagatatttgggttggcgatattactaaaattaatcatttaaaataacaatatggaaaacctcacttgtattcaagcaaaaaataaactgaatgtaaacaataattttctctgcttattagtccattagactgaaactttgcccagtataattttataagattctaataaaggcccacaatatcatggttatgggaaaattactatattattgaatcacacatggtttattcagttcttaaaattgcagtcctccctccctagatgttccagacttgatgatatagcatgggttacttgagtgtgttctccaaacagatgtctcctaacatacaatcttatattacagttcatctctgaaaaggggataataatagtatctatcccatttgcttgttgtaaatactgtatgtaaagctcatggaatggtgcttggcacacagtaagtgttcagaatatgctagctattgttgtttattgttattgcccatgttttaagaaatggaagggaaaagcaagagggagaaaaatatattgccactcctttgtatgaagagtaactaggggaaaagcataggaccgtgcattataaaaataacctacagtgtttataagatgtattaattaaggacttaaaatcactagattgatacagaaattaatttaaattttttttctaaaagtagttatttttataattaaggttttcttttttcattgaatacaattagtttttttaatattaattcaacatttgattttttaaaaatgcagattatatttccactcctggttaggcagtataatacagtgtttaagagcacagtgtttaagagccagacttacctgggtttgaattctgtctcctcaccacttactgtgtaccttcagacaagtcctgaagctctctgtttgttgtttgtaaatgaggactataatagtgcctatctcatatgtttattttgtgggttaaatgaattaatatatataacgggtttagaataacttgcgccttctaatagtaaccactataaaagtattattgttattaatggctatattttttaaagcatcattagttcagacacttccatttgaatactcatactagagtttcttgggattaactctcagaaaacagctcttatgaaactcttatcccatccagtgttcagaaataaaaatcctattaaatatcttgttagctagtactgtgattctcagttttcttctttctgttaaatacagctctgaaacagattccttcaggaacatgatccttctgtttagaactcttaaagtactgggtgtattttattatttatctttaaatcctcagagcctaaacatacctaatatttggtaggtacataaaaaatgatgagtgaatgcatatatagttttcaggaagtagtctaccttcttgcagtgtattttaatggctgatcaagaataactctttgttaggggtccttacaaatgtctgagctttggagttagtaattactgtacttaatctttctcttgttcagttgaggcatataggaagttttcttgtctttggttttgtataaaataatgacattattggaaaagaggtacagataactacttgaataatttactggcttttgacaattatcttcatattaatatgtttcagtactttggataagaataaggaatataaaagtttctgccatatttgccttgttctttttgttttggattttaaaaaatttaataagtgaaacagaacattgcagattgatagtgtgtagtctcccttgttcccctactcagtgtcactttcctccctctttcccttcccgtaatcaacaattgcaaatttgatttatagtcatttagtccacattttcttatttttactacacatatctaaaactattctaaacattgtttacttttaacaatgtgtagagatgctattctgtgcatcattttgcatcttgcctttttttccttccatgtaatactgtttttgacacagaaatagactaccacgtgtacagtcacccgatataagaaagaggtgacattctagtgcagcatagaaaggatggcctgtatcaattggatatccatttgggaaaaaaaatgtatctttgcccctattttggaccatactccaaactcaatttcagatgtatttcaggtttgattttaagtgggaaaataataagcttttagaagaaaacatgggagagcatcttcattatctatgaggaaacaaaaagcactaactgtgaaaggaaaaatatatttagataacttctgtttatcaaaagataccactaaaataatggaagaggtaacagagtagaagatatttgcaatactataatgtatccaataaagcagctgtccccaacctttttggcaccagggactggtttcctggaagaaagacagttcttctgtggacatgggtgggtatggttttggaatgaaactgttccacctcagattatcaggcattatttagattctcaaataaggagcgcacaacctagattccttgcatgtgcagttcacaatagggttcatgctcctatgagaatctaatgccactgctgatctgacaggaggtggagctcaggcagtaatgcttgcttgcccactgctcacttcctgctgtgtggccccattccttaacaggccacagacttggggatccctgcaataaaagacatctggaatagattaacaatcctccaaatcaataagagaaagctagacaacccaattaaaaataataagcagaagactttaatagtcacttcacaaaagagcacgttgaaatggccaataagcgtatgaaaaggtattccacttccataaacatcagggaaattaaaaccccaccccactacacacacgcacacacacgcacacacacacacacccacaatggctaacatgaaaaagacagccaaaactaagtgttgatgaaggagatacagagcaactggttctgttatacgctgctagtaggagtataaattggtataaccactttggaaaactggcagtatctgatgaaagtaaacatattcatatccagcaattccacaactaggtatatactcaacagaaatgcatacatatattttccacaaatacatgtactgtaatttcatagttacactattcataacatacccaaacaattcaaaaggataattacggagtttgaggccagactggtgaagatcccttctctacaaaatattaaaaagtgagctgagtgtggtggcacgtgcctgtagtcctacctacttgggaggctgaggcaggaagatctcttgagtctaggagtttgagggtgcagtgaactatgaccatgtgactgcattccagcctgggtgacagaacaagagcttgtctctaaaaaataaaactaattatgatatacagataaacaatatggcaataggaatgaacgatctaccattgtatgtagcagtataggtgattcttacctttacaatgatgaaagaagccataaaccaaagagacaatactccatttttataaagttcaaaatcaggcaaaactagtcagttggggaggggcataagttagtaaagttatctttcttgatacaaattttagttacacaaaggcattcaacttgtgaaaatttgttaggctgtgctttctggatatatgttcttatatgtatgtatgttatattacccaaaaaacattgttttgagatctatccatgttggatgttaagagttctagtttattcatttcagatgtggtgtgtgaacagactgcagcttatttattgattcccttattggacttctaaattgtttcccgttttcctctgtttcaaataatgctgtagtcaattgcttttttttttttttttaaacatcttatacaaataatatgagagttcttctaggagttggcattgttgagttttagggtatgctcatgtttagctttatcagatactatccaattgttctccaaatggtagtataattataggctcaccagaagtattggagagttcctattgctttatattcttgtcatcacttggtattgtcaaatttaaaaaatttttgctaatcttattgtgaaatgatatcaatattttaatttgtgttatctgttaactagtgtatttcatcatcttcctacatgtttataggtcatatggatttccttttaggtatccttatctattgcccattttttgcttttgggaattgtctatttttattgcatatttttctagtgactaactttatatttttcttcatttatgtgcaattttccttgattctcaaagtccatatattcaggaagacctccccaccccctttgatttttaagacattactggaatttcacctgtaaactttaaacctggagtaagtcaatcctcctgagatttttccttcagattttaatctttttcctgtttctatttgcctgccattactccttattttactaattcatttaaactatagcggattttccccttttttggttttgggaggttggtggtgatttgcagagggagaaatgagaagcaatagaaaaataaataaaaatttgcctaaagtttataaaattgatatagctatgtgtaaaatgcttagaatatgcttgtgaaccttgctggggttttttttttacatttgaaattcattctagattcagcattgtacagccaaaggccatttatttcattttatattgtctgcgttgcagatgctcatcattacatgattagtttgtgtgtgtgcatgtgtgtgtgtgtgtgtggtccgcgcagtgcctgttttcccccacattctcaagacagttccatgtatctatccattattctgcaaagcaactgcattaacagttgaaacttcacgcagtaccactggtgctttgacatttttgtgatattagagagaaaatgaccaagtacttggtagctgtgtttcccaaatactttaaaggtggtttaaagggtaaaaggagatgatgtaagtagtgcttgcttatttatcttctgtcagggtgtggtaatagcagcaagggcctggagctcctgagctgtttacaattgtcacagagcctgtgaggctgggaaaccttcctcgagaatatgctggcccagatttcttcagcattccttctctgttgcttctgccttctgccttacgtgccagagaaagaactcatgacttctgtccagagtcacaaaatcttggctgatcttgatgaaggagtcttgcagcatattctcatggcatgaatcttttgaagagaggtgccagtataacatagcttcactaggaaaactcttcctagaatagaattggatttctttttttaatggtttgatgtaagtcaatgaagaaacttgagtctattttagtgtagaatgacttcaacccccatcaagtttggaagtcttctctgtgtgagatttagaaaggctgtacacaatacaattaggtcttgctttgtgaagaaattagtataaaaaatgacaattaatttagaagtgatcattttaaagcatgttttgtataaaaatatactccagtatttgtagaaaaaagccctaaactgagtcttgattttatttttaaaaaatttgtaagtggtaaggattttggttttcctaagcaccatatacttaaataccattatcacacttaaaagagtattaacaattccagtaatataatcttgaaatttcctgattgtctcaaaaatcttcgcttttgcctcttttataacagttttaactcttcagattcccttccctttgcttttttatgccactgatttattggagaaaccaggtcatttgtcctgtataatgttccacattctggatttgactgattgctctcttgtgctggtgtttaacttgatcctatatccccactattccctgcaaactggtagttagaaccgaaggcttgattcaattcaggtcgaatcttttctttcttcctcttttttttggtaagaatcctttatagttgatgttgtggtattgcatcatgtcatgagaaacatagtgtctggtcatcctcattgagtgatactgagatgaatatgtggattctgtttgtacactgttactctgttggtatagaagggcccattatagtcatttaaaactttttaagatgcttaagaatctcagaaaagattctaacttagcaggtgtaagggaagaaacatctattattaataaaacatgcaacacatacaaaaacccccaaacctctctacatttactcagatgtggtaagaatcactacatttaaaatgtaattagagtgacaaaaatttactcttctacaaatgctttgagattgtttatcttatataaaatgaagcatattttaaaatattaagagctgtaaagatgtttgagattgctgtggtgtaataaaaaagtactgactctggacacaggaggccaaatcatttttttgaggtctatttttttttacatttagaaaataataagaccgggcatggtggctcacacctgtaatccagcactttgagaggccgaggcgtgtgggtcacctgagatcgggagtttgagaccatcctggtcaacatggcaaaactctgtctctactaaaaatacaaaaattagctgggcgtggtgttgcgtacctgtaatcccagctactcgggaggctgaggcaggagaattgcttgaacccaggaggcagaggttgcaatgagccaagatcgtgcctctgcactgcaacctcaaaaagaaaagaaaagaaaagaaaaataacatatctatcacagggttgttttaatgattaaatgaaattatttatttggaagcaattcagcacccagtaattaattgagtctaaatctgaaattcattccaacaatacagatttttttcagtctatatcttcaaagtaagtttaagaaaattaaacagtatcatgtgctgttttagctatgtctgaacaagtaagcttttatatttgagcttgtttttcaagtgataggagagttgatgcagttctaacgtaagtgtaattaaagtaggctttttgaaaaaatagtctgtggaattcttattactgtttttcccccctactttcagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggtaagttttttgctggcagtaatttggtaacttaaagcagattttatctgaatgttttaaaagtgtacattcaaaagctccatgtttgtttttatttcacaagttaatattaggaattaggcatatatgcttttaatagtacatttattgctaatggtctatgatcttcatttgaatagaatgtgggttactattggacatgacaaggaatggtaatattttttctacttgtatagaaaatgctattatttgaagttgttaaactaattttcttatctacaaagattgccaatgatttagaagtaccatagcattattttttgcaaaaacagtcttgagaatcatctctgtgtatttgatgaggtatgcttggttaagtgcaatttttcccagaggcaaagagattgatagattaaaggaaacagatagtgaggtcttatccagcttctgtttcacttatacatcagattaggtaggtactatgccaagtgaacatcaaggaaaatcttgaaatacaatatgtaatcaactcagaactcatttaatatagaattggctaacaggtggattaatttcatataggtatgtattgcgtgcctactgtgtaccaagtatcgttccatgcttttggcattcagtagtcagtacagacacggcatttttggtttcatggagcatttcagttctcacctgagaattgtattaaaataattttaatatcaaattctgtatttgatattaaaatgtgcaagtctagcattccactattttacttatgataagggcctgtgacataatctgcagacacagttggtgcgctaatgagattcgtcatagccagctacataagagaaaatgtaagttctaattaatattttaggtgcattttttctaaaattctatggattttggaaatctgcaaaattcacagacaaaaagggattaaccttacacaggtgtgtgaaatagatagaaagctgttattcatgtcattaaatgctttcattttatagaaatgctttttgtgaactttcgtaatgccttcacaatttaattaacaaagggtaaaaaaggcatatatgtaattttttttagggataacctgtcatctacatttgaaaattaatgaacaattctcgttacatagataatatttttcagtgacagtcgtatttttttctgtgggagggtgcacatttatattcatgaaattttagtttccagctttgaactggcacccttgttaaaaattctgatttttttttttttttaaactctggggattttacttaacaggttctgaaaggcttggaggctataacattctcacattggaaattccttactaggaattacttagtttgaacttagaatgatgatgaacttttgggacttaaatatactataacttttgtcactaggatcaggaatattcagagtgtgaagtcaagtgagtggtgtaatcaaagagtctgaaaagaaccatgagacatcatgtagcagtcttgcctttaggcagtaatgtattaaagctactttgcttattctttgaaaggaacatctctagagaagttccaaagtcatccttggtgatatctttcaatgatgcagaaatcttagtcaagaaattaggaagtcttccctaaatatacattctgaatccttcctgatgtgatagtttatttgccccttttcatgctcttactagcaataagagtaagccgctcaaatgtcactcatcttttcatatctctgaataatgtgtttcctttcttttttaatttaaaggatgttcactaaacaaagttttggggaacaccagaaaagtagaaagaacaaaaaagataatacccactggtattgcactatccaaatatgtaatcactgctaacaattcctgtgcatttttaaaacttaaggttggccgggcgcggtggctcatgcctgtaatcccagcactttcgaaggccaaggtgggcggattacctgaggtcaggagtttgagaccagcctggccaacatggtgaaaccccgtctctactaaaaatacaaaaattagctgggcgtgatggcacacgcctgtaatcccagctgttcgggaggctgaggcaggagaattgcttgagcgcaggaggtggaagttgcagtgagctgagatcgtaccactgcactccagcctggctgacagagagagactctgtctcacaaaaaaaaaaaaaaaaaaatttagttgtttatgtgtgtatttgtgtacatttatttttcccattatggagtaattcatgttcactaaggaaatgttggaaaaaattcatctgtattgccaaaataataatatatttctttctatgtatttttttaattgcataattgtagtcattgtaagcatttttcttttgatatcaggtaattaatgagtgcccactctatgccaaataactgttactgggtgttgggagtacagcaggaacaatagaaagcttatgtctttgtactgagtgacagataataatcatggaaaataaataaatgatattttatagtagtactacctactactattgtagtagatagtagggtgctacctactatgaagacaaaacagagtaagggagtggagactaacttaaggcagagaaagcatattctacctaagttttcgtctgaggaggtaacatttaagcagagacctgaataatggagttaattacacaaatatctaggcagaggaaatggcaaggaaagggacatgctctctatatatttggaagcaacaggaaggctagcatggctggagcttacatagggaggaatagagtaatagctaggtttagagaggtaggcaggggccaaatattgaatggctctttaggctacaataaatattttttgaggaaatggcaaggaaagggacatgctctctatatgtttggaagcaacaggaaggctggcatggctggagcttacatagcggggaatagagtaatagctaggtttagagggtaggcagaggccaaatattgaatggctctttaggctacaataaatatatttttatattccaagtatgatgtgaagccttttgaaggctttttacgggaggtgacgtctgatttctatttctgaaataccacttcacctgttagatgagaatatagagtggcaagaatgaaagcaggaagactagtagtagtactttgttctatgctagctttggaggtcctgagaggtggcttaatgcaaaagagaaccaaggatgaggacaataagggaagaagcaatccaggatggttcccagatgattcagttggtccgaaccactagagatggatggctgtgccaaggactgagatggtacactggggagaagcaggtttaggggaggtgcaaggatgatagcaaattttaaaatgtgtaatagacatgttgttaaatatatcaagaattttttaagtattttataaaaattatagatatttctagattaaatacatttaactttcttagcctctgtaaggactattgaccaacttagaaatgttcatttgcttcttctctatttgacaaagatgctaatactgcctttagactcactatatttagtttgacttttttgtggactctacataacccaaagtgagacagcttcttgacttgaaggtgtgtgctaataaaacttttttcacaaatacaagtagtgatcctagaaactttatgcattagcacaaagtgttgtatatcccaaggagtaagttttgacatagacaataagtacacatgaggaacattacggaggatataggctcactttgtaaagaaagcaaaatttgctatttctgtttaacttttaaaataattaatagatttttattaccaaatgactcattttattctttttctccaatttttgtaaaatatactgattagtaattttatttcgtgttaagattgatttgcttatgttttcttaattgatgacacaacttaggagagcaagataattgtcatagtttatatactttaaaatttttgctttttaatgacatcttaggaatatgcttaaatttcatgaaataagatactcaacctttatgtaaacttctaatattttgcatgtaaagatggttagcctttttatggattgctttttgtatatacttaaattgacttagaaaaaaatttgaatttaccaattctttcaagtaagcatgacttcatatagatgctgtattttaagtactgatttcaaattcacagaggatttccaagggacaaaggatatccagaatagtttctgatacactgtaagggtttgaattgtaactctatcactatactaacttggaaaagttagttagcctctctgtgccttagtgttctcatttgtaaaatggggaaaataacccatacaattgttgctgagattaaagaaattaataatcataaaatgattggaacagtgccaggcacgtagatactcagtaattggtagatatttgttaaggttataatcatcattattttatacagttaagttgttgtatttattttttctaagtaaagctgactttgaggatttgaatcaccattgtctataatgttctcttttctgagtagcctttaacaaatcacgttaagtgtaagttgatataagtaatttgatgtgtcaaatgtaatgatgtagcttgtgttgtgaaataattggttgaatgtgtaaaagagtagggcatcatattgagcttattacaaataatgttgcaaaatatttggccaaagattgagttttagctgtcaaggtttttagtgttggtctggatcagaactgtataatagaaatctgattcaaatttcatatgtaataaaaaatttcatagtagccactttaaaaattaaaaatagatgaaattaattttaataatatattttatttaaatcaatatatccttattacttcagtgtgagattgatattttaaaattactaatgagatgttttatattttttcatactaagtcaacaaaatcaggtgtatattttacttactatacatttcaattcagactagctatatttcaagttctcaatagctacatgtgtctagtatataaagtattgtatagcaaaggtctagatatttttgttgaaaattcctctttaaaagatcttttcactggtatctttttaaaaaaatcactagtatttaatgcttctgaaccaaaagtagtataagttaaaacgtacaaaaggggaattcacgtgagacaggtaattcccaagtgtttacataagctaagtgaaattcagaaaagcacacgctaccatctgtatattaaaatgcaaatatttaaaatacttaaaaactgccagtaaacaagtagttattacatacctactatgtgcacagtaaatcttagtgataatacttttgttaagcaggaataagattttggggagacagttactagatgtgtgtgtgtatatgtgttaaagataaattgtattgcataacagttggagatagtgttttttatatatatgttttaaaaaacataaaatatgtgacttgttttcatgtgttttgttcagaccaagaattctatgttccaaatacctgtaattagaagaaaaaatgtacatactctcacaaaatgggattgttggttggttggaaataatgatttttgtgcattctttcataagataatgaaattagtcaacttttaccattgaacttttgttaattagtactgtcagaaaccccacagttgtttttttcttgctaatgataggaattcttgcaactaactagtttactatattcttcttcttcttcttcttcttttttttaatctcaggccgttcatattctgtgtgttctccaagaatgcttaatcagtgtctggagtccttggtgcagaaagtacaaagtggggtggtaataaactttgaaaaagcaggaccagatccttcccctgtagaaggtattattgcacttttcttttagacattcaaaacttgctttattgtttattcaactagaactgaaaacttactgtgatttggccttaagataggcaaggccaaattattaagacagaaaggctgttggtaaagagggaagattaaataggaaagtcaaggtaaactaatagtagtctagtagcatcacctttttgtattaatgattgtctattgcctgacattttgatgagtcaaaagccttttcaaagatttatcgataagcaactttataatttctttgtagtattatacaattgcctctcaacatatatatgcttctcctatgccctttaattcccaaagtgttcagtcctagatgtttaactccttagctacttttgtaccagggatcaaactgattgaaagtaaatggtttattgtgggtcaaaaatgaggaaccaggctttgccattaagcttgattcttctaactctagctgagtcccacctggctttttcttggcttctgtaatcatgaactatttccaatagccagtggatataaggagttatagtagaaccaatggatggtttatagttgagaccctctgcattgtatgttacctatttcaagatttaagagtcattgctgggcacggtggctcacacctctaatcctagcactttgggaggccaaggtgggtggatcacctgaggttgggagtttgagaccagcctgaccaacacggagaaactccgtgtctactaaaaatacaaaatgagccaggcgtggtggcgcatgcctatgatcccagctactcgggaggctgaggcaggagaactgcttgaacccgggaggtggaggttgcggtgagtggagatcacaccattgcactccagcctgggcaacaagagtgaaactccatctcaaaaaaaaagaaaaacaaaaacaaaaacaaaaaaaaacaaaacacacacacacacaaagatttagagaatcatttaatgataattggcagaggtggtccactaaagtaggtacctgggagaagagaaagatcatagagatgaaagaatgggggcactgagagggtactatagggaaggaatgggtgataacaataagttgtgtcatgtctgctttaacgaaaccaaacttaaaaaaattttaattgttacagtgtatttattttaaattattttaatgctttgtttagagtttgttactagtaaatgtttactggattgttgaagatagttgctgttttgctaaaattattttagattaaaggtaggtgctttggtctagatttgcttattaagttctttttttaggcttcggttaaaatgatttctaagaaatactcaatttgcagtacttatttattctagtatttattgtgtgcctggcactgtttttgacatttgggatatgatgataaaggtggcaaattgggtgcttgctcttatcatctgatgaagaaaacatgccattcatcaaacagatattcaccgtaaagtatgttttgtgtgttccagttgggaaggcaaaggatgctgcggacctcctttgaactggcgaactcatagttggaatttgtacttattgtctaatgaattacaatctagtctaaatattcagcagacatagtgttctgccatttaagaaaaataggaaaacctggaaaaagatattaggaattttttattaatttaagtaataattgatataatttaactttttatgcttatccccccttatgatatatgctttctttgtcttaatttctttgctatagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactagtaagtaccagagactgtaactatgtaatagtaaccattcagctgtctttcctattagtttcaaattctgttgtcaaagctgtgattaatttatggggattagacagatgttcaaagtgctatgataccctgttacttgctttattatgttgctttgctatgataaccctgttactttgtttattatgaagtaatagaaaaaaggcatctccttcgtttagaatctaatactatgcttgcgatttttattcttggcttctgggttcaaaatttcctctttagactctaaatgaggatttgtctctgggacacaatttaggatttaaatgaaggcttagaaaataattttgatagtttgcctgcaattttttaggacttagtcttaaattcatattgatatgtatggttttagttatatacagtgttgcagattggaggtttaagctagaacagattttctgattttgtttacctgaattatttttaggaaaaatgaagtttgctgagcgatcatggtgaattatcagtattcattatataattcttaaaataatagggtacatttatacaaattaatatccatttagtcgtgttagtgtactctttttttccatattttttttctaagtatctgagggcattaagggatattttgtgggagagcatggcagtggttctccttgattttacctttagaaaataagaattgtatttcagagatcattaagcagtctaataatgtttgatacaacaaaacctttttgaaaccttttgtacttcaaacctgtatcagcttttcaggataatttttattttgagtttataaagtgatatttcctttattcattagggatttaataaagtagtgcatgaagttaaggttttctaaatttcattgaagtatcttcattataccttttctttttttctgatagaaccatcatagttttttagtctggctttatggagaaacttccaatttctttggtcattttactttcttttctggagctctttcaactcttacagaacagataccgtatttgtatgaaatattgtcatgttggttatttattctatttatttaacatgtacaggagaacatacagtacctgagttgtaatggaaagaaatccaaaaccagtatcagaacccttatctattaatgctgctctagcagtctatcacaaattcttagaagccatagagggtaggtaggacttcaattggagaaggaaatagtatgagaaaaaaaatatggaagtgaaaaagaacaaggtatgtttagaggagtaacaagtagctgagtacgggtggatcataacatgtatataggacattgagagtactattaaactaaccaaattgcttatgactttaaatgcagggttaaggaatattagcttttaaacagtggagttcaaagagcagtcgaagatgtttttaacagacatctttagaaaaattgatttggtggtggttatatgcagtaaaattagaaggggagatgagttgaaaggcaggtaggttacctatgagggctattgatatggttcacgtaagagattttaagtggttgaattatgatgatggaagagagaataataaataatattggaaagaactggcaaactttagtaactgaaggatattaggggaagtgaaatttttataaattacaatattgaagaaatattgctactgaagttaagtgtaatttacaagatgtgaatttgaatcacggcactattagttattaattagtacctttggttatcttttgtaagcttcaatttcccatctgttaagtggcttatagctccatctcatagggttgttttgggaattaaacaaaatcatatatgcaaaattttcttggccaagttctagaggatctttccctccactttccctcttggatctccgtatttttattcacagaataagtgtgttttgtggactgattcaataaactgtgtgtcaggtgcatgctaggcacaggagcacaagatgagtaaaacagtgcttcccctctgaacattacccatctatgggcatgtcagacacgtacacatcatagagtacagtgtgccaactgtaatggaggggtggggcagagccagaggaggtgggcctgacagcctggtgtgtttttggagtacagagtgggaaggggtatgagggaagaggtcttttagaggttgttacatgccaactcatttttctaaactttgtttgcaatatgcaagggagaaaataagtacttggcatggctgaagtatggagtctgtatggcgtggtggtgggaaggcagatagggaccagatcactgaagatctttatatgtgatattaagtgtctagaccctatttttaggtgattggctgttacttttaccgaacagttttagatagggaaattatatgatcctatttatatttcactgccatggattgatcagacagggactgattagaaactaaacaaagcaaaaagcatttgtactagtctaatctgagaaatgatgaaggcccaaattaaagtggtaagaaatagaagataacatttctagagagatgagagtttagtattgacagaaggcagcaactagtaatgactacctaccatgtttatgtgttctggtaagtgccttagaatttgtgatatcagtttatccaggtctttgtgacagttaaatatggaggatgaggggaagatatcaagaataacggctaggtttttagaacaggttttgtagcttgggggagaagaaacaaattgtacatattgtgtctgaggaacctgtggaagattcaggttatgtctagtgggtagttagatacagcagagaaataggagccatctggccccaacagtagatttgtgaaccaccagggtataagcagtaactgaggccaatagagtcctttatagctatgacatttaaaattatttcctcatagctcattttgttcacaatttgtgagatttttaggaagaggactattaagaggtagattggggagtaacatgcctttttaaaaaaagtattacttttttatacctctagaacaggggtttctaaaataagggtgtgtatcctatagagtttaccaaaatgattgctggaatagggaaggaaacattagaagttctatttatggttatttttctcctattttcataccattttggtatatattttgttatgtacatctacatttataatttgtataattagaaatatatagtgtgttcaaaaactgatcaagatctatgattactttggaagtcgctactctctataagtaattgctacaaatgaagacttgtgagagtttctatatacatttctaattttttggatgtaaaaattaatgaatactcaattactaaattttgcgtaagacctaaaaatattttcatttctatagattttcaagtgtttatctttttgttgtgaatattacataactttagcattacattttcaagtgtttcctttcagcttaatgttgcttttagcagtaaatcaaactcttactagcaagacggaggaactgagtaaattttgataatgaggaatatttagttttgtttctgaaatttcatgtaagtagtaattacaagactttcccctttagccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtaagctgaacaacttacagtgaccccaaaatttaaatgaggcatttcttaaaaagctgaattgaatcaatggtttatgtaacattctttaaaggttattaaagttttaaccgctcctttttaacaggtgtacgtgagcaatagtgcaaaatacagtgaacttggtcatccttttggttacttgaaagccagtacagcactgaactgtgtcaacttatttgtgatgccttacaattatccagtccttcttcccctcttaggtaagtcattcttgtcactttctccttggcttagcatataaaagttctcctaaagcgcatttctttgtagtttttcttgtcttctggaaatcaatgaaaatattttgaatattctaaaatgttgaacatctttaagaaaatataacaatctgttcgtgtttacagtaaattaaaagatgatattgaaacactttttagtctgcaatttaataaaggtatttttttttgcgggggggtgggggagggaggggacggagtctcgctctgtcacccaggctggagtgcagtggcgtattctcagctcactgcaacctccgtctcccaggttcaagcgattctcctgcctcagcctccctcccaagtagctgggactacaggcatacaccatcatgcctagctaagttttttatttttagtagagacagggtttcaccatgttgaccaggctggtcttgaactcctgatctcaggtgatccgcccgccttggcctcccaaagtgctgggattacaggcatgggccactgtgcccggccaaagatattacattttaaattttttaattaaatattctaacttttctgcaagttagatttctaacagttagaattggtaatgtaggctttctgtttgaaatgagacattttgtagaaacatagtatagttaacaagatctgagtgcattttctaagaatttatctacactttaattttcatttggcaaatattttttaaataaaggaatttgttccaaaataatttgataaaagcctaaagttagtttctgggtacaatctagctatcatttttgaggagtgctgttggagaaaacttaccttccatgaaatcacattaaatttaaaagttatagtcaaaatattagtacgtatattttatagaaaacattgtgcatgctttgtttctgtcttcaaatctgctttgtgtctaggtctagggagggcatagattttccttgtgtgttttctgattctaacttaattcctgcatgtacttttagaccataattggcatcttttcattttatagaaaatgacaaaaccgtaaatcttactttcatgttaaaaaacgtctgatgttactctctcaaaaataacaaagcagactttaaaaaggaaacgtctttgacttgacttctatgtgtgaaaataatgagtagtgatagtttgttcacattatacgtttctagatgacttgtttaaagtgcataaagcaaaaccaacattgaagtggagacagtcatttgaaagttatttgaagacaatgcctccctactatcttggggtaagaatattatttaaaagaacttgttggccgggcgcagtgactcacgcctgtaatcccagcactttgggaggccgaggcgggtggatcatgaggtcaggagatcaagaccagcctggccaacatggtgaaaccccgtttctactaaaaatacaaaaattagctgggcgtggtggcgggcgcctgtaatcccagctactcgggaggctgaggcaggagaatcgcttgaaaccggaaggcagaggttgcaatgagccaagattgtgccactgcactccatccagcctgggcaacaagagcgaaacaccgtctccaaaaaaaaaaaaacaaaaaacttgttaattatattatgcttatggtttattgtgggtattataaacttttatttattgcttttatagattaaatgacatgaaaattgagcatacagatgaccactataggtataaaggtaaagagaggtttcagtgatttgcagagtagtgatgatgatcatgatcatgagaacatttatgtactgcttacgtaggccaggtactgtcctaagcaacatcattaatttatacagttaccctatgaggtagaaatgattattggttctgttacatagatgaggaaactaaggcattaaaaattaaataatttgcacaaggctacatagctaatatgtgaggggatgaggagcctgaaattcagtctggcttagatttaggcttttaacctcgagtgttgtactaccttttaaaattacagttttatgattatagttgtctctcagtatctgtgagggattggctccaggctcacctgtggacaccaaaagtcacagatgctcaagtccctcatataaaatggcatagtatttgcatataacctacacacattctcttgtatactttaaaccatttctaggttacttaatatgtatatacttttatactgtattgtttaaggaataatgtcaaggaaaaaagagtctgtatatatgttcagtacagatgcaacgatccatttttttttcctaacgttttcagtctgtggttgattgaattcacagaatacggaatccatagatatgtagggccgactatatttatttttaagggtgcacaatagtttttgttgtattatttcccaaatctctagaaacactttgtaaggtggataagtgtatattcttatagaaccatatgctttagaggacttgattacttcaaaatagtgtatcatagtaggtaaaaccaataatgtgcattttattaaatacatgatttagtttgtgaaagataactttttaacaaaagtacttaaaatcacttatgtattctgttttgatgcaggaatattatagcatttggctataaataatctttctaaatcatccctaatataattaggagattaatttcttgagctttaaaaatcatgacattttatagttctaacagataagttgtgttgaatgtctagcacacagtgcctggcaagtagaaggacaaaaaagaacaaacacttcgaacaggaactgttacatatgttgactcatttacgtttcatagcaaccctgaagatttagccaagccagataggtgttaaatatcagggctgggatttgatttcagtttgacaccagtgcttatacactttctaatatgtcaatgattatcatcctttttctggctctatccgattcacaaatgctagacactcttgctagtgatatttttcatcgtataaagtacttctcagtctctccttacaattgaaagttttttttaactttcaactaccacatccataataaatattagattgttttttcctcctgcttatgtttccttcagagctttttttcagctcagcatatgataataatagtaatgattaataatttgtacccaatggttttataaagtgctttatgtgtattaactcatttaatcccatgacaaccctgtaagagtaggtattgttattatccccattttacaaatgagaaactaagccacagagagccagagagcttatttataatctgatctagaatcatataactagtgagtggttgagcagctaattactcaaaagtagaaatcttgcattttccttgagtgtttttcacttactacccatgttttatcagagctacctctagaatgtgtcttctgtccatttattccaaacctagtttctcccagtggtaccaaggaagaccagtatcttatccttcttgtcttggggagttattatggcctctaatcctttttaactacttcaaacggcctttcatcccactgacaaacattttactgaaacataaatacgattgtgttacttccttattgaggaaaagaaggggaaataattttttggagaaaattttaagacagactatacatggaaccataagtttttaataagcttaatattgaatgatgttttcttttttcctatagcccttgaagaaagctgttaggatgatgggagcacctaacctaatagcagacagtatggaatatggacttagttacagtgtcatttcatacctcaaaaaactgagtcaacaggtaatatcaagaaatagagtgagccattaagtattttgaatggttttggctaggatggttaaacaggttaaaagctagttcttgatggttctaatggaattccattatattaatatattacattttagagccatatattacataattctgtctcacatccatggtgtgctatgttttgaaacattaatttgaaaattatataataattcctaatttatgaaaatggcttcatgagtgtggtcctagacttgctatatgtgaacattatttatcttttgagaaatttagattagaaagtcatttttccttaaaaaagaaaaaaaaaactctttatgttttgaaacctgcagatttttctttcagaatgggagtttctttgaaatgtttgtagaaaacactgaattttgtcattctggccataagtcacattaataaatactatagtagtcaagcagtatatagtttaactgactgtgaaattattaatgtcctatgaaatacattatttctccagtacttctgacattgctaccttaactacaaatcaaaaggcagtttgggaggagtcaaaacattgcttcttgctttccagggaagaactgcataattatttgccatattgatgtgctagtaaaaatgtcttacataatgatgattttaaaaaaataatttaccgtcacccctgaattgggaatacacatttttgtttagtgtgcatttatatttcatggtttaggtatagtgggtattaataaataaaataataaattgaaattgtgtttgtcctgctccaaaagtttagagttgtaatgatttaaaatcataagacattgttgtttaaactatgtttaatttacccaatacttgacataaactatgctacttgagtttttaacttcttatatacttaaaaaatatatatttaatttatagaagatcataaccattagtatctgatttattaatttagattttatcaagataattctgacttatttttactttaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggtaataatcatgaatttagtgctactctagttatgttctgttatgttactggataaatcacattttctgttaactctgacattcagtttatccagactttaaagagtacttctgtactcttgtagactaatgatcattatactgtcactgctagaattaaaacagtgtacatggtgtgtgaatgaatggatagattgatgaagagtaaactaacttgtttattttatagatgagaaaacagaggtttagaaattgctttaagttgcagtagtggatggtagaattcactatagttttgtacttaaactgatgaccctattagacccacagcatgatccaaaaatgctttgtgagtactcatggttacagatatctttatcccagcagcctttttgtagaaataggcaagctgattctaaaatttatatggaaatgtaaaggtcctggaatagccaaaacaattttagaagaataaagttggaagacttatatcatctgattttaaaacttattgtaaaacttactacagtgatccatgcagtgtggtgccatcataaggataaacataggagattagtggaacagaattgagtctagatgtaggccctcacacacacagtcaattcttaacaaagatattaaaataaggtagtggataagaagacagtcttttaaacaaatggaacaattggatatccatatgcaaaataatgaatttgaccattacctcatattatttgaagtggtcgtgatcttaaatgtaagaacaaaaactataaacttctagaagaaaacataggaaaaaatctttgtgatgttgagttagcaaagatttctaaaagcacatagcaaaaatgttgataaattgaatttcattaaaataaaaaataaactttgctctttaaaagaaacattaaaaatgaagagggaagctacagcttgggagaaaagcacatatcaaataaaggacttgtatcaaaatatataaagaattcatataactcaataataaaaggacaaacatgggcaaaatatttgaacagacatttcaccaaagaaaatatgcaaatacaaataagaacatgaagtaacactcagccttatcagccattagggaaatgcaaattaaaaccataacgagatactacttcataactgctagaatgaataaaatttaaaagacaaaaaatacagggattgatgagaatgtggagcaaccctcctaacattactgatagaaaatagttgatattttcttaagaagtgtaaacataaatttgctgtacaatcagtcattctacttgtaggcttagcatgccaacatggcagcatttttcataatagccaaaaacttgtaacagtccaagtgcccatcagctggtgaatagataaagaagatgtggtgtgtccatataatagactactactctggaataaaaaggaacaaactactgatacatgaataatgtcaatgaatctcaaaaacatcatgctaattgaaagaagccaagtacaaaagattagacgttgcaaaattccatttataaaatggagcatagaaagaaagcaagtcacgtggttgcctggggataggaatagtgattgactgcaagtgggtacaacaaacttggggatggtggaaatggattatgatgatggtttcacaactataaatttactaacattcatcaaactatatacttaaaataggtgattttatggtatataaattacacatcaaagctgttttttaaaaaacttcagtttttaaaatttggagattgatttttacttaaatgagtttacttcttttatccagaatatataataaaatctttagagttagatggtgaattgagattgtttggttgagctcactaccaaattttcatcttttggccctgaaccggtacattaagattatatcatatgtctttattttattttttttaagctaaccagtttatatatcttatttccaaacctatgctgcaggctagagattttagtctcttgtaattctatgtttgacaataaattttgtcctcgaatgttgtttaataggatttgaagccacagacatttagaaatgcttatgacataccaagacgaaatcttttggatcacttaacaagaatgagatctaatcttttgaagagcactcgcagatttctgaaaggacaggacgaaggttagaacatagtttcaatactggtatttttaattttttttctttatagtctgaaaaagcatagcatggtgatgtaaatttcaaagaattattacagtactataacattcttattgtaagttcaaacaaatgaagtaaaaggtgaatcatccctgattctgtacctttcttcctaccatcactgttgccccaaattctcttccctagaggtaacaacctttcttaacagtttagtttccttttatagcttttctcatgcattcatgcgcgcacgcgcgcgcacacacacacacacacacacacacacacacacccacttatcaaactgtatacttaaaataagtgatttttcttatctcaatcattttcttgagataataccagtatctgatggtttaactctggatggccagtttcatgacattttctgataattccttcttcacctttatccatggcacctactataaatcaagtcagatgagactttaaacgtttgccacctctgatttaagagttctaacaataattttatataaaagagttagctatgcgacttttttttttttttaccatactgtacttccattttctacaaattctactataattaaattctgtttatttggaatagcgcagaagagaagagatacatctttcacggtaagatcacacatactttttttttttttttttgagtcagagccttgctctgtcgcccaggctggagtgcagtggtgtgatctcggctcactgcaacctccgcatcctgggttcaagcgattctcctccttagcctccctagtagctgggattacaggcacgtgccaccatgccctgctaatttttgtatttttaatagagatgggattttgccatgttggccaggctggtctcattccttacctcaagtgatccggatgtctgcctcagcctcccgaagtgctgggattacaggcatgagccactgcgcctggccacacatactttctgtatgtgtggaattaatggcaatgtatgtatgtgtgaaattaatggcaatttttgttttgtttagatgatgagatcagtattttaaattttattttaaaatattttgtcgcagtggttataattgcaccaaacaaatttagaatatgttggtaaagaagactgtctagaataacactaggtagcattcatatataaggaaacattatttgagaactaattggaggttaactttttttgctgttgtattctttttgaaagatcaagtgcacagtgttcctatagcacaaatggggaactaccaggaatacctcaagcaagtaccttctccactaagagaacttgatcctgatcagccacgaaggttgcatacatttggcaacccctttaagctggataagaaggtaattttgaaatgttctattatgtaatttgtttatggtaggcactgtcagttttatagttcttaatttaactgaagtaagctgaagctattttcctggtagagtatctaataaatatgaacagaatatagttaccttcattggaattgacactggttgtgccatttaaacattgtttgtaaattcaagaaagttgtattcttttttgctaaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaagtaagaattgtttttttcttaaacattatttgctgccttttggttccttttcaaggaagatatttttgttatagattatagaaggaaattgattagtagtacaatgagtgaatgaatgtatagaaaatttgtttaaatgagcatgtaatcatttttgtatgtctttttaatgaacatttgaacatttcttatttatgatgctttattagctattatgttctaacatacatttgcaaatctttcaaaataatactttcgaaaggagcattatcactatccacagaaagatggttttcaatttcagttgaagtcaactaattattaaatatgtatgctattttggataatgctgtgctttgaggtataccactgaagacaggagtgatctctgccctcatttataatcagcaaggaaggtcagtcattgaacagatattggaagtatgttgaatgttacgaaaaagatgtcaagtatattctggaagcatttggcaagaggatttaagtcaatgaagtcaaggcacttaactgaagaagttaatgcttaagccaaaagctgtgccgtttgcttatgctggagcaatagtatgtgcagaggcataaagagaaagacattaagggaatttaaaaaattccagtatagcaagggtgttgggaatgaggtaaggtgagaactgaaagatagaagccagattatggaaggtcttggaagctattttcaactttattctaaggacagtgagaatccactgaaaggcttaaaatgatggtgacctaatctgattagcattttatgaagaccaggttgactgtaatgtgtgtggactattatcagagaggagcaagaatgaatgtagggaaaccctaatgaattaatggacttatcaattatatatagtggtcatacttacagcatgttaactgaagggaaacaaaatattatatgactcctgatggaagtatccaatactgcctttgaagttgtcttacccaaaaaaaaaaaaaccaaacaccaaaattgaacatcaatgtaatcaaaccaatttataggaaatacaggggacagagaaacatgtgggataccgttagtaaaatccagattgtagaaaactctacaggacaaagaatctgttgggtttttttcctggaaaaaaaatattttttccagaaaaataaaaggggtacggaaggattttacagattcaaatgtagtttaagagatatataagccagttgcaatgtataggccttaactgtactcagaatcaaacaaaatcaaacttttccacaaacagaaaacatgttggagagtatggacactgactgtatatttgatgttattaaataattgtgcatgcacaggaatcagttgggaaacccggggaacagatgctgctgacctgacagtggggtttcaagaagaatatgtatttgagaaatacctggacataccactgaaggacttggttactggtcagatgttgggaccagagcaggggaggagtcagacgtatgtcttgagagacactgggtgggtggaagaagaaatgataaatgagtttagtttagaagtgcatattaggtcatcaagtggagatcctaagttagaagatgaatattgagtttgggctcaggagaagaggattgggctagaggggtagtatgagaggcaggttactgcctattgcactgaataaaatctcaccaaggcaaaaagaagaaaaaacgctcagaacagaaccttgaaagtgccaaagttaagaggagaaagcagaaaaggagattgagaaggaagaattttagagctaggagaaaataggggagaatttaatgtcatggaagctaaagggcaagataattgagtgggtagttgtcccaaatactttaaaaaaaaaaaaaaaaactgttcaatcaagagaaatggaaagattctgtggtctttggcgatcttagcaagagcagtttctgtggagtaaaggggcagagcctaacaaggggttatgggaggagtgagaggtgagaaaatggaaacaatggctatgagtataaacgaccagttaagtttagttgtaaaaggaagatgggaaaagagcatggtatctggaagagttcacagggttttgaaaatggtgatttttctttgtttttaatatcagagatgcttgagcatgtttcagtgctggtggtggaaccagtaaagagggagaggttgaaaataaaaatgagaaaaggcatactcagcacaaaattactgagaacgcaagagggaatggtctagagcatagatgaaagaatgctccctccattgacactgaatgtgggggaagtggggcgagggtgtgtgcaatttagttagaggaaggtaaaggaagtcccttaatcatggctttgcttttcttccgagctctgtgaggtagaaggtgaagtatactgctgagacggaaggggatattgggaaagtcagaggtttgaagagagtgagggagtttaacaatctctgtgggagagagagagaaaagattgtgataaggttgctagacagtgcctgggatccaagtagagatggtgattgtgaccactctgtagagctgggccctatttctccagcagcgctcatgattccaaatgcaagtctggggcaagcagatagtgagtcaagagatgggattttgcttggcagatgttatgggaagacagtagaataagagaaattcagacattagtaaaagtgatatatcacttttacttacagggatataagcctgatacagaattggctacttagaagggatatggttaataggaggaagaaagtagaggaattgctagagtcaaagtctggctgagttaaggagcagtagcgggagtactgtgaagatgatactcctccatctctgaatttgtctggatgtgaaaggcgaaggtgtaagtgtaagttctttagagagaagctggggaatggggaggccaggttcttaacaggtgatctgcttaaacactgaagtcaccacagcacttctcagacttgaatatgcatgtgaatcacctgggaggtctagttaaactacagattctcatttattcagtctgaggcagatgagcatttctagcaagctctctgttggtggtactgctgcttgtccacacaccagacttcgagtagtagtaagaaccaagaatgaagtcagaagggctttgggggtggaatgtgcatggcagatgtgcttgatagcaataactgaagcataccttgagaatgaccctgcttgcagacaacacctgcatgcggttgggagttctgagctagggaatagggtggctaacccaaagatccattccctatctataaggaacatctgtgcccctaacccattgtgaagtgaatgcaggccagacaggggattgaggccctttgttttgggttaaatgaaggttgccaggtggaggttgttagggggaagagtgctaagtgaaaatacgatataaactgtatactttttgcaagcagttgccatttttctgcccagcctgctgccactgggccgtgcagttatcctgtccagcccaccaccattggactgtatgtaaggtgcttctcctgcctagcttgccaccactgggcttgctcccctttatgtagcccccaacaaaacgccttgtcttgtttgctggctctgggtctcttctttggcttcttgaacttggtgccatccccactggagttgataggggctcagcacaacagaaggaaggctatgaactgggtgccagagacaacagtggcttacaggcttgtaccctggagattggcctaagatagtgataaggagagacagcgtgaatggcatggttgagtctcacaagagtgcaagggagtaattttgcaatagcactaggaagtgaaggaatcagtgactccatgtccttttatgcctatggagattgtgcaagagaaagcaatttctacttttggtctggaaaggagagcagtctccatacaggagagctgggtttcagttaaagcataagttgttgtagagaatattcagtaaagaggagtttgcaaatcatggaatcgaatttaggagagagtcaggaatttgggggatttgtgatgagtgtataggggaatatgggtaaactaagtttatagtttggacaggaaatgaggacagtagagatgaattcagctgggatcctggaggttggtgagcaatcagagaacttaaaattcagctgctttctgtggggcaagtctaataatctggtgttaagaggaaggcttgcgagctttcagttttagtagtctaataagctgaagtgggcaccaggttgctctgcactggtaaataaatgatgactagattctctagttagaaggtatactgtaaaacattacctgtttggtggtatgttccctgcagaatttggaacagttaaaggcagaaatataagtggaaagtaaaaactacccagtgtttacttttgcctctaaatgataccagatgtataaggcatatgtgtgagttagggctctctaaggtagagatagatgaccgtgataattttgatcatagatatttcattgaagtatcaagaacctacttgtttcaataaaattgctatagaataaaccagaaaactaaaaactacttgaaattggctttattttttcctccaagggtaaaaattgtaaatattttgtaaatactgtgtatgtgtcacattgaaatctaccgtatctttggcaatgcttaaaaactatatcacattatttgttaacttgcattagtcaaggaaaacagttgacttgctgtagtaatgttcttttgtagctttatttactgtatgctttgagactggatcccataattttttccccgtatctttgtttttagtttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaagtatgtataataagagacgaacctcagatctgatttctgtatgtgctcaaaaagcaaaaaagaaaaaaaaagtcaagtaactgtagtaaaagaatacatatgattctagatctgtcttgaacaacatctcagttaagatcctttattcatctgaccaacaccaaatatcttctatttccaaggtactaggtatggtggtaggcagcagggactgagagcagagcaacactgtacagataaattgacaggaacccatagtcttgaatattctgaccaacgatggaattttaatatagcagctagctcacaagagatatagtgaaaattaaatgacttcatgtctgtaaagttcttgtcatagtgcctaccactatgtttagtagttaaactgtgatattataggatatgtttaggccaaaaaactaaagttatgaaagctctctggtatatgaacacaaaagaacttcgtgggaaaaagttcagtattattggcattcatttagaggatgttaacagatcacttgccctggggtagtagaatgacctgggtggtccagaaatgggaacaaatcagtccttggagttcagacgtttatagcccttgcagagtttcatatgaaaactttaaactgaaataacactcttaacctgtctggtttttacccccacttcccagttacccccatgttagctgttagaattttaaactgtaaggatggagttttgtaaaggccacttgttcttattttttagtgatactaccataaagctatttactcatccttttaagctttatgtttgataccttaataggaacttttacttacaaagcagggtttgattagttgttttatctttgttgctgtgtacttacttttacatatatgttaaaatataaaatctctaatgagtggtgaaatttttatgtagaatgtttttatctcagtatatcttaatatcataaactgcaaaagaagaatattgaataagaatacaaatgaaaggcacttaatttttctttttgtttcttttgctttaagaatatgaaagaatcttcactttactgaagcatgtgcaaggcagtttacaaacaagactaatatttttacaaaatgtcattaaagaagcatcaaggtaaataaactattgcatataatgaaatggtgatgaaatgagtccacagtttatataggcagtattttaatagtatccgttttgcacttgtattgtttataaatgtatatggcataccaacatataaataaattcttattcttttttagtttattgaaagaaattcacttagaaaacagccacacatacattcttcaggaattatggaccttttctccctacaaattactggatacttggagaattcttgttattcttctctgtagctttttgatatctttacattaatattttataacctttaatttttctcctttatacattaatattggtgactaaaaataacgtacttgagtgtcatttatttttacatgggaaaacgtaattaaggagacaagaattggacaaatgggccttattctgattgtttcagtagcccaggatcattagtacattggccctctgtatccctgggttccacattcattggattcaagcaaccacagattgaaagtatttggaggcggggaaatggatggttgtatctgtattgaatatgtacaggctttttttttcttgtcattttctaaataattcagtctaattcatatcgtatttacactgtattagtattataaataatgtagagattatttagagcatatgggagaatgtacataggttacatgcaaatattgggccattttatacaagggacttgagcattcgtggattttagtgttcatagggaggcctagaataaatcccccatccataccgagggatcactgtgtaaagaaggtggataaaggttataaatggtaattaagaagtgcaattaactggaaaacatagttgtatgagtttaaaaacattttttattttcccttcaagattttggggattttagtattataagaaaacttggggcttatcacatcccaccttctaaatgtaaacacacttatactttgtccccctgtctcttctatgctacacatgaagattttagataaagttggttttgtttctggttttcttttctttttgtacttttggagtggctagagcataggccagtttgcaggatcaagataaggctataacttttcatgtaattttgagtatttaacctattatgctctttatggtaacattctgtcagctaaaacctcattaggaatttatatccccggtatctgtacttcacttctgccaccttttagagagttgtgtagtattatggtggctatttatattagcttctaagtagcaaggaagtaggaataaaatgtccagtgtcttgggatattcttaaaaccgtcagcagttacgtatacagatgcaattttagtctgtccatatttgttactgaaaatctttaaaagttgttacttgaactttaactgcttgctatactctgtattatagatgtctatccttgatttgctagctctcaaattgtaatagaataccatggtttttaaatgctgctgaccaattttcatttcttcttccattttgtgggagattatattcatactttgttcacattcctttcaatattcagcttacaaagagcatgagaagaagctattgaagtatttgcttggggagcccaaatttcactagagtgtttgcagcccttgaatatattttgaatatattagttttttgtttttttgtttgttttttcctttttcttttcggttgtggaaggaacaacctctttcccattgtttagccctagagtgttttagggacaaactataatactgtactaggataataatttgctaatctttcaacatattttatattgtcgtagtattgatttttctattttcatttcactttgaaaaatcttcccaaaattttctctcctttcttaaaaaaattatactgatatatactattcattaaaaagtaattgagagtactatttattttttcatacaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctattttactcttgtgtggtttaggaaataatcacatttaaagtaatcatttaaaaacatcctaagataatggaattttaaaggccttgctttttagcattggaaaaatacaccacttgaagttcatgtttgttaagcctaactgtaattacatgttacataatctgcattgcctttttactatatgttcgtagtttttgttggccatgccaacatactcccatttctgcctagattatgggaatgactttgtatggggcagatagacagatactttaaaagctatttaaaaagcaaacaactttggatattattggtttccttacttcaacaccttttcctttatcactaggattgtggatggcacgaagctgaagctgttagggagtggtaggtttggagtacagtacatgctctgaaatatctagcctttagcagcttcatgccatgcttgcaaaagcccacaacaaattggaggcctccttgttctgctctgctgttctcacacttaaactctgttttatttataagctaaatggaaaggaaacacctttaagatgactttgctcattttgcatcccccctgagtttcacaggataaggaaaaccacgctattcattctccaccctcaattcaacatggcctagagtatccgtactgaggaagcaatcttatggcctgactcactcaccattcatgatcactgctgtgccttttagtggtttggggggtaagcagtagaaaagaaggtcaaaatagatttggattaagagtaggcaaaataaacttataacatttaaaaactgaagtatttttaggtttataatattgaaaatcacatacccttagctttttacactttatcagacatttttttaaatttcaagggtatagcaaaatgaaattataactttatgaagaaaagcattgatgaaagtggagaacatgcatttagtctaggggatttgaaactctcccaatactgaagacaaaccctgtcaagaaaaagaagaatttaatattatatagtattttcatatgcagttctttaagctttgtttacttctatacaaatacttttaagtaatgcaagataacatttaatagatggaattgttaaggtaattgcctgtagtcacattgctaaattcattgagagttacacaaaatccagaatatattgtctgttcctaaattatatatatttagattctggaattactaggaggaattagaagtcattcagataaaaattcatacttaacaagagtatctaggaaagagattcagcccatcccaatattgagcagctttccttatcagaaagttttattttctgtttcacagattgctcatgacctttaatacatttttctgaatgaaccctggagggaggtgagaagtagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattagaatacttgttgtagaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtg

SEQ ID NO: 15569 - DNA, 10082 bp, Human
ttaaataaagaagccagccagaatttcaggtttctttctttttttttttttttttttttgggacagagtctcactctgtcgcccaggctggagtgcagtggcacgatctcagctcactagagcctctgcctcccgagttcaagcgattctcctgcctcagcctcccaagtagctgggattacaggcatccgccaccacgcctggctaatttttgtatttttagtagagacggcgtttcaccatgttgaccaggctggtctcgaactcctgacgtcaggtgatccacctgcctcaatctcccaaagtgttgggattacaggcgtgagccaccatgcctggccagtttcaggtctcttggagagtgttttcacaggataacacagcaatgattgtcttgaagtcgtagaatcttaataagactcctttgttcaaagcacattttcaaggatagccttatgttatcagagaacagagtatgtctgtaatggatacagatattaacacatactttactgcccataaaacaagtgttcctgaagaacttctgttttaacagctgaccaaattattacatttgaatttgcagaattcctctgcctccctgagagcagaggaaattaggcattgccttcctatctttcttgtgcttctttttgttaattaaaagcaaaataaaaattttaaagtgggccctggagtttcattagggtttataaaaaaaaaataaaaaaataaaaaaaaaagaagggctggtgtgatggctcatgcctgtaatcccagcactttgggaggctgaggttgggagaaaatattgaagccaggagtttgagaccagcctgggcaacacaacgagaccccatctatacagaaaataaaaacattagttgtgtggtggtgtgtgcctgtagtcccagctacttggggacgctaaggtgggaaaatcacttgagcccaggagtttgaggctgcaatgagctatgatcagaccactgcactccagcccaggtgacagcaagactctgtctctttaaaacaaaacaaacaaaaaaacaggtttggaagctactgggctagagagtgacagggatgccagacaagggtatggggaaggcctctgtgaggaggggcaacatttgttatccatcttctcgagggccaggatttttgtctgtcctattctctgctctaatgctaagaaccgcatctggcatccagtaggtgctcaataaatgttgaataaatttatcaaacacagagcacctactatatgccaggcactgttctaaagactttccaaaagcttaactcctggccgggcacggtgactcacgcctgtaatcctagcactttgggaggccaaggcaggtggataacctgaggtcaggagttcgagaccagcctggccaacatggtgaaaccctgtctccactaaaaatacaaaaattagctggacatggtggtacacggctgtaatcccagctactcaggaggctgaggcaggagaattggttgaaatcgggaggcagaggttgcagtgagccgagatcgtgacactgcacgccagcctgggcgacggagtgagactccatctcgacaaaacaaacaaaagcttaactcgcaatctttgcaacacaccctacctatgttgtaggtgctgtctgtgagcacattttacagaggggaaacaggctccagaaggggggtgttatctgcctgagggttctctgatggaatatggcccagcttattccctcctaatcaccccagaccctggtgttgtccccagctgggcccatggaacaatggatagaccccattcccctcctgaatccctccccaggctcctgccacttccctttctcacttcccttgtgctgacctccccgaccacaagctgaccacagggaacctctcaggaaaggagggccgaggttaagggagggtggaaggtggagcaactgactcgatgctccctccacccccacgagcaggaacatactgagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggtgagaatttgtcctaggagcttctattgaacactgtgaggttgctgggaggagcgcgaggtgctggggatatagtaacaaacagaacaagaccaagagtaagacaggaaatggggaggggagagtagagaaggaggcagaggggacagggtggggtcaaagcaggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggtgagggggtgagggcccagctggccccaggggtgtccaggcccaccacatccctgaccgagccccacccacccatcccctggccctgttacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggttagggggagcctggggtgggggatgggggggagggaaggactgtctgtgggggtcacccaaaactgggcactttctttctctgggacttccaagggtggccctgaggccctgatcgtgaccatacctcagggtttctcaaccttgttactattgacatttggggctggaaattcttggctgggggaggggattgcttacctgtgtattgtgggatgttttgtaacacccctagccttccactagatgccagtagcaattctccccaccagctgtgacaaccaaacatgtcagcagacattgccaaatgtcccctgggggtcaaaatcacccctgattgagaaccactgacatagctcacacatattgagcacctcctgcacactggaagcattgcaggtggggtgcagcttggtatttccctaattttgatgacagctcatgtttattgagtgcttactgtatatggacacactgtgggggcgggaaagtttggggaattcaaagggcagctctaggcccctaattatgatgacacttcacattcattgagcactccctgtataccagctgcatggcagggttgggagatgagcttgaggatttctgagggtagctctagtctcctgatcatgatttccagcttgcatggattgagcccttaccgtatgccagacctgttttctacttgtttactatatatcccagatacaccgtgggcatggggagcttggggatttttgagggcagctctgggccccaagtcatgtcaacagttcatcacatctatttggcatgaacagcatacctagggctatgcagtgggttggggatagatctggggttatttctgaggaggcctctgaggtcatagggatgatggctcaggtttattaagcactttctatttacctactaccgtgtagtgtggtgatctggtgggtttctgacagcagcccttggtttctagtccttacctttgcttactgcggacctggtgttggccatgccagccttccaatggtaactccagatgcctgattgtgaaggtaaatgacattatcaagcacttattgtatatccactgcttcccatcagtatcccaatatccctaaaaggtaaggacttatcaatccatcgcacacgcacttgcctagcaacccttcgtgtctgcccacactctggagtcccacatgccattcttgttagctcatgccaggatgggatgtgtgtgctcttctccacaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctggtgaggaggatgagcaaggcgggcaagcactccctgtcacccagcactggtgggaacgatcggtacagaggtcctcagagtgggcccgtccccagtgtttgtaaggacctaaggaggagagtggtgggaggtgaggtcagagaggtgaggagggtccattgcctgggggccacagagaggacgttggcttttcatctgagtaatttggactgtgggcagaggaggaacgtgatctgactggggttgggaggagaacagactgtgcacggtgagggtgagaggggaagcggaggcacccatgtgaaggttgctgcggcaggcccggtgagcggggatggtgggcccagaatggtggcagaggatataaggacaggattagctcatgtggggcactcaaggaagcaaagagccctgaatgacaccccacctccatcccattaccctctcttctctcccacagagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccagtgagtgagggaagccacaggatgctgatgggtgcacccagcgtgggtctgcggggttacagcagggaactgccaggctgagaggactttagcatgcatgaccacacctgcatccctccacctcccaccccaccacagcacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccaggtacaccaggatgaggctgctgatgttgctggtggggctcttgattgagggcagagatgctctgccatttctagagttcctaggccatgtgaccatgcagcccttcatttggggacagtctgcttcaagggtctaggggctgagaggaaggattgaggaggcctttctcctcactccctttcctcctccaacagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctggtcagcatctcagggttcacgatttgcatgcctaagtcccccttgcccttctctgctgcccagctcctgctgctgaggccttgttcctgtctctgattcctcctttcctggccctgataccttgtttccacccctggtcccccattcacacatctgatcacctctactccctcctaccgccctcattccttcctctgaacccccttgctgattccctgctttggtccaatcccctgttgccctgtctctgcagtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgcccctgtgagtgtcccacagactgtgctctgagggtggggtggcccatgcaggataaggggtttccaactctctgctgtggacctcacgtctctgcagcctccctctcactttcccaccaagacctccagttctgactctgtgacccctacccctcattgcagtgaaaggatcatggtcagagtggagtacctgggggctgtgcatgcccccctgtggacctaatcctacccgtgcccgccagcgcctctgcacacccttgctccccaagtacccgtgagtgagagggcaaagtatgcctgggagggggtcattatattacaggcgggagagtcggctaccccaggaaaccagggtttccactgctgaatctaaggtatctgccttgccgagtgccacctcccagctgcaggaagtggggagaaactaagaagatgagaaagaagttcttggaggataattcgtagcctctgtgcccctcagtcacctgttcagtcactcatccacttagtccttcatgtgtcattgactccgaccttcagttacccatgcttttagctgccatcactcaggcctccattcactgcctgcctcccacagtcactcatgcctccatccactttgtcagcatctcactgagccaaggcactccaaggctttttcagcaacagttgcagatacacacagcccagatcctgtggatcctccaagggacccagctgagcaagcccctgacaggaggcatatgaggaacagctggtgcatgcaacaggtgctgccacctcaacctaggtccaggaagctgactgggcctcccagggcaggtaggggttgggaaaggcattcctggcatcaagactgtgaacggagccttggagctaggtgattagccgctataagtgtttccaggtgccagaggggcccaggtgttagagagggttaaaatgttcatcccttttcttccttccacatacatcaagctactagattaagtgaactattcccagctcgtggaagggctgccatctgggaagggatctcccggctgagggggttagagtggggcctgaagattagaggtgttgaatggaggcacaaaggacttgagtgagcgagagactgagtggaggaagaagcaattgagagaactgggatgggagtgaatggagggctttcctagtgggacaaataacccaggtaaagacctttctggacagggactgagcttgaataaagtggaggagacagagagagagattggcttggggcagggatttgggcccaacaataaggccttgaatgtcaggacaaggcattgggttttttcctggaggcagtggaaagagatataaagggtatatatttcggaggtaaaagaaagtagctcatgccaacaagtaacattcaccagcatttattgagcacttgctgtgtgccaggcactgctctgagcactttacctgaattaactcatttatcctcattcaaccccgtgaggtgagtattaatattactattcctaccattctcattttgcagatgagggaaaccgaggcacagagaagctaaagaaattgcccaatatcctatagctaaaaagtagtgttgggaggccaggcacagtggctcacgcctgtaatcccagcaacactttgggaggctgaggcaggagcatcacttgagcccaggagattgaggctgcagtgagctatgattgtgccactgcactgcagcctgggcaacagagtgagaccctgcctcaaaaaaaaaaaaggaaaaaaaaaaaaaaaaaaagtagccctcggcatatagcaggcactcaataagaattgaatgcattcttgccttccctgagattctcccttccgttcctccccacccctaatgcctcaggcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcgagttcgtctacgattccttaaaggaggaaaaacaacctatccccttccccaaaagtagggtgatagcatctcatagggcaaacagcacagcacgggccaagacacagcagcctgttgcggaaaacagtattttccactgtggtcgcaggttggcaggagtgaaagcgagtgtgcagtcccagcctctccccgccgctgccataaccccaatgtctgggccctgcgcagcccccttagagcctcagggccgcccggcacgttcctctgcagagctccgcgttacgggtttcctgattggctacttgtcctggcaggcacttcttgattggccggcgtgcttgttcgttgtctccccgtctcctggacctccctagattcccaccagccggaaccctggaggagcctctgccggccgactccgactccgcgtcagtcgaggatgaacggcagaggcgtggccgaggctggcaccctgccgcccgagcacctgcacccacccactcccgacagcccagctccaatgccacaattaccagcgacaaatagctcggcgaggcggggggcgggccgaggaagtgcctgtgttgcgctctgagctgaggaggggcaaagaagctagagtcagtatccgcccggaggagcccccaagacaaatccagacactttcctctggtaatttgttcattcattcaacacttattagcgcctgctgtatgctaaagctgagtctgagcatctagggtggaggagggctggtagaaagaggacatctgagtgagggaacagactcagaaggtattcctttcgtgtgaacatctattcaacacttaacgcctactgtatactaacaatagtgctggacatcacggagaatagagaagaagaggaatcagagcgttacgtgtctccgcagtaaagggaacaaagccagacaccagtgcttttagcatttgctcattcatttaccacttactgaatgccgggccccttgtgaagagacgcatcataagaatcataataatcatggtaatagctactacttagaaagtacttactgtgtgcttagtagtgtcttaaggctttccatagcatgaactcatttcgtccacagcaaacccatgtgggtaagtattattatccccattttacaaaggaaacacgcacagaaaggtagtaggctggacatttttgaagcatcatggattgtgatgaggtcttaaatgtcaagagtgctgtgggtggaggggacccgtctgtgtgggaaggttcgggtaggaggtttgtgacatgcacacccagagtatattggtacacttacttgacttctctggttcgttttccccttattcaagtggaccagtcaatgagttgaagtgaagatgaagttgatgagtacttacttggtcatcttgggaagactgagccaaagtgaggggttctggttgctactacagggtatgagagaggtatacgtttacaagaaagtgggaattcagctgtgtgtgtgtgagagagagatgcagacctttgggcctgtgcaagaattaaggatgtattgatatgtggcatgtgtgtgaggttacaaatgtatgtatgccataacaatgcaggagtcccgtgtgtgcacatacacattaaggtgccatggacatgtatgtgtgagtcacaaacatgggtacaatactgaatgtgaacatatgtcaggggtgtgtgtttgagagtcgttgctcaccaatgtacagcaaaatcattattggggccccttttgtacgcctattcctgctgaacaagatggagacagtttgggggagcctaacctttgccttagtgaattgaggcactcctgaggtgaatcctcattcctctacaaaacaatctacaaaaaattaatttctggaaattgagccacgtggaaaaatgaaatggtgctggggccacaagtactaggaacctaggaatggggaccccaggaagaggcgcagcctggag

SEQ ID NO: 15570 - DNA, 8493 bp, Human
tacaggtgtgagccaccatgcccggccaagtgctttcttaaaaaatagatttaggctgggtgccgtagctcacgcatgtaatcgcagcactttgggaggctgaggtgggcggatcacccgaggtcaggagtttgagaccagcctggccaacatggtgaaaccccgtctctactaaaaatacaaaaattagccaggcgtggtggcgtgtgcctgtaaccccagctactgaggaggctgaggcaggagaattgcttgaacccaggaggtggaggttgcagtgagccaagatcttgccattgcactccagcctgggaaacaagatcgaaactctgtctaaaaaaaaaaaaaagatttagaaggccgggtgtggtggctcacgcctgtaatcccaacactttgggaggtcgaggcaggtggatcacctgaagtcaggagttcgagatctgaccaatatggtgaaacccccgtctctactaaaactacaaaaattagctgggggtggtggtggtgtggctgtaatcccagctactcaggaggctgagacaggagaatctcttgaaccccggaggcggaggttgcagtgagctgagatcgcgccactgcactccagcctaggtgacagagcaagactcttgtcaaaaaaaaaaaatagatttagagggtacagctgcagttttgtgacatggatatattacatagtggtgaagtctgggcttttagtgtccccatcaaccaaatagtgtacattgtacccattaggcaatttctcatccctcacattcctcccacccagaatagtgctggatacgcagtaagcactccataagggctgctggtagtttttgttgtgttcttgttattgggctatcatccctgagttaatcaaacttaattagcaagggagtatggtgagtgaatgagataatttatacaaacactttagcacatagtacacagaaagtgctcaataagtggctgccatcatcactacaattattattattgatctatcctcctcgaattaaggatgttaatcagaaccccagggaaggttcctgcattgtcagaaagctggtgggcaaggattgccccaccccaccccccaccaggggtacaggtccatggggagggggcagggcaggatggggtggggattagttttctactgacccactcacttgcttctttcaccatcattcatggccacccccttcccaatgctcattcattcacccgcaccattccctgcttgctaggacggtgccactcctgagttacaaccctggtgccaggtagcctctgtttgaatcccggccatgccctgtgatcttaggaaaattctacagttcctctacgccccatatttcctcatccgtaaaacgggaataagaaccggtacccatctcagagatttgttgtgagctttgagtgagataaactatgctgagtgcctggtatacagtaggtgctgtataaatgccggctatttgcctgtgttatttgagaccctggctttggctcctggccacctgagttccagtctcagttctgccatgtattgactctgtgatcctgggtaagtcacttaaccactccgtgcctcagtttccccattttgtattcctcccctttcacctgccttatctccctccactgctgctacttaatttgtttcctctctgccacccctcaccagcatgtcagacatacaaaacaagggatttttgtgtgcttggcacacagtagatgcacaataaatgttgaagggctgaactaatttgggtttgagtcatagggagcttgggggatgtgggtgattggatagattctggagactttaggggactgggccgggggaaatgcggcctctaagctctccgctgaggcggcttggaaggaatagtgactgacgtggaggtgggggaggtggctggcccgggcgaggcccagggagagggagaggaggcgggtgggagaggaggagggtgtatctcctttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagaggtaagcagggcccggggtggcccagcagggaccggagctgggctgcagcttgggtgctggccaccaggcccgtgcactcccgtgccagatgcctgtctactcagcttggcctgcgggtaccaggaccctgggctagtctagggggaagagggtcggaggctggaactgctttcccaaccccgaggctccaaactccctagaacccctgacatccgcccccaattcccccaaacccatgaccccctaatatcacaaatgctttccaaatccccccgcaaattccttcatcccgaaatttccctcatcgccccctaaatacccaccgctaacccctgcagctccctaaactcccccagctccccaatccccagttccccagctcccaaacttcttttgccctcaaattcctcaagtatccccattgccttaagcccccaaattcccccaaccccttcaacctccaaactcccccagctccctaaacccccaacctcctccaaattcctcaacctccctaaattcccccagcctcttatatctcttaatatacacaacccctaaactctgccgtctccaaactcctccagcccccaatcccaaattcctcacccccaaactcctcaacctccagaattccccaatcccctcattcctcaaacttcctcagcccccttctcccccaagtgccacaaccccataaccccgcaactcactcagtccctcaataatttaaactctcccaactctctaaaccctaaattcctctgcgctccccaatccccttaaaatccctaagcttaccaacccctcaagcccaaatccagccccctaatcccccccataggctgccccggggcaagatggggtggatgacctgcccaggtcagcagatcagctgggccggggcctgcctgacatcccccttccccacagaacccaccatggccccctttgagcccctggcttctggcatcctgttgttgctgtggctgatagcccccagcagggcctgcacctgtgtcccaccccacccacagacggccttctgcaattccgacctcggtgagtcctcaccccactcagcccacacactctgccttggtttccctttcagtccagtggggctcaccatggcacttacctctagaatgattccactcgcccctgcacttcctctgctttagccacactggcatcctcacacttccttgagtactctgtgcccaagcccaccacaggatctgcatgctggctgctccctctgcctggtacactttccccccaggtatccacatgggtggctgcctcaaacgtcaccttctcaggatggccttccctggccatcctgtttaaaattttaacccctgccccttagtactcctgatctcctgttaaacagaaaaatattcagtgatacttgttataacacagtaaggaagaccatattcaggaccatggtgatgggtataggaaccactgcaatgggatcttgcagtcggtgggagagattgggctcaacactgaatatagcatgggccagtgggaatgtgtagctaaggagcagtgtgagggtctgtgggtggaaattactaagaagaaacatcaggggtaagggggattctggctaaaccgacgtaacaggattcttgctgaaggcaggccaaggggaatcagacatcacctgggggatggtggaagatgaagaacccagtcagatagcaaggatgatcaggtattgaggatgatcagagattgaggatgatcagagattgaggatgatcaggtattgaggatgatcagagattgaggatgatcaggtattgaggatgatcagagattgaggatgatcaggtattgaggatgatcagagattgaggatgatcagatatagaatataggggttcttgctaaactgacttagcaaggctctcggctaaaactggattttacaaggaagtgcacagatgggcctaggaggaggttcaggagcctgagtaaagtttggtcaagcaaagaatctttgtcagccccttacccaggtctgtaattccccattatacttaatgtctaacattccatatccttattttgtttgttcttagcctgtctcctcctggctagaatgtgaactccacaaggaaagggatttctgtgttttgttcactgttgtgtccctaacacccagaacaatgtctggcacacagtgggcactcccaaatatttgaggagtaaatgaacaaatcaatgtatgaaaatggcttaagcagtgcccggcaaagagagacactcaacatacagatgaatcaatgaacaaatgtgtaaatcactttgtgtgctgtctggcatccaataacccctatttatgtatgcgctttgctggtatgatgatgatgatgatgatgatcttatttttattggctcatgcagtccatttgactcatatttccctcctctcctgcagtcatcagggccaagttcgtggggacaccagaagtcaaccagaccaccttataccagcgttatgagatcaagatgaccaaggtatcccctgcccccgcctctttcccagcattttctaacatcttcctcctggtcaaaacagaaacttctggccactggttggtgcgagaaagttggctgtgatcttgggatgctatatgacttcagggaagaacctggagtgggaggattatgtcagtaaaagagacacttcccctcatccatcaacagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatcccactgacccttcctcagcacatctgcttgttgctctgcagctctgactattccagacaccagagggtgttacactgacctcctggctagtccaagcctgttccctgatggctcctgatggcctctgagcccagtgactatcttgaagccccactggctattcctgtgcttaaactccttagccgccaaccgggtggggccccttactactgccagtttttccctgtcctttgggacaattccacaggcgacctgcctgactgacccccagggcctattccccagccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagacactgtttctgtgtagtgcctgggaacaaacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgccttactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatcctcaggttttgtaccatgagtctgacttgagtgaaaggggacccagggcacccagagtcccacagtaacccagctggggacttgggaagaaggggtggccctggctccccagccatggctgcaggacattccttggaagggactgtttggggcagaggagaggtgggatggagagaaggtatgagctaaaaatccccaagctctgccatcctccctcccctacttctcccctcactcctctgaccaacttggaaggaaatactgacagcaatgaaatgcaggtagggttcaaaattaagaccagccagatatgctggcccataccctccacacacctccctcaacccaactgtcccctcacccaaactagggtctctagactcgaccctcacctttatgaatcatcctttctctagaaaaactgagtgagagaacctccaaatactcccctctgaggccttcctgcttccacagcggggtccagtccctggctcctgcccctcatactccaaaggtcttgactcaagtgaggcccttgggaactagaatttcagactggtgcaaacattcaatggagcacctgtgtcctcctgacctgaacgtgcttgaaaagggccccaatatatctcctttggtaaagaaaaggacccccaaattccctctcatcagagtacccactgctcttaccagtaagaacccaggtctcctccagggcattctaggtcaccaagcacagccccctggatcttctgtggtcctgtcccagagccttttacactcctgggaggttaccccacggcccaaattatgtcccggatgggaatgggcagattttgaacacacagtactcagccacttaagcagggaatgcgcatgcagcaacaatttctacatcaacatctacaccttggttacgccctcggagggtctgaaccttgtccaccgaaggggccaaccgcagcctttgctgatgggcacaactgtaaggtaagggcccgagccctggttcatccctggtgaccttgtcaatgttccctcagctgcctgcaagaggctgaccgctcctggcaattcgccaaaccttagtgtcagctacctgcactcttaagctgctccctggcctcagggcccatttcctaagtcctcagctcttccaagccctagggggaaggtgaagtagcaggggaaggatggaacccagcgtggaggtcgttctcctgccgacctgtctaccctgcaggtcagcccttcgccaagtgcaatgcagaatggacagggaggaccggagaccagaacaggtctcaggggacacagagcccagaacagcagacgaggctacctccaccagagacctggcatgagctcctggcaggatctgtaaccctgggctcattacatcccccattgctcttgtagaacatctgttaaaataggtcaagtgagcatcctccatccccagcattcggggtgtctgtgggtgaatctctgggagagactctgtgacagctgagagg

SEQ ID NO: 15571 - DNA, 51049 bp, Human
gaagtgtttgacttgggtactgtggaagcctaggggaggaggggatagaatctgagacctgggggtgaggggttcctgcagacagtggccaaaggcagccctcgagagagaaggagaggacattcctggcagaagttacaacacatgcaaaggtacagaggttgcccccttcctacccctctccttagaggtgggttagagatgtatcctttttacagatgaggaaaccaaatctcagaaagattaagtcactttcccaagtgtatggtggaggccccacttgaacccaggcactgtgtctccagaccccacactattactgccttgtttaaaccagccaatgatttaatgaataaaggatgaacaaatgaataagtggatgagtcacctgaaaattctgcaggcaaaagagactccatatctacttacttcttgcctatcttctgccacctctcctagtccaccatcactgctcactatggtcaaggtcctacccaatctggcccctgctaccacaacccccttcagcttgttccagccacattggcactggatgtttcctcttcctggcacattcttaaaaaaatgtgttgatcataaagtgaacatgaccctttgggaattaactggagttcttgtattccctcatctgtaaaatagacattatattatccaccccactggattgttgtgagggttggatgaaatgatgcatgtaaacagcttagttaagagttgggtacaatcagtgaacaaatgattatgaattagtgcttttattgtagtcagaatcataaagatttgacaggttcccatatcccacctctgcttggactacctcatttgctcatatgcaaacattatttggtacctactgtgtgtgcaccatgggatgggcctgcctctgtggaaagttcttgggtgcagggggagacagccatgggcactgatgacatcaggtagttatcgtgagttttggcggtgtccagagcaaagggatggtggcgtatataccaagtgtgttctggtgtgggggtggacacgcaccagggctagggctgcagagaatgtctgtgttgcagatctaggtttctccatgatcatcggtgggaatgtgttttgtctgcaagtgtatgctcatatgagtttccctgggtctctgtgtgtcagtgtgttacctgtgtgtgtgggggtatgggtgtatgcatgcatgtatgtaacatgcccatgtgtgttactctggacttgtatgtctgtatgtatacctagattggcgtgtgttctgtctgtacatgccctcgtatgtttcctcacttttgtgtgtgtttatatgtgtgtcatttcttgtgtgcctccaggccccccttgccaccttgggcaagggtgtgtacaccacccaagtgtccacctccgcttgtctgatgctgtctgtgacgcccccgctctctgcctagctgagcctgtgtggatgtgggagactaatctccccgcgggcactgcgtgtgacctcacccccctctgtgagggggttatttctctactttcgtgtctctgagtgtgcttccagtgcccccctccccccaaaaaatgccttctgagttgaatatcaacactacaaaccgagtatctgcagagggccctgcgtatgagtgcaagtgggttttaggaccaggatgaggcggggtgggggtgcctacctgacgaccgaccccgacccactggacaagcacccaacccccattccccaaattgcgcatcccctatcagagagggggaggggaaacaggatgcggcgaggcgcgtgcgcactgccagcttcagcaccgcggacagtgccttcgcccccgcctggcggcgcgcgccaccgccgcctcagcactgaaggcgcgctgacgtcactcgccggtcccccgcaaactccccttcccggccaccttggtcgcgtccgcgccgccgccggcccagccggaccgcaccacgcgaggcgcgagataggggggcacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactggtaagccactgccgcggacgtctcccgtgggcctgggtccccagatcgttcttctgcgaatgagcaattatcgagcgccgcttgtgtgcctgacacctggccctctcacctaaatctttttcctttaaattattaagctggatgcttcctctgtgccccgcccttgtcgcccccctccgccccttaaaccttgatggatccagggagcaattatcaggcacctgctgcgtacctgttccctactacccctcccccaaaagtctttggcttcaatatatcctatgagccttcgaaaaccgaacgtgtccttcctaccctccccaacccttgccccataggccttgtcctctaatggatcttgtgagcacttatctagtacctgcagtatgcctcatccaagagcccttccccaaggcctttgatttcaatgaggtttgtgagcattctttgagagcctgatactgtcctgttctcctcaacccttgccctgaggccttctctaatgggtcttgtgagcatgtgtccagtctatgctatgtgtcccaccccagctccgtccttaaagcccttttaaactatttagtaaacattgagtacctgctgtgtatcccaccccagcttctctccaaaagctttgcctttcatggatcctgtgagttttgattggatgccttctctgtgccccaactccaagccctctctctgagggccttttctccaaaggatctaggaagcatttgttaagtgcctgatacgtgccgcacccccaaaccccttctcaaacaaatcattttcctccagtgagttccatgagcagttttgaaccttctttgtgtgactcatcttcagaccgtctcctcaaagacctttccctacagtggatctagaaaacatttattgagtgcctcttgtatcccccgttctccagctacttcttcaaagacctttcctttggtggatccatctagcatttatcaactgcctgcagtgtgagccttctctaaaagttctttcctccagtgtattcagcaagcatgcattgactggtgcctgctgtataccccaccctcaaaccctttctgcaataccctttcctccagtggcttcagtctgcatgtattgagcactttctgcatgacccaaccttagacctctccataaaggcctgtgcctccagttaatacagtgctcagatatctggcacttgctgtgtgtaccattccagtcactctttccaaagaccttttcttttaatcactccttggagtatttatggagcacctgctgtgtacctgattgtgtgccttcttcacaaaagccttttctcctatggatgaagaatcgagctcccatagatcaactttctgcactcccatttcccctccccataggacttttccttcagggatgcagtgagccttgatcaggtgactatatgtccatccccagccccactccccaaaggccttttcttctaatggatccagtgagcatttattccttgtctgtcatgtgctccattttaatcatcctcccccaaagaccttttcttccaatggctcccctgagcatttatggagtgtcttctgtgtgttctgtatattcacacctcctccccagaattgttttcttaacagtagatccagtgagcacatatgcaggacctgttgttttggggagtacattcttcttccttacccctaggagagcctgttccaatcacaaggcctctcccaaggtcctttcctgtgataaatccagagctgagtttataatgatcacccctttcccactcccttcagtacccctaggattccctctaccaactttaattcatacccccaaagggcttttagtctatttaagtaacacttacttaagtaaacacttttacttaatagttttactattgacttaatttactaaataaatttagtaaatttactaaatttactatttacttaatagttttactatttaagtaaacacttattgagcacttactgtataagtcactttcaacttcctctttccaagtctctggaaatccctgaccctgcctcaagagctctctctctaggggtctacttcagcctaaatgtattgagtaccagctgtttactggttagattacctctcccccaggagcctttaccgagtagcctttctctccattcagagcaatttattcattctgcagatatttattgcatcctttccatgaaagtgtgggaggcatttattatgcaccattatatactaggaataacccttcttcagctccccttccttcttttttttctaaatgcaggtgtgcttgaaatcctcacctgccagctggccttgctataccttttcctccatgcaaccccacaatcatttaatgagcatttatcgtatactactgagaaccctgcgttaaatgcctcttctcccctttttgtagtcccaattcccccttcaacaatctccatcctgccttttacacaacacaatcctgaaagctcacaatgtgcactgttttccatttattctagctaggcctcttcctccacttagtagccatctccccagctgcctttttctccccgaattagtccagaaaacacttattaatctcttactgtattattttcaaacagccacattatcatccctgcagcaggcttctccgcttttttctctatcaatctgtaaagcatttatggagcacgtgctgtaattccttcaccaacgtccactcaccaacgtgttatcttcctggttaagtttgctccattgaagtcagcaaacatcaatgaggcctctgctggatataggtaatcaccctcctttagacttccggtctccactccagccctccatgcaggtcctttgcgtctgcttccttctttccatcaagcatttattatctatggaatactgacaagtcccttcccctttccataatcacaaattcaatgttttccattttttctttgtccagaaaacatttattgagcacctgctgaattcagtgaaagatccatcccttccccttctgcatctcagaagcccccctttatcccagcatcccctccagtcttttcttccaggcaatctagcaaatatttatttagtgtctactatatgtggggtggggtggacaaagggacagagcctatgtatgtacgccaggctcagtgtggggaacagagacctgttttaccaacttgcagacactcagaaccacactagcttcagggatttcagccccaaataaagcaggagttgtgcaaactctgtgatggaatgtacaccgaaatacagtctgacgccttttccaccaaacctcaccaccctcattccttcctgggtctcaattcctctgtggtttaaagttgaaaactctaagttgagactcatctcccccattttgtgggtaattttgtcctgtgtttttctttctttttttttttttgagacggagtcttgctctgtcgcccaggctggagtgcaatggcacgatctcggctcactgcaacctccgtctcctgggttcaagcgagcctcctgagtagctgggactacaggcacatgccactatgcctggctaatttttgtatttttcgtagagatggggtttcaccatgttggtcaggctggtctcaaacttctgacctcgtgatccacccacctcggcctcccagagtgctgggattacaggcttgagccaccgtgcccggctctctggtgtttctcaaactatgggtcacctattggcttatgaccagcatttcactttcttcttgaagtaggataaataaaaatagagaataacagagcatattgcacatagtaaatggagttgttgtttagcaaaacatataatgttattccattaagatatacaatctgtaatgtatattatatatgacatacggtatgtaatacatgtgttatacaatggctttacagtacataatacatctatatgtatatgttcttcttcatgaaatgaaataaaatagcatagaaaaatcagactgcattacacatagtaaaggtaattatctattgaaactttaattccagttatgcatatgtatttatatacattctaaatacatatacacataatatgtaatatacaacattttatatgttacataatatataagacattctatattctcatatttgctgtacaacatatgtgtcttatataatacatatataggatgagttattatgcaaatacatatatagtgggttatataagctttatttcttactgtggcttcttttctcagatatatttccctggaagcagaccccgagactctgagatttgcatgcagatttactggggagagcgcttgggaataacacctgtgggggaggttgtgagggaagcaggattgtgcagagggaaaagttgagctgtgatgcaaccacaaaagaggcctcggccaatcctctggggagctctggcactggaatgacccttcagagttgtcccagttgaagcggggtggccaggctttgaattcctatgtcagtcattggctgtaggctgccccctgggaggaggcgtaatcttgggtgaggcaaatccctgttgcagaggccaatgcccagtgagggacacctatgagccatcagcagcggataattccagaagctgaggatagatgcaaaggtctggaacaaggaggtaaggatctggggggagcatatagtccacaccttgcactgctccgatccacttccttcttatagtaagttcaccccattggggaacggcatttccagaattctaatcggtcttgttttctcagggacacttgaaagagcacggtagtgagatgagccatagtctctgctgctgcagttgatttcaacgtcataaatgatattcatcctctccttcttttgttacccattctagattccccccaccctcagctagcaccactcttggtctgggtggctcccatcctgcagagatccctgagcctttggtccccatgcccttctcaggctgtagctgctgtacaaacaaccacatttcccatttactatcaaagttgagcaaggagtaccaacagatgcccaagtggatcccctgggtgccagacatactcctccctgcctccactgtgtaccagcagctctacctcctcctgaggagcaaggttggtcacgtcccctgccaagacaatggctcctttttatgtcccttggcatgagaaacacgaagtgccctgagggcaatcatagcttacagtttaatgggattcttgctgtgtcccctggtagcagtgttcccccttggagaaccaggacctctaaccttgcagagccctgagggaacaggaagcacaatttcaaaagtggatcactgggattgctggtaagctgggccactccttcctaacctctgtgtccccaaaccggtgtattctacctgttaggaacacagcacctacaatggccattgatttagggttgacactgttttggaggatggtgcccattcttgcatgatctcaccttcaacctgggatcttagctgtggctgcaccaaattgttccatcattccatcaggccagcagctcccgggtggcgtggtgtgtaataccatcagttaattccatggtcatgggcccacttttgcacctcctttgctttgcattcctttactttgctataaagtgtgtcctttggtttgacgcagtgttatgcagggtctcgtgctggtggatcaaacgttatgtaagcccttagacagtgagctggctgaggtcctgcagtaagaaaaggcaaactcaaatatggaatattccagtcaaaatcgattactgttctttgcaggatggaaggggcccaatctaatcagcttgccacaaagtggttggttggccttctggagggatggtggcgtgtcagggattcaatgttagtctctgttgctggcagattggacattcagcagtaacactgctgcccccacacatagcttctctctctgctgctattgccacttattcatgtgcccatctgctaacactggggtggctgattagagcctggctgacatcatcgggctgactcatgctgtctacctggttgcctagtgtcacttccatggcgccatggcagatgctgtctggtgggtgttaacacacgatccaaagatcctcgctcctccctttttttttttttttttttttttttggagacggagtctcgctctattgcccaggctggtgctgtggcacgatcttggctcagtgcaacctccacctcccaggttgaagcaattcccctgcctcagcctcccgagtagctgggattacaggcgtgcgccaccacgcccggctaatttttgtatttttagtagagatggggtttcaccacattggctaagctggtcttgaactcctgacctcaggtaatccgcccacctcggcctcccaaagtgctgggattacaggcgtgagccaccgcgcccagtctcactcctcatttcttgcccactcctaggtgtctgcccacatttctgtatcccagacctctttgtctggatcttccagtctttttatttccaggcccctgaccaaccagccaaaccatttaccactgcccataagtggatatatgtattctaatcttgaggcacttctctttctgcacaaaggagatgagcaggtgcacagcctgaagctctgcccactgggagctctgccactgtctttcaaggccattccagttgggttatagtgcaaccactgcccatttttggcttccacccacatactaagacaaccaatttgtgaaccaagcttagacctttccctctttcatcagctagttttaaggagtccccttagtgagacaggcactagcacaacagtgtggaagacatggggatcagggttacttacctgctcatgcaccttgcttggttctgcttgggctcaatcctgactgctgggcccacctgactttattatttggcgggcccagcaggacccagcttataatgggaacttctggatgcacaatcatttggtgcctggtcaagcattctgtctctatcagggcccagcacctcaatggggtgtctttctcaaaaggcgtaaaattctctgctgcagatggcatggctttgctccagaaccccaagggcctcccactcaggcttcccataagctcctcactgcatctttccccactactgacacctccagtatcataagatctgccagatcatctggcctaaatggcaggactgcttgtaccacagcctggacctgctgcagagcccttttctgctctggccctcacacaaagctggtagctttacatgtcgcctggaatatgggtcagagcattatttgtgtgtgggggacatgctgcctccagaatgggaagaggcctcctaggtattgtgctttcctcttcatggtggaaggtgcgtgattcaatgctttgctctattctttggaggggctgtcctggtttactgccctggaccactggattcctaaaaattttactaatgcatcggtcccctgagtctttgtggagtttatcctccaccctctgtagtggatgtgtcttaccagggcaatatgctcaccctctcttgctcatcttgcacaatcagtatgatgtaatccatgtggtggtccagtgtgctattccatgggatgtccagatagtccaggtttctctggactatattatgacaccaggtgagagagatagcatagccctacagcaagaccatctatgaatattatcatcagtctcatgtgagtgtaaactgtttctgatccttttttctaatcagaataaaaaagaatgcatttgccaagtcagcagccacctgctgtacctgaggtcttattaatctgctctggcaatgacagcgtgtccagtatggcaggtataactaagggtactacttgattgtgcttgcagtaatctgcaagcattctccaggacccatctgacctctccaggggccagactgctcaactcgatggagataagatgagaccaacacccctgcatcctttagatctttcaatgtggcattgatttccatcatcacccataggatgcacacaatattgtttgtggtttattgttttgttcagggcatgggggtgtgcgccattttagaagcttctatttggacttccctactgaaacagctcttatcccacaggctgaggagcccatgtaggggttctgacaactacaaagtatgccattgcaattacgcatttgtgaactgaggaagtgaccactgggtgggtctctagacccaccagacccactgtaagcaggacctgggccaggactcatttatcaccttaccactactgtgcttctcagcgtgactggtaccaccctcaccagcatgtttcttattaatttcataagttgagtgtatcctccaggccttaatcagctggtgggttttccagacttcagtagtatatctactccaacatgtctgcttctttgagccctttaatccttccctgtgcaatctgccatggaagttctgcttcacttagtgtgggccattgtttactccaggtttccaaataccagtgtgttagtaacacttcctagagtcctcgccagggttttaagttccgtatcctgggagagcacaccaacttcctgttctacctccttcgcccattgtcctcaggatccagtctcatgcataccttcccagctcctgccaatacgtactagccagattctttaggttcttctacagatcatttctctccctttgcaagcctagaacctgtccagtcaggtttcactaggatttcaccctaatttttggtctggtttccaggagggtaggtggggggtagactctgaggggggcaggcattgtcttacaaagcacctgcatcatccgaggcctctgcattatcttcaagcagaaggtctatattctaactcaggggagtagtctacttcagcaggcccagtggatgcaggtgagtctgtaagttcaaggtgtttaactgcatctgcccagatatccccatctcagagtcctactcctgtcctattagggacatgagcatggcccaggagatgtgctgggcctgagaagtcaactttctccgaagctccgccaccacgtagaattaaattctgagcctggccctcccttctgtctgccctctgactgcaggagatgagggtttccttaaatgcagtcagggagatcctctggctttcacattttgccttgaattcaccctgagcatgtcaggtctttcttcagctactcaatggcgtttagggaatagtcacccaagtctggttaccatttccctgacatcactcaagttccagggatatttcaccatccagtacattcccttccaccagaatcccattacagcccaccatcaggaaaagtcaccgctactccaaaaccctgggggcctgcgctgtattctcccacctgggagaagaaattccacacagcatcttttcctactactgacacctccagtgtcataggatctgctggatcatatggcctaagtcacatcctgcttgcaccacagcccggacctgctgcagagcactttgcgttgctacagcatatcggaggctatctatgccccacctcccactactgatgggtcctcactgccatctggctgctgggtaacccagctccagaattgcattagaccacccttgtagtttgacttccatggcccactgttttaggttgggttccctggaaaaagactttgaggtggagatttgcatgcaggaggcttactggagtgtgccattgggatcaacacttgtgaggagggttgggttgagcagaggaagaggctggctcaagatgtagttgccttaggggcctccgctgctcttagggggagccctggggctgggagggtccttcagagtcagcccagattgaggcaaggaggctggcctttctttcccttcatagaccagaccatggggatgccctcatgaagtaggtgtaaccttggacaaggcagttccctgtgacaagacaattcccagtggggacacagccatgagctgtcagtagctgccattcaaggtacattgtccctgaagaggaggcctgagcagaccaccacagtatccaactacacttatggtcagaaaagttttagaaacagtgatacaccctcatcatccccactcatcagtttatagatgaaaaatgtgcagggctgagagagattctctctcaacacttctgaggggatagtgtcagcgatggtgtgtgtgtgtgtgtgtgtgtgtgtgtgtgtgtcagagagagagcaaggaaaaagaagtagctgtacttggggtctcttgcatatgtcagtcaagtcaccagggtccatttgtgccgtgtgtgtgtgtgtgtgtgtgtgtgtgtgtgtgtgtctgtccaagaccctgattgtatgtgtgtcagtgaccagtagccctgaaagtgtctctccccctcatcccccttccatgataaacctgattgaggatgagcttccatccctggagcaagcagcctgttggctagaaatcttgagcctgggggaggaggccaccggaaaccaagcccagctggggacgggcccggggacaatgacatagcagttcgtgatgttcctactgctgctcccactccccctccctcctgttgctccctctcctcctcagctgcattcctccctgccccccatcattgccagctacactggcttctctagagccacccagcctgcaccactcaatccactcctccttatcggatgcagctgcccacctatggccattgtgtttctcacagcacacaaccacacatggtgaatgtgctcctccttgcgaaagggccagagagcagagagatgcttcaggccacacagccagacacaggcactgacatatacacaggcactaaaaaatacacaaaaacaggcacgcttcagagaaatgtagtttctttctctccttccttccttccttccccttccttccttccttccccttccttccttccttccttccttccttccttccttccttccttccttccttccttccttccttccttcctttctctttatttctttctcttttttgcctaggtcttgctctgttccccaagctggagtgcagtggtgcaatcacggctcactacagcctcgacctcctgggctcaagccattctcctgcctcagcctccccagtagctgggactacaggcatgcaccactatgcctggctagtttttgttttttgggttttttggagatggagtctcgctcttgttgcccaggctggagtgtaatagcaccattttggctcactgcaacttccgcctcctgggtccaagtgattctcctgcctcagcctcccaagtagctgggaatacaggcatgcaccactacacctggctaattttgtattttagtagagaaggggtttcaccatgttggtcaggctggtctcgaactcttgacctcaggtgatccacccgccttggcctctcaaagttgtgggattatagacgtgagccacagccctcggcttttgttttttttttttttttttcaattttttttgtagagatgggggtctctctatattgtccagggtggtctccaacccttggcctgaagcaatcctcctacctccagcctcccaaagtgctgagattacaggcgtaagccaccgtacctggccagataggtgttttctaaggttctttgctgtttaccggtctccatgcaatttcaaagtatgttctaatttacatagtgctgctaattttgtgaagtttttttaaaaaatttacaatgacaatgtgatgagcagactaaattttgggaaatacctgctctctgcagtgtaaggccacattttacagtttgcaatgtcctttaatatttttgcaactccatgaggattacaacagacattattcacaaagcactcttgattttttcaaaatatttcaataattataaggcactttgtggtttctttagtagcattgaaggggcaaaagggtcaagggcctgtgttttgtcttcccttctgagatttcatcattgacagatgtgttgtttttcctctccagggcaaaatacttcaaagggaaaaagatccatggagaaattgacattaaagtagaacaggtaagttgggacatttggacctgggggtcagttgtccatactgcaaactgagtggccatttttgtgtgatgtaggtgaatcaccagtttttttctccttcccaggccgaattctctgatctcaaccttgtggcccatgccaatggtggattctctgtggatatggaagttcttcggaatggggtgaaggtcgtgcggtgagtataagaagggtaccttggtgttatgagcaaggcataagaactctcccttagagctgggggaaagttcctacctccccacccatccttctgtgggcaagaacttaggcatggaatgtggggagacaacttttcttcagaaaaagagccagggaccccaggatgccacaagtcagactttaaaaaaaaatatatatatatatatatatatttcagacagggtcttgctctgtctcccaggctggagtgcactggcacaatcatggctctctgcagctgcaacctctcaggctcaagtgatcctcccacctcagcctcccaagtagctgagactacaggtgcgcaccaccatgcctagctaatttttatgttttttgtagagatggggggggtcctcactatgttgcccaggtttgtctcaaacttctgggctcaaacaatctacctgccttgtcctctcaaagtgctgggattacaggcatgagccgccacacccagccttcaattattaattaaataaacatttgctagacatctgctgcatgccagatgctgctctcaggacttcatattcaataaatatttattgtacacctactgtgtgccaggagatattctacatgctgaaaggccaaaaaaaaaaaaagaaaaagaacctgggccttatgaaacttacattctactgtgagatacacacaatacacaaataaataagaaaatgtaaaagtgctaagaaaaaacataacagtggccggatgtggtggctcatgcctataatcccagcactttgggaggccaaggtgggtggattgcttgagcccaggagttcaaaatcagcctggccaacatggtgaaaccccgtctctactaaaaataaaaaaattagccaggcgtggtggcaggtgcctgtaatcccagctactcgggaggctgaggcagggaaatcgcttgaacccgagaggcggagattacagtgagccatgattgctccagcgcctggacaacagagcaacagtccgtctcaacagaaaaaaaaaaaagaaaaaaatatatatatagcactaaagcagatgtagcaattgttggatgatggtggggtctgcagttgggatagggtggcctggttgcaggagagacatttgaggaaagacctgatggaggtgaaggagtgatccatgcagatatctaggggggaagtgctttaggcagatggaacagccttggtaaaggtcccaaggttagaatttattctgggcagaacactgaagacagcttgcagtctgagagatggtgaccagggagttgtcagagctgtgtcggtaagctgcaagctgaccttgctgagaagggaacaggtaggagaggcttaaaggggatcaccaggtgggcagagggtagaaagggtgcactaggcagagggaacagctcacacatgtgtgcagaggtgagaaaccactttgcaatttctgggagctatggagatttaaaaacttggtctttgtttcgagagtgattgggagcttctgggggaactctcaacactcctacccctgccacactaggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtggtaagtaacaggaagggtgccactggcagagggaacagctcatgcatgtatgtgggagcttgaaaccagtctgcgatttggggaagtgagggtgttcagaaacttacagattcgtggtgaaggactcactgacccagctctcctggttctcatagtttgcccagatggttcgactgcataagaaactggggacagaagaattccctctaattgatcagaccttctaccccaatcacaaagaaatggtgagtttggggaaaatagagtgggcaggagggaagagtcataactactgcaataatattaaatattggtatattatcagcagtgcgatatcaagagtgtggctgctgtgtgcacgtggagtcatgaagttgctttgtgatagggtctaccgtgaatttccttatgcttacaaggaaaactaaatcatgatccattctaatatgtatcagatcctgttactcatgttgtctatttttgccagtattaaaaacctatttctaatgtgaattgacagaattaatgtaatgaatcagaatatattacatatagaaattaagtcattattactaacattatcaaatattccttctgatagaaattttacctatattcaaattaggattgccaataacatttatcaataataatgttataaattaaattgttggcaaggcacggtggctcatgcctgtaatcccagcactttgagaggctgaggtgagcagatcatgaggtcaggagatcaagaccagcctggtcaacataatgagaccccgtctctactaaaaatacaaaaattagctgggcatggtggtgcgtgcctgtagtcccagctacttgggaggctgaggcaggagaatcacttgaacccgggagttggaggttgcagtgaccagagatcacgccactgcactccagcttgggcaacagagtcccacctcagcctccctcctattaattaattaatagaaattgaacttttggttactattatgaaatataatcactggccgggcgcggtggctcatgcctgtaatcccaacacttcgggaggccgaagtgggcggatcacctgaggtcgggagtttgagaccagcctgaccaacatggagaaaccctgtctctactaaaaaaatacaaaattagcccggcgtggtggtgcatgcctgtaatcccagctacctgggaagttgaggcaggggaatcgctggaacccgggaggcggaggttgtggtgagccaagatcacgctattacactccagcttgggcaacaagagcgaaactccatctcaaaaaaaaaaaaaaaaaatatatatatatatataatcactaatattacaaattatcactaatattataaattatttttactgttgtaaattatgagtacctatgtcatgaattaaattatagtttctagtagaaattgaataatcattactaatagcatcaaagattattgctgttattacaaatgattattgctattacaaattatgctctaatataaattataagtacctgttttgacttacataaacatggcatgcagtggagactaccacagttgggtcattgggctacaatgtgccagaataaaatatgctgaacgtttaaataatagaaattgaattatcattgctaatatcatcaaatataacaactaatattacaatgcattacagtgttacaaattaagtttattactataaatgattagtacttatgttgtaaattgttataattattttttaaaaatttaaacccaaagtgggaggatctcgtgagcccaggagtttgagaccagcctgggcaacatagcgagaccccatttctacaaaaaatttaaaaatcagcccggcatggtggcatacacctgtagtcccagctacttgggaagctgaggtgggaagattgcttgagccctggaggttgaggctgcagtgagccatgatagcaccaccgcatcccaacctgggcaacagagtgagaccctgtctcaaaacattaaataaataagtaaataaaattaaaccattagtacaaacagtgtaaaaatttttacagatataactattaccagtgttacaaattaagattactaatataacccatgagtacctgtgttttgaattatcttgtagttcctaatagaaataattactaatatggttaacattctaactgctattataaaaaaaatcactaatattaaaattttgattactaatataaattatgagtaccacagttatgaatcaaattttagttacaaatagaaattaaataattgttactaatgcaatcaaattgtataagtaattttgtcaatttttaccaatattacaaattatgtttactcatataaatgatcatcaccaattttatgactaaaattacaattaaatataaatattgacccaacactatcaacttgattaaataaacattgctactaatattagcaattcttaccagtactacaaattatgatcactgatatacgtcaacagtgttgtaagttaagtttacttacagataaagattgaatcattagtttttcttttttttttttgaggaggagtctcgctctgtcgccaggctggagtgcagtggcacaatctcagctcactgcagcctccgcctcctgggttcaagcgaatctcctgactcagcctcccgagtagctgggactacaggtgcgtgccaccacgcccagctactttttgtatttttagtagaaaaggggtttcaccatgttggccagcatggtctcaatctgcccgcctcggcctcccaaagtgctgggattacaggcatgaaccaccatgcccggcttgaatcattagttttaaggaaacccaatttgtttatcattattattagtctacattctttgagagacagtagagcagaatgtgattaagagcatggactctgtagccagaatttctgtataagaatcttacctccacaacttattagttgcttaacacaggaaaagttacttaaacgccctgtacctcagtttattcatctgcaaaatgtaggtaataatagttcccgcctcatatagttggtgtgagaatgaaattacttagtaaatgtaaggtgtctagaacaatgcatctggcatatattaactgctacctcagtgttgacaaatttctccttctattcttagttggttgagtatttttgtcgtgaaaggatgttggacattgtcaaatgcttcttctgtgtttattgacatgattgtgtgaattttgtcctttattctatgaatatggtatgtagtacattaattgattttcatgcaagttgatacgttcataagtttgtttatgatgtgtctaggtgtagacatttgcattcctaggctaaatctcacttggccttggtataaatcctttttgtatgttgtaggatttagtttgtgattattttgttaaggattattgtatctatattcgtaagagacattgctctgtagttttcttatgatgtctttttctggttttggtatcaggataatactggcctcatagaataagttggacagtgttccttcttctatttttgggaagattttgtgaagattggcattaattttttttctttttttgagacagggtcttgctgtgttgctcaggctggtcttgaacccctgggctcaagcgatcctcctgctttggcctaccaaaatgctaggattacaggtgtgagccaccatgcctggtcggtattaattctttttaaatgtttagtagaattcaccagtgaagacatctggtcctgggtatgtctttgtaggaagttttacttattcctaaatcaatctcttcacttgttataggtctattgagattttccatttcttactgagtcagtttttgtagtttgtgtctttctaggaatttgtccatttcatctaggttttctaacttactggcacataattgttcacagtactctcttatactctcttataatactttttatttctgtaaggtcagtagtatgtccactctttcattcctgattttagtaattagaattttctgcccttttttattcttagtctaaaggtttatcaattttattgatcttttcaaagaaccaaatttttgttttattagttctctatttttaaaattctttatgtcatttatttctactcttattatgtttttccttgtgcttgctttggacttagtttgctcttttctttctaatttcctagaaaaaaatggaagattaggttactgattttgatatctttcttctttttagatataggcagttacaactatgaattctcctttaagcaccactttaactgcatcccttacattttgatatgttgtgtgttcattttcattcatctcaaagtatcttctaatttcacttgtgatttcttctttgacctattggttatttaggagtgtgttactttccacatatttgtaaatttttcaaattttcttctgtttttgatgtctaatttcattccattgtggtcagagaacatattttgtataatttcagtccttttcaatttactgagatttgttttctggcttaacatatagtctgtcctgaagaatgttccatgtgcactgaagaagaatgtgtattctgccattgtagggtgaagtgttctatagatgtttatgaggtctaattggtttatagcatttttcaaatcttccttattggccatgcacagtagctcacacctctaattccagcaccttgggagtctgaggcgggtggattgcttgagtgcaggagttcaagaccatcctgggctacatggcaaaaccccaactctgcaaaaaatacacatgcacacacaaaaagccacatggtggcacacgcctatagtcccagctactcaggaggctgaagtgggaggatcacttgagcccagaaagtggaggttgcagtgagctgagattgcaccactgcactccagtctgagtgagaccacgtctccaaaaaaaaaaaaaacttcctttttggttccctgtctagttgttttacccatttctttaaatgagatattgaagtcttcagctataattgttgaattgtctatttctgtctccaattctgcctgtttttatttcatatattttgtgctgtgttgttaggtgcacatatacttattattgttaaatcttcttgatggattgaccatttatgcttataaaatatttttctttatctcaagtaacaattgctgttttaaattctattttacctcatattagtatagctattccagctctcttttggctattgtttgcatggtaaatctttttccatccatttactttcaacttatttgggtctttgaatctaaaatgtgcctcttacagatagcatataattaagtcacgtttttcatccactgtgcctattaaccctttaccgtttgtgctgagaacactctctgatggcacttgcggctgcagtgtttaccctgagataactttgccacaaactgtctcatttttattattattttcacatcactctagtatatcgactttggaaacaaaagacatcattctatttatagcattctgtttttaggagtggtatttccacttacaaaatatagtaattctcaatcattgaaaatgtcaaatcctagaaaatgtaacatccctacaaatgatgttaacatcgttcttgaacagtcgttggatgaagaatcatttgatgaatctgatttttccaaaatagatggttctgatgattcagatgattctgatgattcagatgattctgatgttagttcagcttagaaataactccaagaatagtttttatattttgttttgacattgaaaatcagttagctttgcttcagcctcaaagagcatgtttatataaaatctagtgagcacaggcagcaagctgcacgtttttttttcctaaacaggaaaagggttaatcgcagtgtttaattaacttatgttattgtaattcctgataaggtagggtttatgtttgcaattttgctatttgttttctatatcttattttttgttcctgtattcctctagtaatgccttcttttaagttaaacagatattttctagtgtaccatttttaatttttctgttatttcttccctatgtcttttattcatttttttaatttaaaaaatttttatttttttttgatacagggtcttgctctgtcacccaggccagagtgccatggtaggaacatggctcattgcagcctcaacctcctgggctcaagctaccctcctgcctcagcctcctgaatagctgggaccacaggcatgtgctatcatgctcagctaatttttagttttttattttttatttatttatttatttatttattttgagacaaagtctcactctgtcacccaggctggagtgcagtggcacgatctcggctcactgcaacctccacctcctgggttcaagcaattctcctgcctcagccttcttagtagctgggactacaggtgcctgccaccacacccagctaatttttttgtattttaattgaggcggggtttcaccatgttggccaggctggtctcgaactcctgaccttgtgatctgcccaccttggcttcccaaagtactgggattacaggcgtgtgccaccgcacctggccaatttttaatttttttgtagagacaggaccttgccatgttgcccatgctggtctcaaactcctgagctcaagttacccaccttggcctcccaaagtgttgtgattacaggcatgagccactgcacttagcctgttttttttttttcttagttgtttccttgggtattacaattaacatcattatttatattactccaattagaattaataccaaattaagctcagtaatacaaagaaattgcctctatataactttattccttcatccctcctttgtgctattattgtcaaacaaattacatctttacacattgtgtgcccatgaacatagttatagttattgctttatgcagttgtcttttaaatcaggagtaaaaaagtgttacacgcaaaaaaatgcatttatactgtcttttatatttacctatgtagttaactttacaggtgctatttatttctttatgtagatttacattactagctagtatcattttatttcaccctgaaggactccgtttagcattttttgtagaagtttgttagtgatgaactatctcagtttttgtttatctgtgaatgtcttaatttctccttcatttttgaaagataattttgctggatgtagaattcttgtttggcagtctttttctttcagtactttgaatatgttgtcctactgccctctgacttcaagatttctaatgagaaattagctgctaatcctattgaggattccttgtatatgatgagttacttctctcttactttcaagattctctctgtctttagcttttataagtttatgatgtgtctgggtgcctatctctttgaatttatcttagttggagttcagtgcacttcttgaatgcatagattaatgctttaaatcaaattggggggatttttagccattattccttcaaatagtctttcttgcacctttttttctctcttttctctctccttttgggacttccattatgtgggtgttcatatgcttcatggtgttccacagacctctaggactgtgttcattttgtttacttttcttcttcctgttcctcagattggatcatctcacctgacctgtcttcaaattcactgattctttaccctgccagctcaaagctactgttgatcccctctagtgaatttttcatttcagttattatgctttttatctccagaatttctttttttttttttttttgagatggagtttcactcctgtcacccaggctagagtgcaatggcacaatctcggctcactgcaacctccacctcccaggttcaagcaattctcgtgcctcagcctcccgagtagctgggattacaggcacacgccaccatgcctggataatttttgtatttttagttgagaggggggtttcaccgtattggccaggctggtctcaaactcctgacctcaggtgatccacccgcctcagtctcccaaagtgctgggattacaggcatgagccaccatgcccggcccagaatttctttttcatgtaatttctctttattgatactctctacttattaggatatcattttatcctttcctttaagttctttaaacatagtttcctttagttctttgaaaatattaaaaatcactgatttacagtttttgcctattaagtctaacatctgggtttcctcagggatagtgtttgactgcttttttccctgtgtttgggccacacttaattttgtttctttgcatctctcatacatttttgttgaaaactggacatttaaataatataatgtggcaactctgggaatcaggttctctcccctcctcaggatttgtttttattgctttgttttgtttttagtgaccttcctgaactaattctgtaaagcctgtgttctttgtcatatgtggctacccaagtctctgctccgttagcttagtggtcagctaatgattggacagatatttctttaaatcacctgaaaccagtaagtctcccagactttgctgatgggctctatgtgcatgtcagggtgtgcctttaatgcaaaggcaggctgtttacaactttgccttatccttcatttcctgcttgtgcagagttttgaggtcagccagagatcctaggcatacatacagccttatgcgtatttgtggttttctagattcccaggcatatgtcagagctttttaaagcctaataatggactgataatggatatataattacctagattttccttttaagttttcttgaaaagcttgttgttttttcctaaatgttatcactgctgtgttaaacagttgctgctaattgtttctgaaaagcacccccagagaaagctgtttataccagatgagccccatgagtggagtattcaggatagtgccagacagatcaaataaagacagttctctggaaatgagattttggaggaactccaaccctgttctgcctcctccaatggttgctagtctgctggttttcactggaattgcagggctgttgattttcaaggctcttgtggaggtgaggagaaggggatgtgtacaagagaagttcaaatgccacagcttcctgttgttaccaagattcagccattttcttgaaaaaacgctttctgaattgtaaaccttggtcaatttccagagttctgataagtttgttttgacaatttttgccagtgttctcattgcttttaagcaattttaaggaggagaagacaggctcttacatttctgctgacatcacctccaggcatatcttgttctttcccggccccagcccaaagataatagtatttcaaagccaagatctgggaactagatttactcattgctactggaatgttcttgcttcaaggccctctcattgtacacagctaggacatttcatttctttatgtatatatatataatttcatatatgtgtatatataaaattgttatatgtgtgtgagtagaagaatcaaactgttttttcttctgctctcacaataccatgtgtggaggcttttacacacacaccaagaagcaattaattctgcagcaaattaatataccagctggatgtcctgcaattcaattctgacactatctacctggaggatagcatcagatcacacaggttaagggtgtagtcccacaggactaagccctacttctaatgctgatggcaagccccaggttattttacctgtgcttctgaccaactagctataaatcggggtccacaaccccttcctcaggttcaattagtttgctagtgtggctcatggaactcagggaaacacttatttacatgatcggtttattgtaaagagtattacattacaaaggatacagatgaagagatgcagaggacgaagcatgtgggaaagagcacagagcttccatgccccacccccaggtagccaccctccaggaaccccacatgttcggctatccagaagctctccaactccatcctcttcagcccttcatggagacttcattgcataggcaggatttataactgtatagaaatgtgatgggacagccaggcgcagtggctcacacctgtaatcccagcactttgggaggctgaggcaggcggatcacctgaggtcgggagttctagaccagcctgaccaacatggagaaaccccgtacctactaaaaatacaaaattagccaggggcagtggcgcatgcctgtaatcccagctactcgagcggctgaggcaggagaattgcttgaaccaaggagacggaggttgcggtgagctgagatcacaccattgcactccagcctgggcaacaagagcgaaactctgtctcaaaaaaaaaaaaaaagaaaagaaaagaaagaaagaaatgtgatgggacaaaaagggtgtgatcttgtactaacagactgagtggggaaacccagcaaggcctgtctgttcagagccttagactctctctgcaacatcccttccttctgggtattgggcaggaccccttctaaaagggaggtctttttttttctttttcttttttttttttttgagacagagtctcactttgtcacccaactggagtgtggtggtgtggtcttggctcactgcagcctctgcctcccgggttcaagcaattctcttgcatcagcctcccaagtagctgggactacaggtgtgtgccaccacacccagctaattatttttgtatttttagtagagatggggtttcaccatgttagccaggctggtcttgaactcctggcctcaggtgatccacttgcctctgcctcccaaagttctgggattacagacgtgagccactgcacccagccttttttttttttttgagatagagtccgtgactctgtcgcccaggctggagtgcagtggcgcaatcttggctcactgcaacctccgcctcctggactcaagcaaccttcccacctcagcctcctgagtagctggggccacaggtgcgtgccaccatgcctagctaattcttttgtattttttataagagattgggtttcaccatgttgctcaggctactctcaaactcctgagcctgagcgatctacctgccttggcctcccaaagtgctaggattacaggcatgagccaccacgcctggtaatgctgatttaattttatatttttaaatgtaagacgttagcgtggttctaaaagtcaaaatataaaaaaggcatccacagataaaatagaaaacctagatgaaaataagtaatttcctggggaaacacagtttaccaaaatcgaccccattagaggttaacaaaccaatttccataaaagaaatagagaaagtttttaaggaacttccccataaaaaatcatcaggcccagatgatttcacaggggaattccactgaaatgctagagactagttaatcccaatggccacataaattgttccacagaatggaaaatgaagacaaacttccatattacctttctaaagcaattataacattaatagcacaaagaaaagcatagacctggtgcagtggctcacggctataatcacagcatgttgggaggccagggcaggtggatcacttgagatcaggagttcgagaccagcctgaccaacatggtaaaaccccatctctactaaaaatataaaaattagctgggcgtggtggtgtgcgcctgtagtcccagctactccggaggctgaggcaggagaataacttgaacccaggaggcagaggttgagtgagctgagatcatgccactgcactccagcctgggtgatagagcgagactttgtctcaaaaaaaaaaaaaaagcatagaccatttttactataaatatcaatgcaaaaatcctaaataaaatattagcaaacaaattcaaaaccacattaagggtgagcacggtggcttacatcgtaatcccaacactttgggaggccaaggcagaaggatcacttgagcccaggagttcaagaccagcctggtcaacatggtgaaaccccatctctatcaaaaaaacaaaacaaaacaaaaaaaacacaaaattagccagacatggtggtgcacccttgtagtcccagctactcgggaggctgaggcgggaggatcacttaagtccaggagtttgaggctgcagtgagctatgatcccaccactgcactccagcctgggtgacagagcgagaccttgtctcaaaaaataaaaataaaaaagaatgcagtaacagcagcatatgaaatcaacatgcagaaatcagtagtttttatatacacaaataaccagatagaaggtataatagaagagaaaacatatacaataacaacaaaaaaaataagatattttgggataagatcaacaagggatgtgcaaagtgatatgaggaaaagtttaaaacactcctgaaagacacaaaggtagacttaggcagatggaaagacattccttgttctcgggtagaatgaattaacatcatgaaaatggcagttcaccttctcacgtccttatttaatttatatatttaatgtggttcccaaaaatatacctacaaacttatatctagagctaaatgagttgatagtaaagttcatatggaaaagcgaacatgcaagaaaaactaggaaaaccctgaaaaagaaaagtgataataaggactcatactcccagcccacagggagtctgatgcctctgccaccagacattttacgaagatttcatttatttatttatttatttatttatttatttgagacaaaatcttgctgtattgcccaggccggagtgcagtggcatgattgtagctcactgcagccccaacctcctgggttccagcaatccttctacctcagcctcctgagtagctataattacaggtgcatgtatagctaatttttttattgtttattttgtagaggcacggtcttgctatgttgcctaggttggtctcaaactcctggcctcaagtaatcctcctgctttggcctccccaaaactctgggattataggcatgagccgccatgtccagcctgaaacttttataatttaaatagtgtgatgctgacccatgaatagacaggctgacagattaaaggaagaaaaacaaaagtccagttatagatccatgtacatatggaactttagtgtatgatcaaagtagtgactcaagtcactagagcaaagagggactttttagtaaagtttcgtttttgccatctaaattcttcattcttctgaaattccttttcatatacagtgtgaaggaggtagggattgagttcatctttttccttataggtaagcccttgtcccccactgagcttgtatgccacctctgtcatatatatactaacttttttttttttttgagacagggtgtctctctgttgcccaggctggagtgcagtggcgcgatcttggctcactgcagcctccgcctcctgagttcaagcaattctcccacctcagcctcccaagtagctgggattacaggggcatcccaccacacccagctaatttttgcatttgtagtagagacggggtttcaccatgttggccaggctggtctcgaactcctgacttcaggtgatccacccgcctcggcctcccaaagtgctgggattataggtgtgagccaccgcgcccggcctatactaacatttcatatctctgtcctgcaggttcagaactctattctgttccattggccactttctgtaaacctgtaccaaagccatactaccttaacagcaacttttctcattaattcctggtgcctggtagggcagcagcacctcctggctgttttgtaactatgtagttctgacaagagtagaaacagaaagggaaccacgaagagtgggaacaggagctggagcagggcttgatagcagggaacatgcaggcagagcctgatggcccacgcctgtaatcccagcactttgggaggctgagctgggaggatcgcttgagcctaggagttccggaccagcctgggcaacatgatgaaaccccgtctctacaaaaaattagctgagcatggtggcatgtgcctgtagtcccagctacttagctggctgaggtgggaggatcacttgagcccaggaggttgaggttgcaatgaaccatgattgcaccactgcactccagctggggcaacagagtgagactctgtctcaaaaataaaataaaataaaataaaacattttacaaaagagtagggaatatgtagaaggaccaagggataggaagtaggcaacggggacaaggagcagggaataggaagaagaagtaggggagcaagaggcaggaagaacaggggtgagccacaacacaaaggggacgcctgtggctgcgggagtccctgagggactcactcaaggccccatcgcatcctttcctatagaaagtcaggaagccctttctgggctcctccctgagccccttccaaggatgcaccccccatctcgcagagtgcagacttctatccctcaaaggacctggagggacagaggccatgtcccaaggaccagtgtagcatgaccatatgtcccttggctaggacatgctatgatccccaagtctcaaagactcagaacactacggactggggacagaatttgctgtgacgggctgaagttgggaacatagtattgtgaggcgggggttcttcgtggggagaatgctccagggatggggactttttgttccagggtggtgcagagggagacctgagggtgaggagtccacacagggtggggacaggttggctggcctgccgttaggaatccctaaaggggaacctctcctcatggtgtcgccacagttgttgtgggtgggcgtgtagaaggatctaaccacattgctctttattttcaggtgcttctgtgagccacaggttcaggactccactaggaaactggattgtctgtgagggggaaaagagagagggacactgggactgaggaacatttatggcgtaaagagctgggatcttagtatcacatcaggagcttttgggtctcggagacctaccccattccttcaggcagagcagggtcaggagcttgtattttggtgaggagactggtgtgggggagaaatggacattaaattattggtactaatcatacacattatttccaatatcgtatattatcatgcctaatatcaaacattgtttgcaatattataaataatcactactaaagttataagttatagttatcataactacttctagtaactaatgcttgtaagtgctatatgcctagcactgttccaagtacttcacatatacaacctcatttaatatggacattgtctctatgagttaggccttctttttatccctgtcttacagatgcaggaactgaggctcaaagaggcaatatgatttattcaaggacacagagctaagacatggcaggggcaagatttgaatgcagatgatctggctccagggttcctgctttttttttttttttttttttgagacggagtctggctctgttgcccaggctggagtgcagtggcttgatctcagctcactgcaagctccgcctcccaggttcatgccattctcctgcctctcgagtagctgggactacaggcgcccaccaccatactcggctaattttttttttttttggtatttttagtagagacagggtttcaccttgttagccaggatggtctcgatctcctgacctcgtgatctgcccaccttggcctcccaaattgctgggattacaggcgtaagccaccatgcccggcctttttttttttttttttgagacagtcttgctctatcccccagcctggggtgcagtggcatgatctcagctccctgcaacttccgcctcctgggttcaaacgattcttgtgcctcagcctcccaagtaactgggaccacagggcatgcgccaccacagctggctaaattttgtatatttagtagagatggaaaccatgttggccaggctcgtcttgaactcctgacctcgtgatctgcccaccttggcctcccaaagtgctagtattacaggcgtcagccaccatgactgtcccatttcctgtgttttgacccccccaaaaatatccaaggggcaaagacaccccgtaaacatcctccaaccccaccacagacctctgaaggattctgggccaggactgtgacgcccatgtttaaacatggcgagaaggactgaggctcaggtgagagaaggactggccccccaggctccccactgagctgggtcccatgctgaataccacatggctgtgacccctacaagcttcctctcagctgtcacagagtctctcccagagattcacccacagacaccccgaatgctggggatggaggatgctcacttgacctattttaacagatgttctacaagagcaatgggggatgtaatgagcccagggttacagatcctgccaggagctcatgccaggtctctggtggaggtagcctcgtctgctgttctgggctctgtgtcccctgagacctgttctggtctccggtcctccctgtccattctgcattgcacttggcgaagggctgacctgcagggtagacaggtcggcaggagaacgacctccacgctgggttccatccttcccctgctacttcaccttccccctagggcttggaagagctgaggacttaggaaatgggccctgaggccagggagcagcttaagagtgcaggtagctgacactaaggtttggcgaattgccaggagcggtcagcctcttgcaggcagctgagggaacattgacaaggtcaccagggatgaaccagggctcgggcccttaccttacagttgtgcccatcagcaaaggctgcggttggccccttcggtggacaaggttcagaccctccgagggcgtaaccaaggtgtagatgttgatgtagaaattgttgctgcatgcgcattccctgcttaagtggctgagtactgtgtgttcaaaatctgcccattcccatccgggacataatttgggccgtggggtaacctcccaggagtgtaaaaggctctgggacaggaccacagaagatccagggggctgtgcttggtgacctagaatgccctggaggagacctgggttcttactggtaagagcagtgggtactctgatgagagggaatttgggggtccttttctttaccaaaggagatatattggggcccttttcaagcacgttcaggtcaggaggacacaggtgctccattgaatgtttgcaccagtctgaaattctagttcccaagggcctcacttgagtcaagacctttggagtatgaggggcaggagccagggactggaccccgctgtggaagcaggaaggcctcagaggggagtatttggaggttctctcactcagtttttctagagaaaggatgattcataaaggtgagggtcgagtctagagaccctagtttgggtgaggggacagttgggttgagggaggtgtgtggagggtatgggccagcatatctggctggtcttaattttgaaccctacctgcatttcattgctgtcagtatttccttccaagttggtcagaggagtgaggggagaagtaggggagggaggatggcagagcttggggatttttagctcataccttctctccatcccacctctcctctgccccaaacagtcccttccaaggaatgtcctgcagccatggctggggagccagggccaccccttcttcccaagtccccagctgggttactgtgggactctgggtgccctgggtcccctttcactcaagtcagactcatggtacaaaacctgaggatgaggacagtaacacccacgtgtttggatggggcatcctcactggacaacatcaggactgtgcttgaggcaatgatagtcatttgccaattggtagggcatttgtcaatgactctgtcagctggcaagatgtgtgaatggggaatttccagtaaggcagtgatttgtcagctgtgggataatttataactagaaagccctgggcaaatagcaattaggaatcagtataggaaaatgttttaaagtattggctggagaaattattcagaggttacggttgataatgcaggttcagtgaccattgctgctgttgcagatcatcagtgctaatgccaatgttgagaattactaccagtacatcagaatttaagtaaaatataaaaacccaacatttggcatccctcatccccactggtcccagggtgctcacaccaggtcatcagcaacatgggtttgttcccaggcactacacagaaacagtgtctgctgggtggtaactctttatttcattgtccggaagaaagatgggagtgggaacagggtggacactgtgcaggcttcagcttccactccgggcaggattcaggctatctgggaccgcagggactgccaggtgcacagccctggctcccgaggcaggcaggcaaggtgacgggactggaagcccttttcagagccttggaggagctggtccgtccacaagcaatgagtgccactctgcagtttgcaggggatggataaacagggaaacacctggaagggaggagggaaacatctctgagggcttctccctgcctcccccgtggagcagaacttcctctcctcagctttcaacactgagccgctggggagacttgctctcaccccacctaagtacataccccaggacagcccctcccattgagggaaatgtcactgggtcctgaaaggtaacagtaagccagtaaatcagtgtcctggaatggtggctggggaataggccctgggggtcagtcaggcaggtcgcctgtggaattgtcccaaaggacagggaaaaactggcagtagtaaggggccccacccggttggcggctaaggagtttaagcacaggaatagccagtggggcttcaagatagtcactgggctcagaggccatcaggagccatcagggaacaggcttggactagccaggaggtcagtgtaacaccctctggtgtctggaatagtcagagctgcagagcaacaagcagatgtgctgaggaagggtcagtgggattagggaacagcactttgggttcttggagaacattctggggaaccaagaaacaatcccgggggctcaggaacggggagtgggattacagaatagtcacaagggagaattagagggaccagggagggacaggtgatcacacggtattggacacagggaaagggagcagccagaatttgtaagggagcagtctcgggcttggggaaatagcaagagagatcagggacagcccttagggttggggagcagccacagggacacagaatagccagagggagcaagaaacaagcccacgatttagggaatggccccgggaaggatctcccgttggaggtcagggtccaggcactcactgtgcattcctcacagccaacagtgtaggtcttggtgaagccccggcgctgagctaagctcaggctgttccagggagccacaaaactgcaggtagtgatgtgcaagagtccatcctgcagttttcctaaggagaaaggcggggcggggaccgacaagcagcttgtgattggctgagctgccaagctgccaaaggcccggccttctgatagactgaaattggggtggtccccatttccagtgggaccattcccatcagagcctcgccccctcgtggttgctaggccgcgccccagggactggttggtgtggcacagggcgcggggacggtgcctcaccagcaatgagaaactcctcgctgcggttgtgggacctgtggaagtatccgcagacactctccatggcgggggtgtagacgaaccggatgtcagcggcatcccctaaggcttggaaccctttatacatctgttgatggatgaggggaagtgtctcttttactgacataatcctcccactccaggttcttccctgaagtcatatagcatcccaagatcacagccaactttctcgcaccaaccagtggccagaagtttctgttttgaccaggaggaagatgttagaaaatgctgggaaagaggcgggggcaggggataccttggtcatcttgatctcataacgctggtataaggtggtctggttgacttctggtgtccccacgaacttggccctgatgactgcaggagaggagggaaatatgagtcaaatggactgcatgagccaataaaaataagatcatcatcatcatcatcatcataccagcaaagcgcatacataaataggggttattggatgccagacagcacacaaagtgatttacacatttgttcattgattcatctgtatgttgagtgtctctctttgccgggcactgcttaagccattttcatacattgatttgttcatttactcctcaaatatttgggagtgcccactgtgtgccagacattgttctgggtgttagggacacaacagtgaacaaaacacagaaatccctttccttgtggagttcacattctagccaggaggagacaggctaagaacaaacaaaataaggatatggaatgttagacattaagtataatggggaattacagacctgggtaaggggctgacaaagattctttgcttgaccaaactttactcaggctcctgaacctcctcctaggcccatctgtgcacttccttgtaaaatccagttttagccgagagccttgctaagtcagtttagcaagaacccctatattctatatctgatcatcctcaatctctgatcatcctcaatacctgatcatcctcaatctctgatcatcctcaatacctgatcatcctcaatctctgatcatcctcaatacctgatcatcctcaatctctgatcatcctcaatctctgatcatcctcaatacctgatcatccttgctatctgactgggttcttcatcttccaccatcccccaggtgatgtctgattccccttggcctgccttcagcaagaatcctgttacgtcggtttagccagaatcccccttacccctgatgtttcttcttagtaatttccacccacagaccctcacactgctccttagctacacattcccactggcccatgctatattcagtgttgagcccaatctctcccaccgactgcaagatcccattgcagtggttcctatacccatcaccatggtcctgaatatggtcttccttactgtgttataacaagtatcactgaatatttttctgtttaacaggagatcaggagtactaaggggcaggggttaaaattttaaacaggatggccagggaaggccatcctgagaaggtgacgtttgaggcagccacccatgtggatacctggggggaaagtgtaccaggcagagggagcagccagcatgcagatcctgtggtgggcttgggcacagagtactcaaggaagtgtgaggatgccagtgtggctaaagcagaggaagtgcaggggcgagtggaatcattctagaggtaagtgccatggtgagccccactggactgaaagggaaaccaaggcagagtgtgtgggctgagtggggtgaggactcaccgaggtcggaattgcagaaggccgtctgtgggtggggtgggacacaggtgcaggccctgctgggggctatcagccacagcaacaacaggatgccagaagccaggggctcaaagggggccatggtgggttctgtggggaagggggatgtcaggcaggccccggcccagctgatctgctgacctgggcaggtcatccaccccatcttgccccggggcagcctatgggggggattagggggctggatttgggcttgaggggttggtaagcttagggattttaaggggattggggagcgcagaggaatttagggtttagagagttgggagagtttaaattattgagggactgagtgagttgcggggttatggggttgtggcacttgggggagaagggggctgaggaagtttgaggaatgaggggattggggaattctggaggttgaggagtttgggggtgaggaatttgggattgggggctggaggagtttggagacggcagagtttaggggttgtgtatattaagagatataagaggctgggggaatttagggaggttgaggaatttggaggaggttgggggtttagggagctgggggagtttggaggttgaaggggttgggggaatttgggggcttaaggcaatggggatacttgaggaatttgagggcaaaagaagtttgggagctggggaactggggattggggagctgggggagtttagggagctgcaggggttagcggtgggtatttagggggcgatgagggaaatttcgggatgaaggaatttgcggggggatttggaaagcatttgtgatattagggggtcatgggtttgggggaattgggggcggatgtcaggggttctagggagtttggagcctcggggttgggaaagcagttccagcctccgaccctcttccccctagactagcccagggtcctggtacccgcaggccaagctgagtagacaggcatctggcacgggagtgcacgggcctggtggccagcacccaagctgcagcccagctccggtccctgctgggccaccccgggccctgcttacctctggtgtctctctgggcgctggatctgcggcgatggcggcagggcctgagcgctagaggataaatgtccacgctaggggcgggggtggcagcgggtgcggaaaccacaggcctccaggcttcctggatgcattactcatccacccaccatcagtgcagaagccaaggggcgggccgacgaaaggagatacaccctcctcctctcccacccgcctcctctccctctccctgggcctcgcccgggccagccacctcccccacctccacgtcagtcactattccttccaagccgcctcagcggagagcttagaggccgcatttcccccggcccagtcccctaaagtctccagaatctatccaatcacccacatcccccaagctccctatgactcaaacccaaattagttcagcccttcaacatttattgtgcatctactgtgtgccaagcacacaaaaatcccttgttttgtatgtctgacatgctggtgaggggtggcagagaggaaacaaattaagtagcagcagtggagggagataaggcaggtgaaaggggaggaatacaaaatggggaaactgaggcacggagtggttaagtgacttacccaggatcacagagtcaatacatggcagaactgagactggaactcaggtggccaggagccaaagccagggtctcaaataacacaggcaaatagccggcatttatacagcacctactgtataccaggcactcagcatagtttatctcactcaaagctcacaacaaatctctgagatgggtaccggttcttattcccgttttacggatgaggaaatatggggcgtagaggaactgtagaattttcctaagatcacagggcatggccgggattcaaacagaggctacctggcaccagggttgtaactcaggagtggcaccgtcctagcaagcagggaatggtgcgggtgaatgaatgagcattgggaagggggtggccatgaatgatggtgaaagaagcaagtgagtgggtcagtagaaaactaatccccaccccatcctgccctgccccctccccatggacctgtacccctggtggggggtggggtggggcaatccttgcccaccagctttctgacaatgcaggaaccttccctggggttctgattaacatccttaattcgaggaggatagatcaataataataattgtagtgatgatggcagccacttattgagcactttctgtgtactatgtgctaaagtgtttgtataaattatctcattcactcaccatactcccttgctaattaagtttgattaactcagggatgatagcccaataacaagaacacaacaaaaactaccagcagcccttatggagtgcttactgcgtatccagcactattctgggtgggaggaatgtgagggatgagaaattgcctaatgggtacaatgtacactatttggttgatggggacactaaaagcccagacttcaccactatgtaatatatccatgtcacaaaactgcagctgtaccctctaaatctattttttttttttgacaagagtcttgctctgtcacctaggctggagtgcagtggcgcgatctcagctcactgcaacctccgcctccggggttcaagagattctcctgtctcagcctcctgagtagctgggattacagccacaccaccaccacccccagctaatttttgtagttttagtagagacgggggtttcaccatattggtcagatctcgaactcctgacttcaggtgatccacctgcctcgacctcccaaagtgttgggattacaggcgtgagccaccacacccggccttctaaatcttttttttttttttagacagagtttcgatcttgtttcccaggctggagtgcaatggcaagatcttggctcactgcaacctccacctcctgggttcaagcaattctcctgcctcagcctcctcagtagctggggttacaggcacacgccaccacgcctggctaatttttgtatttttagtagagacggggtttcaccatgttggccaggctggtctcaaactcctgacctcgggtgatccgcccacctcagcctcccaaagtgctgcgattacatgcgtgagctacggcacccagcctaaatctattttttaagaaagcacttggccgggcatggtggctcacacctgtaatcccagcactttgggaggctgaggcaggcagatcgcttgagctcaggagttcaagaccagtctgggcaacatggtgaaaccctgtctctatttaaaaaaaaaaaaaaaagcactgttctaaagtctttttacagacattatctcatttaatcaatcccgattgcctctttgttcattaatgttagttaaggaagagatgttaagccaataataagagtacccaacacttcttgaggatcgaggcttactgtatgcccgataccatgtagagcatttttcccaaaataactaacttatttctcacaatatccctgtgagttagatatagctcatgttctcattatacagatgaggaaacttagacacaaaagggctgagtgacctacccaggaatgagaatgaagaaatggctctgctgcggggtggtggggggagggtgggggggcgacaaaaacagggaggaagggaagtaaaccaaaaaaatctgtaggagctgattatgaaagtgggacagtgagagtgaatgagacggggctgagtaacctggtgcctccgagggagaagtgagggcaggggaagtcctgccttggcccctcgctgactctggttctgacgccaactctttgaaacctgagtcagcacagagtgttgccgactgtttacatgaggagtcgtgtggatccggttattgtgcagttttgaaatggagagtgggaggggtgttcatggaggggtgtgtgaccatctggggagctggatgggtgtgggggcccatgggggtccaggaggcatgtgcaaagcggacacctgacaatgcccacagcataccaggtgcttgggcctcattgtgctctttgtgcagatggggaaactgaggctcagggagaggttgtgtccttcatggccttaggaagaagaaaggccaaaattcagacctagggctttccaggagctcccagagtcagagttcaaagcactctgcatgcacacatgtatgggcacacacacatatacagagcgttgtgttcaggctcaagtccagagaaaacaaggacagttaacgaaaagaggcacctagaaacctcagggttgttgggggaggtatgggtgtgtacgcacagctctctggtgtgttgtgtgtccattgctaagagtcgagcatgtgcctgtgtgttttgtgtgttacttctgggagttgtctaccagcctcggcaaagcggatctgggttgcatatgtaactgagtgcattatgcacttctgtgtgctgtgcgcacacctgggtggtactgtatgcatccgcctcggcatcgtttccctggcccgctgcccagagatgccccaaacccccgtcccaacatcgtgcctctcagcccacctcataatgacgccagtcatttgggaaatgaggaagggggggtgtgcagagggaggccttaaggtcaatcggtcaccctgagtctgcgggcttcctgtgcctgtcgggaactgggaaccaccaccgccccagcagcccctccgggaatgccatctctctaccttgtcagcgagagggagggccaccagaggggcactgtgcagctgtgctgtgggggtgggggtggagggagcggggagcctagggccgtccaacctggtttcctctaccccatccaggagcgggggagacttgaggtatccctctcgcctgaatgtgtgactgtatgtgtgttggggtgggagtgcccaggaatgttttctgcaaactgagttgtgggtgtctctggttgtgtgtagcctctctgtattgtatatgtggcaaggcatgttgtgtgtgtgtctagatatactttttgtatgcccaggaatgtggcgtgggtctcttacgggtcccagtggtgatgtgaatacctagaagtgcatacacctctgtgtgttgtgtagggccttatttgctgtgcatttgcctaggggtgttttatgtgtgcctgtgtgttgagtatgtgcccggttctgtggagtgtgcctgtggagttgtgtgtctcttgattggacgggtaatcttttgtgttgtgtgtgttcccctgatggtgatgtgggtttgggtgaggggagggaacctgggtgtgtgcccaagtattgattgtgtgcctaagggtgtccagtgtgtgctgccctggagtgctggctgctgacccacgctatgggcacctggctggctgaatgactgtgtgggtgtctgtgctgctccagagctcatgtgctttgagcctgtgttggctgtcagtctcaatgtcactggcatctctgggtttggcgatgtacatctgagttccaagggctcatgcctctcaatagtttatgtgtgcaggtgaggcttacatacaaggtttggctgaggggttcagtcactacatgctcaccaccactccccaccccccccacccccacacacacgcactggcacacacttgcctcactatcatccatccactgtaaaaacaaactttctttttactggaacagtcccccacgctcataccatgcctctgcccgggaaagcaggggcgggacgtctggaacttgttggtggggtggagtgagggacagacagacagggctctgggttcaattctgggcccggaggtggagacactgtgtgacccccagctgctgcctgcctgtctctgacctgtgtgtcctgggaagtgactcataatgcagttcccactggctgggatcccctcagtgccgccccacccctggaggtcaccctttctgccctgagcatgtctcctctgccttttccccaccagctcagcagtacaacgtaccccgtggttgtgaagatggggcacgcacactctgggatgggcaaggtgagtctctggctgggctgtgcataggtagatgtgtatttgtgcaatgcacaccagtcattctgtgtgatcgcgtctcctggggtgtcgttatctatcaggttggtgcaaaagtaattgcgggttttgccagttcttatggtaaaaaccacaattacttttgcaccaacctaatagatttttgttttctcacattcagctgacctcatcgacccctttttcctcctgcattcagccaattttgtgtgtcctgttattttgcttgtctccagcatcgtgtctgtgtgtacatgcatgcctgtgccgaacacacatgatgtggtgtgatcttttatgttccaaagtcttggggtcctgtgtgctttacatccatctgattttgtctctgtgtacgtagaaagtagacttgtaatttgtgtccgagtttctgtatcttagcatgttgtgtgtacaattgattttgtgtctggatgcctatattagtatattgtacatacacagttttttcacagctttagtgagagatagttcacacaccctacaactcacccatttaaagtagacaatccaatacattttggtatgctcagtgttctacacacccaactttgtgcctgtgtgctcacatacaaaacaggagacccatgatcgtgcctgcttgagcgccttggcatgtccacctaatttttgtgtactcgcctcacctgtgtgtcatgtatacatgctcccccaggcacccccactccccacagctgccctatcctgaccaggccctgatccttgcccgcacttccacaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgtgagtggagagaccaaagccctggaaggggtcccctgccttgcctcatgcagctgaggcacccctgagcttctgtccccttgtcccccaggaggacgtcagtgtcagggaactggaagaccaatactggctctgcgatgctggagcaaattgccatgtctgacaggtgggcagcccgaactcagggtgtgaggggaagcgggggtgggagcacgacagctcaggtgagagactgacaggcttccccaccctttgtcttggcagatacaagctgtgggtggacacgtgctcagagatttttgggggactggacatctgcgcagtggaagcgctacatggcaaggacggaagggatcacatcattgaggtatgagcacccaggggtaggtggggtagagggaggaacagatgccaggcagcagcagtgcaaactgaagcactccatggcacagaggtcctcagccaacagcaatgtgcttagtacactgtaaggtgcctgacgaactttcgaaggggccatcccttgcaatggcagaacactagactgaacttgcacgtccctggtgactagcaaaacccttattagattgtttagtgctctgcgaatcgagacatcttggtgaatggcgaggcacttagtaacctttaaagtattctgcgaactggaccgacagcaaagcattttggaaaggacaaagcacctagaaaaccgtgaagcagggatcggcaaacattttctgtaaaggagcagacggtacatattttaggctttgtaggccacgtagcctctgccgtaactactcaactctgcaaaagcagccatagacgatatgttaaaaaaataagtgtggctgtgttccaataaaactttgtttatggacattgaaatttaaatttcatgccattttcgcatgttataaaatctttcgatttttttcaactgttacaaaatttaaagacccatccttagctctgggtcatacagaaccaggtggtcggccaggttgggcccatgggccctaatttgctgagccctgctctgaagcaccttctaagctgtaaggtaccttggaacagacaagccttcctcaccgtgcacaatcagtgcctcagacactggggctcagcggcggccatgcccttggccaactgaaagcacggtgttactgccgcctcaggtgcgaggcctgcctctcccctcacggatcctttccttcccccaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccaggtcaggcccctggcgctgagctagtggcttgagctagtgtggggaggccggccctgggtcatgctgtgccatgaagctgataatctgtaggctcacagcatcacctttgcacacatgtggctgcgattgccaattgtttaaaacattgataagcagctgctgccctgacttccctgagcacctccctgccccgcccctgggaacaggtcccccaccccacaacccagagtaccctcagctcagccacaagtggggcaacacccagcgcacagggaacctgtgtcatcactggctgatgctccactggctggtaactatttttaacctctcctgctccattcctctgccgcagactccgtccccaggggccctgcccttgggccgccagacctcccagcagcccgcagggcccccggctcagcagcgacccccaccacagggtaagcgagaggctggcggtcgcagtcccctccctcagcccgccatctcttacccgctcactctcacgtgtgctctttctctccctctgtcccccaggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaagtaaggggacccctacagcagccttcgccttgctgctcacaaagcgggccgctgccccagtagagcagccctagctcccttgctcctcagacccaggtcctatgcaggggtcccacgaactctctccagcctgagccaagcccttcccccaagctttcgctcctcccggcccaccagaggctccgcacccccaccccaggaatttggtgccagaatcccagagaaactgcactcagttcgaattcctcctcaaaggccctgggaaagtttcctcctccagggcctcccaggcacctggctgacccaccctctgcaacttcctgcccagcccagagccttccctgccaaactcgcccccccgccaccaacccatccctaaaactcctggcccgagtcctagtcctcctatcatctggctcttcccactccatcctcatacttttcctcctccttcacatccttctggcccatctcagtctccccgcgaatcatcacccatctgccttttctggtccattccaactcccatcccagctcagacgtcctccctgccccacccagctgctctgccttaggctgacttgcccaacagcctgtccttggtccaagccctttctatgccctcctagacacctcacccttagattggaaacttccctgctcatcttcccctttgtatcaaactagccaagaattcacagagaaggttctgcccaggactcttgccacgaatcccacacttcaccctggatccaagtcctcccagcctgtcccagatctcgcctccctggcccaggactccacccactccacctgagtgctcccagccttgagaacctgttagggtccaggcccatggtggcaggtggggaggtcacaggcacagccccaggatcagaggggcagggctggggctgggcctggggtaacgttgtgtttctctccccttcctccccttcctcttcccccttcctcccacgcctccaccttgtctctctctagcaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagcagaattctgtgcttcttggtgaagaaagagaggagtccttgaatggcgggggagacacaaaagggaccccccaaaatccacatggggtgctgggaaccccaaaatccagtggaaggcacatcaggcacaaattccagagaggttctgagtggaatccctgccacaaatcccagccattggagatggaggagctcccaaaatttagaagtatccccaaagccaagaggaaaccaaatgatggaggagacagggggctcagtctttggcgggggtcccccaattccagaagaactggaaaagcacatggggaccccctcatctcccagggtggggaatgggggatcctgaggcagcatcagggcagagacgaacattgattggctggtgggcaaggctccttggcgtggagggctgagattggctccctggtggcttgggcggggcctaaggcacaaggcgggctgcgctgagtaggcaggcaggcaactcatcggcctgggtgcggtgcaaggagggttccgaggcactccgctcaatcttggggagtgaccgttgcagcagctcaattgtggccaggatctgagggcaggtgggggtgaggaggggtgtccagagccctgtgggcatcccaacagccccagcctcatggcgaaacacacacacacacacacacacacacacacacacccaacagtcccagcctcatggcgaaacacacatacacacacacccccaacagtcccagcctcatggtgaaacacacacacacacacacacacacacacacacactatacctctgagctttcatattcacatctgcctccatctcagtcttcctctatcccagagtcacccacccaaggtgtccagccccctacccagcccacctgggggaagaggggccgctcctcccgctggaacttgaggcagtcagacagcaggcgccgcatggccttggggcagttgctggagattttgctgaggtccggggacagatagccacggcccaccataaagataatctgggggcagacggg

SEQ ID NO: 15572 - DNA, 89224 bp, Human
gaccattttacagatgaggtcacacagctgtaggttggagaggtggctttcagactctaaattcattggcatttatatataggcatcatattgagactgccctttctaaagtactctgtcaaaggactaagagatatgaatagggattcagatgttgacctcagatttaggaacaaaatgcagaaatcacaaatgtccatctgaatggtgtctcaacaatggcattattttctcctatttgctaatcactgcaaggcatataggttttcaattacattatgagttacatagaatagaatttagggtccagatgggtaaactggtgaatccccatgaagtttgtagtagctatttcctgatacagatttgatataataacactgttgtatgtaatacagttttggtaatttcagttaagtagattgtagctttattgccctgggtcttcaaggaaacacatgttcaaatattctcactgcttaatgagatccttgttcctgttgaacttatgtgaccttattggaaatcaatgattgcttttgttcttcaaaatgtaatgttgaggagacctagatgaaatcactctacaaaatgcattgagattgcaggatgtggagaatgtgctgtaattaaaatgaatgattctgcttggaggtacagcatattttagctctgtgtgcatatcgtgcataagggaatttctctatgcagaattattttctcccaacaattctcatgatcacagcactcctggtagcaggtatcacttaactcctgggcagcagcttgtccaaagcaagggaaagggagctttcctttcctcgcaactgttgctatggggggcgtggcttcggagctgggtgaggaggcgttcggcggctccctcccccccccaccctcgtagactacacttcccgtgatgctcgagggaatggtctccgtggtgacgcacttggtgtccgcggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaggaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatggtaagtgacggataagttatgacactgatttaattgtggtttccaatcttatttaatcggaaagacggcaggcgtggggcgaagatttgctggggactgtcgaaaagccactgtgctgagcgatttggagaagttggagcttctggtttcccccttttaggaagtactgcttttaatatgggttctctcatttggtcgtgttttctaaagcattgaagatagtggagaagtagggaaatgtatcatggtagcttgaggggacaaaacatctccctcttcgctagaagcctccgaacactagtattttaacgtttctgaaaacgtcagggacagtgggcagagctgaggacgggtgtccctacgagagaataggtagggaaacgggaatcttgctttatgacacagacgagatcgtcattgcagtagggacgaacttgatatttttcaagaacagggatgcacatctcttcaagaaaaagtatgttagaatttgctgtgaggtttttgaaatgtctgaatacggatggcaacagaaatataaagatattttgggattttcagaaacgtaggctgaccctgtattggtacttacaatgaatattccagggctttttaatgccagatatttattaatagtagattccatattagacataaagctaaggaaacatagtattgagcctcgatcactgagtgttgagaacttgaaacaaaaagtactgttgtttattgacgcctttctttgttttgtttataaagggtaaggttgtgagtcggttgactaacagtaaccgtgtaaccttacagtgctggggctgggcttgtgtgagtgtgaagttacattttgcagtcctaaggacaaacataatgcatttaattaccaggaagaggaataatcctgtttatgaaagaattgaagttaacgtagttgtgctcacatatgttaacatttgagtgtttgtgtattcagtggaaacaaattgaactttgctgatgattaaattttattttattttttaattttaatttaattttaatttaatttttattttttgagacggagttttgctcttgttgcccaggctggagtgcaatggcgcgatctcggctcactgcaacctctgcctcctgggttcaagcgattctcctgcctcagcctcccaagtaactgggattacaggtgcccaccaccacacccggctaatttttttttttttttttttttttttggggagacagggtttcaccatgttggccaggctggtctcaaactcctgacctcagatgatccacccatcttggcctcccaaagtgctgggattacaggcgtgagccactgcgcccagcctgctgatgattaaattttaaaacgccagatgtttctagaggagcaaacctcatatacagattttataacaaaaattaaatgattctaaatggcttattttgaccttggtttaaaggaattttgctcttgtttaatttcccattgaatgcaaaggaaacacagtgttctgtctctgggggtggccacataacagctttacagtctccttcctgagtcctaaaactcgtgcgttgtccttttagttttcgcttctcttctggtgtgcacacatgaaatagcctcctgcctggttaagtacggctggacaagctttcctccatactgctcttgaagttgccgggagcggtctctagacagagctgggaaatgctatttcccttgtttgatgagtgatctgtgggttcatcgcctcgagcaaagatttgctctctcgaaagcctccattttatatcatcaagcacagtgcaaaataggttaaccttaagtaccgtctattctctcacagacgttggaatgaaatagatgtgttattaaaacagtgccgctacttcctttaggtccagtgaagaaaagctggaatgtgcgtggcatcagtcacagattgagatgatttgggaaatactgtttccaagtcagagagagggtttggaggctgatgttaggatcagaggactgggaagtaggagcagggttttattaatatctgcaattataaaatataacagtttatctgtttgagactggatgttaaggccttgattctgtggtgctttgagatcctttgattaaaggtgatatgcaagggcaaagcaatattatgtaataaacatataatgccctgatgatgctatttcagagtgggtactaacgtacagcacaggtttgattgttctgagtatttttttatgtcttgttttctactgttcaactggttagaggttaagattttctctttgtgaaagtcttttaaacgttcgtttattacttaactttgcatttttgcttaagaagtctatcatttgctatgtgcctagaattctcaactttttgaaatataacatgacaaatactggttagaagttgtcgattaaatgcttcatgattattaaactcttaataccatgaattgacaattgattttagtttacattcatgacaacaatttaccgctccaaaccttgaagagctcctctcaccactcccacagcaaagctaatgacatatatcccttgcagcataactctaaattgatcaggatatgtactgttaaatacatttttgctagatgcagtaaaatgttaagctttctcctagttgacagtatgtgctgtcaactgtgctgaaacaaatgttacacttttttactttttggtggtggtgtcatttctattgaagtcaatcttttatatgttaatggtgcttgtcagttgtataggaaaatcctgttggggagatgggatggagtggtgaagttaacccctatcatgtttccaatagagataatttattctcgagctacaataattgctaaatcaattgatgtttttggtaaagtctttttatggccgtgattatgactcactttaaaatagattttttagctttggtttttgttttgtaggtagaactcccatttaaaatttatttttgaacatccagtaaatttttgtgtttagcataaggagtctcatttttaatgatccaaatgtcaattttttggatgagggagtggcacccgtagtgaatggatttgctgtaccctttaaaacataatttgtagttggtacttttactacattctgcaatatatatgtcctataaatattacaagtgtatttacttgaaatgttggtttttctttgctaagagtgattgagtttgaactagatttaataacatcttagtgtagtaacttatttgtgaaaaaatctgaaaatatctcaacagaatatcattataatatattgtatttaaatgatgtatttatttatttatgttgcagccaagatcatagttcatgatgcggctatattcattgtttatagttgcagtgtgacttatgttaaccactgtaggttttttgcaagaaaatatttactgcctgtgttagtaataaggcctaagactgggcaagcaatggtaattttgttttctggattggtaaagttatcaagaaatacattcttgtttttataagagtattgtatacaacatttaggctactatttagagctttggactaaaattatactttatctattacattgaaaactttaagagagaaattgacagtgtgagaataatggcaaagcaattttgtgattcaaaacattttagttgataaaacggtcaaagaaaagccccgtatctttaacaactgtaatgtaaaaattgtagcagatcaatttgtaataggagttgaatcagataatgacaattcaagttttttccagtatattttatgtgcttaatgaatatttttattgtaacttttgttatatcacttccattcatgtaagaattattggagccctcttgtggacaggaaattactaaaatacatttcctttcaaagtgaacttttatcacttttccaagttaaagtaaaatgacatatgttgaatataccaggagaaaatgccatgaaaggaaaaggtccagaaaatagaaaagtatactgagatttaatgcccagggactttttcctctttagttacagctcctttttatttttctttctcttcctgatgattcttatttcaggtttaagttggagggttttataaagccaaaaggtagataagtactgtttacatatatgtgtgacttgaatagcttaataaataatatattaagaattgaatgtttctctgaatttttacttgaatgtctcctatttggtattttgaattagacatttttattaagaaaacagatgacattgtttcccacagctttgaattccttctttctagctctgaatcctaccccagcttgtgtctaaaatggtctttagttcattttaggccacagtgatctttccttcttgtaaaccatttttctttagtgcttttgacattcctcttacacaggtatcaaatttctatggatatagtatcacttttatttcacctctgatattttttagacattcagaaattgttgagtgactttcttgactcacaaactattactgtcttcgttacttacagaaaaaataaatattgttccgtagtaatagtggtgttaaatatgaagtctataatgtctgcttctgttatcacttggaatatgaaaaatatatatttatagtattaaaacttgaagttattttaaattagtggataaaatactgatggtgctaatagttttcacaatatagaacattaaatatgttttaggagactgaagcatatacttagtaaatgtgctctttgattttctaagtcatcttattctgggagggaaaaatgaagagtgactgtagaattcatggtaacctggaaaccttgggtaataagtcattccgaaccagtaaattttctgaatacttggaggttgagtgttaagatagcccaatctaacaatgttggattaccattgcatttgcttaaatgaaatatactatgcataatttaacttatttttgatgacttagagctatgatttgaataatattgcttgcattcaatcagtgtttattgggtacctgtctgtgtaatatggtagtagtattaacaggcataagctacaactataataccctcggcacctaatatagattgtgaagctttatgccccttcactagatcagtaatttacaaaatgaggtgaagcaagtcaattttgagaagtaaatatgagaacttctgtttgtttattttgtcccccaaaagggaaaagaattgagcttttctattcatactatgtgaattggctgtgaggttctcctaggtccacctgcattcaggtggtcactgagagtgtggtttgctgagggaagatgtgtgaattctagaatgtagatgccagcaacagcaccatgagtttctcagagtttttccagtttttctgttatatagtccctttaaaaatactttttaaaagaagaatctatgatacttcttattgagatggggaacagaggtttgctgtcaaagcatttaagagttgtagaactcaaagattaatcacacatttttattacaaaagatgagtattctatatgctgttcttatccgtgatgacaagaggctaccaaaaataaaaatctagcggatgtgtttgggaaaacaatccccaagttgtcacttcaaggcaaaatcgacattttaaacagtaagtgagaaagtacctgcttttcaaaagaaacatgttatggagaacattttgaaagcatgttgaagtatttacagtctgttgaaaatcttccttacaatgaattttaattgactttggaccatttattggaaagccaaacattttaatttgtaaacattcttattgcagtcaggaaaaagaaaattttaataacattgacatcaggtagctgactttgaataaaaatgtttgcgtatttggtgatagaatgaaaaagtaatatgatttagtaagttagtaagtgacatgttcttctatatagatctcatctttgtaagataagtttttcaggtatgacttatgacagctcttaaaaccaagtgcaaaatacattgaacttcacaaaagaagaaactaagatttaaaaaaatggagatatatttaataataatgctcacctaatatgttaatagtaatagcatttttagtgattgaaagattaaaacaagttaatatttaaaatagttgatagttaaaatagtaaagtaaaaacaaaattttaatcttttaatttctgtttttagtatatgttttatactatgtgtatgtttataaatgaaaacacatatactataggtatgtgcctcaagtattttatatttgggatcttcagtcaaaaaaatgtaggagccactgcactagatgactaaagatttctgagcattttaacttcttgtgtttgatagttagaagttttctgtctcctgccttgttgagcagctgttttttcctgtgatcagtgtgcctacttattcctaaccatttacagttgctggttttaatttgctatgggtgtggaaaccatatttccaaagtttattaaaaataatatgtgtttaaaatgagcaaatggtgtctgagtaggattttaggagttacctcacagtaaagtgagtatcttttgtttcatggacttgatcatatctgttttggttgcttagaattctctttttaggggggctaattttctggctgttagttatgttttgcagagatgcagtttcttgatagtgaagaactgcttaggtgataaaaaaattacacataactttactttgagctcgtagaggagagagaactaatatttgttgtgtactttctagtaccaggcagatgcttggcattttacattatagcatttaatttaatccttacagtcaccctggataaatatggttggtatatagataaagaaactcttaatacccaccaggtgaagaccaccaggaatgcatctgtggtgaaacaagttaggttgactgttttgcagctaggaagagcgtatgccagatcctgccaagtgtcagtaaaagagaatgggagggctgggcacggtggctcacacctgtaatcccaacattttgggaggccgaggtgggtggatcacttgaggtcaggagttcgagaccaccctgaccaacatggtgaaacccccatctctactaaaaatacaaaaattagctgggcattgtggcaggcgtctgtaatcgcagctactccggaggctgaggcaggagaatcacttgaacccaggaggtggaggttgcagtgagcagaggttgcagtgagctgagattgcgccactgcactccagcctgggcgacagagtaagactctgtctctaaaaaaaaaaaaaaaaaaaaaaaagaaagagaatgggaggagttttcagtagggtttgggctgtgctggaagcagggactcctggactgaatgctatcgtacatcaactggaggtgggttagtaattgggtctttcagcagtctttgtttaggagacaggataaatgaaggggatttggaaagtcattggtgagaaaacataatcacttacagaatgggagattgttggtcattttggagctgcagtgtggccataggaaaaactttttacctgttggtcttctatctttcagatatcacagtctgattatcaaccgagctcatttttactttctcacagcctaggttcagagagggtaaggaacttgtttgagatcacatagcgaggaagaagttgagctagaataggagtttgggtctggtggcaatagtgataaacatctacacccctccccacaacggtaactgagcaaacattactgaatccctcaggcacattatcctaagaatgccttagattccttcccaataccttgctccagggagtccctactgattggtctgagctagcatggtagaaatgaaacctacttcatatatctttgtaataaactatgtaacatctggattggaatgattttaattaaggttggttgtcttactaattggtaaaattaaagggagtttcctttaaacttgttggaactttgagtcttcttatgtatatatttgttacacagtggatttttcttaaaaagtactactttgaatgctttatatatatatgtaacaaatagattgacttgtaaaggatttagtgatttcggggcattttgtttttgtctccatacttttaactgcatatatatatgtagagagagagagagagagagattctctattggttggtcaaatctagtagcatttttggtcttaagtaaatatatatttgggtaattttctgactagattttgagaagaaaatgttctttctgctgaagaaaattgttgaagtttgacattaacatttttgtttatgtacttaagatggcaatttattgtgtctagacaaaatgttcttatgatatatgtttttctttactttcatataaaattagtgtttttctttgccttagaaatagtcttgcttttgtatcctgctattctcattgtcatgttaaatcaagtttagcctaaagctgcctccttacatatttaaagctcagcctatattatgaacatctatctatgcaaataagtatagaaccgtattataattttgaaccgattatgatagatgtatataaattatttagcgaattccatattcatgagcatttagaagctattacaaacaatgacataatggatattcttaaacatatctctgtgccttgtctgattattcccttaggacaaaactcttagtaatgtagttgctctgtcaaaaaatatgtgttaattttgggatgggtgggaaagagaaggatatatatttcctaattttaaagcatccttgaatttctggataaacctagcttttaattttacattactcaaatggtatatgctagataatacttcattgagatttttttttgttcatgaaaacaattggctagcaattttaatttcttgtaaagtatttgacagatttaggtatcaaggttatgctgacctcataaaatgagttgggaaatgctttttaatactctggaagaatttgtgaagattgattttattccatccacaaatgtttgaaagaattcactggtgaagccctctggagttttcttgtgaagattattgattgtatttcgtcagtacataaaaagctattcatattttctatttctttgtcaattttgacaagttttgcttttcaagagatttgtccattttgtctgaattttccagttcagcttaaggtttttgtgtgtgtgtgtgtatccttttataattgttttggtatttgtagtatctatgatctctccttttcaaaatctgcttattgtaatttgggtctctttgtacgcagtcttttcagagtccattttcagattaaatgttgtttttaactttttactgatttctgcctttacctttatttcttctatttaaaaaaatgataattttctgtacttttaaaagttttttgagatgagtacttaagtcattaattgtcagcttatttattttttaaaatcttctttttttttttttttcccccgagacggagtctcactctgtcgcccaggctagaatgcagtggctccatctctgctcactgcaagctccgcctcccgggttcacgccattctcctgcctcagcctcccgagtaactgggactacaggcacccgccaccacgcccagctaattttttgtatttttagtagagacggggtctcaccgtgttagccagggtggtctcaatctcctgacctcgtgatcctcccgcctcagcctcccaaagtgctgggattacaggcgtgagccactgcgcccggcctattttttaaaatctttttaagagatgggggtctcactgtgttggccaagctggtttctgaactcctgcgttcaactgctccttcctccttagcctcccaagtagctgagaatacagatgtgcagaccactgtgcctggctcctttgtggggtttttttggaatatttttggaatttaaaaaatgtatatgaaattccctctaaatgcaacttagatggatcttacaagtttgttgtatattatttttattatcattcaataaagcatattttaaaacttcccttgtgctctcagcatttggggattttctagctatatttttgttattgatttctagtttggtgtctgttgtggtctggaatcattctatgatttcacttgtgggtaatttgttgacacttgctttatggtcagttttagaaaattgacagtgtgccatatatagcaattaaatttattaatcatgttcaatctgttgtatcacacttgactttttttgtcttttttaaatcactcaattgagaaacttgtgttaacattgccaaatatgtgaggatttgtctgtatgtttttagttctctcaaattgtgcctcatatttggaggctaagttattagctacaaataaatttatgattgttctgtcttcctgtctagtaacattttttgctttaaagtttttttccagaggggatgttaatatagcattctttttttttctatccatttcctttaaatctctcttcgtccttatacgtaagatgaatctctttaagcatcatatagttgggtttttgcttttttactaagtttgataatctctggtttacctttaatgtaattactgtaccacattatttgggtttgaatttacaattttgcaatttgtattttacttccatcattaagtcctttataactttcccttccattttgttttcttttggattaatcaaacagtttcccatatacctttctctcagcttctctgttataaattcttttactatctttactggttagcatagagattacaatgttcatctttaacttttttgtctgtcataaatttttgcctttgccacttcagggtaatggaatggccttttaatttaattccatttacccctcttccagtctttgctttgttttcaaccccaaagatgtcattattattattgttaaagtaattataacagtggtaataagagtaatgttgttgttaaaataatcattgctcatttcactttgtcctcaaatttacctttctggaggtcttcatttctttctttttgattgtatgtgcatctgggtaattatcgttttatccaaggaacttttagtgcaggtcttctggtaatgaattccctgttttggtttgcctgaaaatgtgttcattttaccttcacttttaaagggtccctactttatgcaccttcaagatgttattttatcatcacctggctgccactgtttatgttaactcaggcttttgattttattgttactcctttgaagttaatgtgttttcctttggctgttttaaagattatatcttgtctttggttttcaccaattttactattgatgtgctcttgtgtagcttttttttttgtaatctacataaagcttgtagagtatcttgaggtcctgagtcaatctttggcttactatcttttgtcatttgggaattagctaaaattattattattattattattattattattattattattgagacagagtcttgctggtgtgcagtggtgcaatttcagttccctgcaacctccgcctcctgggttcaagtgattctagtgcctcagcctccctagtagctgggattacaggcgcatatcaccacgcccggctaatttttgtatttttcatagagacgtggttttgccgtattggccaggctgttctcaaactcctggcctcaagtgatccgcctgcctcagcctcccaaaatgttgggattacaagcatgattacaaagtgttgggattacaggcatgattacaggcatgattacaaagtgttgggattataggcacctggcccgggaattagctaatattctttaagtattatttctattcaattgtcttctttccttatgggactacaattacgtgtatgttaggtcatgtcactgtttccattcttttttccccttctcgtaagcctagagattttctagcaacctatcttcatgttcacttgtattttcactgtccagtatccagttatttctaattattgagtttttaattttagtttttgtattttttatcctaaaatttacatagattcaaattcttatgttttcatctgttttcttgagtatattaactactgttgcaaaattcctgtctgatgaccgtcatacctagattgtctgtgagcctgtttctgttgttttgtttttgattatttgatcctttttccttgggtgcctggcaatgttttattaacattgtgatgaaaaattatagagaatctgaattatggttatgtttctccgtataggatttaatatcctctggtgagtagttagaaaaacattgattactttgattcgtaagtgactgataagacatgagcctgaattcagggcagtcaggaaattctgatagcctcactattggtggactactggtgtatagcccttagctaaggtctcagttgaaagtttgccatgtttaccaagatacctcttccttggcaagtcctgaatttcaggtatcatgaggctgatgaaagctatttttaaaacctcttttcaacatctttttgttgggattttctgaatttcagtccatgctgtttacaattcagcacattcctggagaggaaaagttgaacagaatattgggcccctttctttgaggttcctttttattttcctgagatcctcaattcctggccctttggtggtacaacatccactttttgtgtcttcccagcccagtgagattcatacaagttctgggatgctgctttctgcttggccttttgctctgtactggtaattggcaaatacctcaagggggaattgaagggagatcttcaaagtgtttcccttctctaagggatcttggctcctcaagtcctgacccttggttgttctccggaaaccttcaaatagctggggatttaggggcattttatatcacttttatagttgttttccatgggaaatttggtctgatattgctgttctctcataggtagcctaattgccttttcttttcgtaccctggttttattttatttatttatttatttatttgtttgtttatttatttttgctgttttgtgctgtagaattggcagtcctctctctcttttatccttctagttgctaagaactgctaaaactaattactatgttacttaccatggcaccatcagccaagcagttgcttaagtcagacgtctcttggagccatccttgattcctctcttttcctcattctttatattcagtcactttcaaagtatatctagaatccatctacttctcttcatcatgctaccaacctagttcaagtaccctctctctcctggactattgtattaatcttggaactaatccttctactttgattcacattccctgtagtaccttttccaaaaataccttgagtgttttccattgaagaataaatttccatagaataaaattacaaatcctttccttgggccttcagggtcctgcatgatctagctcctgcctaacatgactatgtcatctcatttgatttgctatgctttaattgtattggctccctttcagttcctcaaacatgctacaagccctatcccacagcaaggctgagtctttgccttggatattcatcaatatactttttttttttttttttttttttttttgagacagcgtctagctctgtcgccaggctggagtgcagtggcgcgatctcaactcactgcaacctccgcctcccaggttcgagtgattctcctgcctcagcctcccgagtagatgggactacaggcacgcaccaccgcacccagctaattattgtgtttttagtagagatggggattcaccatgttggccaggatggtcttgatttcttgacctcatgatccagctgcctgggcctcccaaagtgggagccacccactgggagttactaggattacaggcgtgagccactgcacctggcctggatatttatcagcatacttctataccctctctgcatcacagagtctttgcttaggatgctcatcagtatacttctataccctctctgcatctgcatgggtagtttttctttcttcagagaagcttttcctgacatctaaagttgagagcctttactcccttggtttctgttgcaagaccatattgatttcttctggagcatgtatcacactttgtaattcagttatttgtcctccccagtaggccatagattccaggagggtggagatatatatatatatatatatatatatatatatatatatatatatatatatatatatatatttatatatatatatatatttatatatatatatatatttatatttatatattttatttgctgccatgaccagtacttagtatagtgccttttgtatagtagatttttcataaatgtttgtggattaaaggagtaagatgatcgcttacagacactgtgccaagcttattacttgaaacaaatttaatccatcggaaaactctcaaaacaatcctgtcaggtaggtaggtgctactattaacttcatttcattgatagagaaagtgaagcttagtaatgtttgattattttcctgaagccagctagctaagtagccttttttgtgttcttggagtttttacttttctaactttttgaccattcttcactttgtcatatcctctttactatattttaaagccagtggttacagttatactaatactctgatatttcaacctcagcttcttgcctttgcttaacatttaatttttaacattttaaattagcatgtaatttaataatttaaatgtgaattttaacatttgtttatcattaagccaaaatgtcagaaaataaatttgaaatttgaatggaagttttgagaaagcattaactgaagtttggtgtctttaataggacttaagtactttaagtggtggatttgctatgtggctatcaattattgtgagtgatttttccagctataaaatctttctcattattttgtgactgtaaagagaaagactgtattataattatatatatttgaatatattatgtcatatatgaagaaaacatttttgagccttttatatttaaagaactatttagttatccatattttttcatttgagcatccaaaaagatcaacagatttttcatgttaggtatcatttttatgattacatactagtctacatgtattcattctgttcttcttactcctttttttttttttttcttgagacagagtcttgctctgtcacccaggctggagtgcactgtggcgcgatctcagctcactggaagctcctgggttcaagtgattctcctgcctcagcctcctgagtagctgggattacaggcacgcgccacctgtgcctggctaatttttgtagtcttagtacagacggggtttcaccatgttggccaggctggtctcgaactcttgacctcgtgatctgcccgctgcggcctcccaaagtgctgagattacaggcgtgagccactgcgttatttattcagacagtcaataagtacttgttgagtacctcctatgtgtcagacgcttttttaggtgctggtgtatagtggtgaatgaagcaaacaaatccttctcctaatagagtttacatttaaatagtaaagatacagacattgaacaaaataagtgaaatatattgtatattagatggtggtaagtattacagagaaaaataaagcagtaaagggggttgggagtgctgagtatgtctgtgttcagttttaaatagtgggatcagggaagggctcacagagatgttgacatttatgcaggagtctaaaggaggtggggagcaagccatgcagctatcttagggaattatattgtaggcagagggaatattgcctcattggagtctttgttctttttaaatctcacagtgtgtcttctgccatgttctcaaatttttatgtttcttgtggtatttgttttctgtcctgtgtgatctaagtggtctcattattttcctcactaatttgggcagcaaacatttttgggtgccagtgtcctagatagatcccatcaataaagccaatcatttttctctaatatgtttcaaatcaatttcctcttttatctccactactttttaacccgatctccatccagacgtctttttagtttagtcatccactgcggtccgccttccaccgttttcccagatttgtctatggaaaatacagatctcagtgtctgactgtactacctactaatggctggctatcactcacatgctaatccaggccaaccttcttaccatgacagcattaatgctcttgtcttggcagttgggccgcattccagcctcatctcctgttggccccttgtatgtaccctgtgtttgagttgtaatgaacccctgcttgtccataatctttcttttaactcctgtgcttctctctcatcctttgcagagccttcactttctgcttaaagtggaccttgacttctctttatcttgctccatttgcacctgaaacttgtcctcaactgcagtgctaattccttggtaatgttttataactttgtcaggcagctagacactgtaagtatagaacatgctgggaaatccaaattaaaaatgacagttggcacaaagctgacttctgggagggaccaaggaaaagtagccagagtggcaggatagctgcttccatcacggattgccagcaatgtaaagcgtagactccagaggaacagtgctaacttaaattaactatgcaggcatcagtacttctggttctgatggcccggggatttctaagtagtagtgagtctcagcattatttgttatacagtctactgctagatgaacaaggctaagtctacagagaaggtaaattatagaaattaggccccgtctctactaaaaatacaaaaaattagccgggcgcggtggtggggtcctgtagtcccagctactcgggaggctgacgcaggagaatggcgtgaacccgggaggcggagcttgcagtgagccgagatagcgccactgcagtctggcctgggcgaaagagcgagactccgtcttaaaaaaaaaaaaaaaaagaaattaggtaaaaggattggaatcttagctaattggtctgaaattcagagctaggccacagaattagttgctctttcataaatttcattacctgtactctagcaattgtaagtgtttttatgtgtttctcccactaaacagactatgtacttactctgagggcagagaggcctcatctttctaaactgctgtgtctagcacagtgcctactaaataaggaaaactcaatgaatgttgaattagcactgcaggtgtctgatagaacttagcacaatcatggaaatgttctttattgtgtcgtctagtaaggtagccacgtgctgggctacttgtgtctattgggcactttcttcatggctagtgtttgaggaagcgaatttttacttatgtttaattttaatgaaaatatctatgtgtatctagtggctactattattggacagtgcacttgtatggtttatataatactttcagtggactaaaaagatctttgactttttttgtttttttgtttgtttgtttttgacttgtattccaagtggtcccagactgctaagctttttgttttactttttgtgattttttagtttttttcttctcttaatgtcagcgttctttttttttctatcattaagtaagctgtcatcagcctttcttttaacttttctgattttagtcaactatcatatagaaagacatataatcaagcttgtagaattatctttttttttttttttttcttttgagacggagttttgctcttgttgcccaggctggagtacaatgacgcgatcttggctcaccgcaacctccgtctccctggttcaagcgattctcctgcctcagcctcccgaatagctgggattacaggcatgcactaccaccccggctaattttgtatttttagtagagacgggttttctccatgttggtcaggctggtcttgaactcctgacctcaggtgatccacccacctcggcctcccaaagtgctgggattacaggcgtgagccaccgcgcccagcaagaattatcttttttaaaagagcaagtagtataggaatctgtgagtcattttacctctccttaacttctgtaagagtgtgaaattactcatcaggaaagaagagaagtctaaaaagtataaatttgtgtgagcattcagttgaaaaaatatcaatatgagattagatgagtcaccaagggagggagggaggataccctgaaggcacaacccctctatttgggaaaaagggaattatgaacgtgagaaaaggaacagagttataggaaaaaagaaaaaaaaaatgctggattgtcatttaaggcatatagggagaaactcaaggaggcagatttgtcaacaacagcagatacagcaaggaggtgaggaatattgtataatttggtgaaagctatatgggtctcaatatattatcaagtatttcaatgtggtcaagagtgtttttaatataattcttgtagttttcttccatactgatatgctaggcatagaaggattcagtatgtgcatttttttgaaagtcattttttccattcttgtgcctgtatctatattttccaaacactttctaattgtcaaaatacctttgctttgctactgcatataatcaggacaggcattaatagtacttgctttttgctctgaaattattcctttttaatcttacaaaggtgaatatttctattacagaatagtagggctgttggttcagtagcagtcatctagttcatgctttgatgcagagattgcaaagagatgttgtttcttgttaaattctttgtacccagagaaggagttttactaaaaaattgggaaattagattcccagctgtcataggagggaagcaaatggctttttcattccccaaagtactgtctaccttactcctttgggacttcgaacaggcagccaagaaaaatcaaaagctgggaaaactttttccctaaatacctttattctgggttcattgataagttgtatgtactgcagattgcagatgtaagcctgttattatatttttgcttttcaaattatggcaacacatgagtcatttctggaagaaatgcttacatatctcatttctcaattagaaccactagatggacagctgaagtctcccttgagtagttcaagtggctatcccaggatggacaaaagggatagcagtctactctgaaactgtaaaaccctttttttgttccccaggtgacttgaataacttatataacttataattacctgagaagcacaccaaaaataatcacaagtgcaaaagggaggttttccagaataggcacatcagattattacaaagaaaagagcaatggtatatccactttcgctctgtttgaaaacatagtatatgtgtggtcacatattagatgattaatttaagctagaagagtaactttcccaaattgaccattcttaacattttaagaaaataatttaattaaaaataatatgagtagggggtggttccaagatggccgaataggaacagcaccagtctacagctcccagcctgagcgacgcagaagatgggtgatttctgcatttccaactgaggtactgggttcatctcactggggcttgtcatatagtgggtgcaggacaatgggtgcagcccaccgagcgtgagccgaagcagggcgaggcatcacctcacccgggaagtgcaaggggtcaaggaattccctttcctagccaagggaagctgtgacagatggcacctgggaaattgggtcactcccaccctaatactgtgtttttccaacggtcttagcaaacggaacaccagaagattatatcccgcgcctggcttggagggtcccacgcccacggagccttgctcattgctagcacagcagtctgagattgaactgcaaggcagcagcgaggctgggggaggggcgcccgccattgctgaggcttgagtaggtaaacaaagcggcctagaagcttgaactggctggagcccaccacagctcagggaggcctgcctgcctctgtagactctacctctgggggcagggcacagccgaacaaaaggcagcagaaacctctgcagacttaaatgtccctgtctgacagctttgaagagagtagtggttctcccagcacggagtttcagatctgagaatggacagactgcctcctcaagtgggtccctgaccccctagtagcctactgggaggcaccctactgggaggcaccccctagtaggggcagactgacacctcacagggccaggtacccctctgagacgaagcttccagaggaacgatcaggcagcaacatttgcttttgagcaatattcgctgttctgcagcctctgctgctgatacccaggcaaacagggtctggagtggacctccagcaaactacaacagaccttccgctgagggtcctgactcttagaaggaaaactaacaaacagaaaggacatccacaccaaaaccccatctgtacgtcaccatcgtcaaagaccaaaggtagataaaaccacaaaaatggggaaaaaacagagcagaaaagccgaaaattctaaaaatcagagcgcctgttcccctccaaacaatgcagctcctcgccagcaagggaacaaagctggacggagaatgactttgacgagttgagagaagaaggcttcagatgatcagacttctccgagctaaaggaggaagtttgaacccattgcagagaagctaaaaaccttgaaaaaagattagacgaatggctaactagaataaccagtgtagagaagtccttaaatgacctgatggagctgaaaaccatggcatgagaactacgtgacaaatgcacaagcctcagtagccgattcgatcagctggaagaaagggtgtcagtgattgaagatcaaatgaatgaaatgaagggggaagagaagtttagagaaaaaagagtaaaaaacgaacaaagcctccaagaaatacgggactatgtgaatagaccaaatctacatctgattggtgtacctgaaagtgatggggagaatggaaccaagttggaaaacactctgcagaatattatccaggagaacttccccaacctagcaatgcaggccaacattcaaattcaggaaatacagaggatgccacaaagatactcctcgagaagggcaactccaagacacataattatcagattcaccaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcgtaagtgaagaagaaataaaatcctttacaaacaagcaaatgctgagagattttgtcaccaccaggcctgccctaaaagagctcctgaaggaagcactaaacatggaaagcaacaacaggtaccagccactgcaaaaacatgccaaatagtaaagaccatcaatgctaggaagaaactgcatcaactaatgagcaaactaaccagctaacatcataatgacaggatcaaattcacacataacaatattaaccttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctgccaagcaaatagaaaacaaaaaaatgcaggggttgcaatcctagtctctgataaaacagagtttaaaccagcaaagatcaaaagagacaaggccgttacataatggtaaagggatcaattcaacaagaggagctaactatcctaaatatatatgtacccaatataggagcacccagattcataaagcaaatccttggagacctacaaagagaattagactcccacacaataacaatgggagactttaacaccccactgtcaacattagacagatcaacgagacaaagttaacaaggatatccaggaattgaactcagctctgcaccaagcggacctaatagacatctacagaactctccactgcaaatcagcagaatatacattcttctcagcaccacatcgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccacacaactgcatggaaactgaacagcaagctccggaatgactactgggtacataacgaaatgaaggcagaaataaagatgttctttgaaacccatgagaacaaagacacaacataccagaatctcagggacacatttaaagcagtgtgtagagggaaatatatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcaataatccaggagctggttttttgaaaggatcaacaaaattgagagattgctagcaagactaataaagaagaatcaaatagaagcaataaaaaataataaaggggatatcaccactgatcccacagaaatacaaactaccatcagagaatactataaacacctctacgcaaataaactagaaaatctagaagaaatggataaattcctggacacatacaccctcccgagactaaaccaggaagaagttgaatccctgaatagaccaataacaggctctgaaattcaggcaatgattaatagcttaccaaccaaaaacagtccaggactagccaaattcgcagccgaattctagcagaggtacaaggaggagctggtaccattccttctgaaactattccaatcaatagaaaaagagggaatcctccctaactcattttatgaggccagcatcatcctgacaccaaagtccggcagagtacacaacaaaaaaggagaattttagaccaatatccctgatgaacatcgatgcaaaaatcctcaataaaatactggcaaactgaatccagcagcacatcaaagagcttatccaccatgatcaagtgggcttcatccctgggatgcaaggctggttcagcatatgcaaatcaataaacataatccagcatataaacagaaccaaagacaaaaaccacatgattatctcaatagatgcagaaaaggcctttgacaaaattcaacagcccttcatgctaaacattctcaataaattagatattgatgggacgtatctcaaaataataagagctatctatgacaaacccacagccaatatcatactgaatgggcaaaaactggaagcattccctttgaaaactggcacaagacagggatgccctctctcaccacttctattcaacatagtgttggaatttctggccagagcaatcgggcaggagaaagaaagggtattcaattaggaaaagaagttaaattgtccctgtttgcagatgacatgattgtatatttagaaaaccccgtcgtctcagcccaaaatctccttaagctgataagcaacttcagcaaagtctcaggttacaaaatcaatgtgcaaaaatcacaagcattcttatacaccaataacagacaaacagagagccaaatcatgagtgaaatcccattcacaattgcttcaaagagaataaaatacctaggaatccaacttacaagggatgtgaaggacctcttcaaggagaactacaaaccactgctcaacgaaataaaagaggacacaagcaaatggaagaacattccatgctgatggataggaataatcaatatcgtgaaaatggccatactgcccaaggtaatttatagattcaatgccatccccatcaagctaccaatgactttcttcacagaattggaataaactaaagttcatatggaaccaaaaaagagcccacattgccaagacaatcctaagccaaaagaacaaagctggaggcatcacattacctgacttcaaactacattacaaggctacagtaaccaaaacagcatagtagtggttccaaaacagagatatagaccaatggaacagaacagagccctcagaaataataccacacatctacaaccatctgatctttgacaaacctgacaaaagcaagaaatggggaaaggattgcctatttaacaaatggtgctgggaagactggctagccatatgtagaaagctgaaactggatcccttccttacaccttatacaaaaattaattcaagatggattaaagatttaaatgttagacctaaaaccataaaaaccctagaagaaaacctaggcagtaccattcaggacataggcatgggcaaggacttcatgtctaaaacaccaaaagcaatggcaacaaaagccaaaattcacaaatgggatctaattaaactaaagagcttctgcacagcaaaagaaactaccaccagagtgaacaggcaacctacagaatgggagaaaatttttgcaatctactcatctgataaaaggctaatatccagaatctacaaagaactcaaacaaatttacaagaaaaaaaacaaccccagcaacaagtgggcgaaggatatgaacagacacttctcaaaagaagacatttatgcagccaatgggcacgtgaagaaatgctcatcatcactggccatcagagaaatgcaaatcaaaaccacaatgagataccatctcacaccagttagaatggtgatcattaaaaagccaggaaacaacaggtgctggagaggatgtggagaaataggaacacttttacagtgttggtgggactgtaaaactagttgaaccattgtggaagacagtgtggtgattcctcaaggatctagaactagaaataccatttgacccagccatcccattactgggtatatacccaaaggattataaatcatgctgctataaagacacatgcacatgtatgttcattgcagcactattcacaatagcaaagacttggaaccaacccatatgtccatcagtgatagtctggattaagaaagtgtggcacatatacaccatggaatactatgcagccataaacaaggatgagttcatgtcctttgtagggacatggatgaagctggaaaccatcattatcagcaaactatcgcaaggacagaaaaccaaacaccgcatgttctcactcataggtgggaattgaacaatgagaacacttgaacacaggaaggggaacatcacacactggggcctgtggttggatggggggaggggggagggatagcattaggagatacacctaatgtaaatgacgagttaatgggtgcagcacaccaacatggcacatgtatacatgtgtaacctgcacattgtgcgcatgtaccctagaacttaaagtataataaaaataaatagaaaaatgagtaatttcttataagtttaaaattgatgtgaatcttttagaaggaaaggtaattatcattatgcagtgtcaactaggttaatgtggttgccactcagttatcctccatagtaaaattaatgacatttattctttctgtgatttctcaatgtacttgaccagtggttcctaaagagaagtgtttatgtatcttgtcccaatttgtcctttcttggccatactgtatttatttttatctgtctacacttaaagatctaaatttgcagccgggcgcagtggctcacgcctgtaatcccagcagtttgggaggccgaaggcgggcggatcacctgaggtcgggagttggagaccagcctgacaaacatggagaaacccgtctcttctaaaaatacaaaattagccgggcgtggtggcgcatgcctgtaaccccacctacttgggaggctgaggcaggagaatcgcttgaacccgggagatggaggttgcagtgagttgagatcacaccattgcactccagcctgggcaacaggagcgaactccttctcaaagaaaaaaaagaaaacaaaactaaatttactatttggtttattattctttcattctaattttgtaattaattagaaaagcaataagattattgtaaaacttgtaaaatagaaaacattttaaggaaaataataccatttataaaattcttcttcttacatatgaatactattcatgttttttctctctacgctccacattttttatgtgtgatgtgatgtgtgtgtttgtgtttgtgtgtgtgtatacagttgataattcattttgaaatgttctaatttggggagatcttaaagatcaaatttaattatgtgcccttttgtgtgcccttttgtgtaggcaatttacactcactcaaaagaaaacctttagttctttgagtttttcacaggatagtacaggcttctttttaacacatcatagctgtaccgtatttcctttttaaaatgcagtctttggccaggtgtggtggttcgtgcctgtaatcccagctactggtgagtctgagatgggatgatcacttgagcccagtagtttgagactgcagtgagctgtgattacgccactgcactccacctcaggtgattctatggagtaatatggttgtgccagtgactagaaacacttttctaattttaatcctgtaatttcactaagatagaagcaaattagaactctcctaaactagactatttcagtagaatcaaaaggagcagaggtttgagtttatatttgagatttgtgggatgcttattttaaaatctttgagatctcacaaaaggactgttttgtttttaactgttccctcctccagtcagtactttatcctattgctaggtttgtaaatacatatatggtatgtgtatacatctctgtagtatacaacacctttgaaaagaatctttagatttcaattatattttacttactccccctttcaccagctaaaagtaaatgaagtaaaaacaaatctctaaatgtgtgattacaaaatttacacatacatttatcttttcagaaatcacatttgcataaagttcattgagttcaatgtctgctaatttataagatagtttccctaccatatatattcaaccaaggcagcatattccagtggtggtattgttaattatatcagaattaagaacatcaacactttctcaaaagtactgaatgagagcaagtttctggatcttctaattcaggtaatttaatttaacaaagagctttaggactagttgtaatcacctagcaattactcataaaattgtttttaatttcatctatgttccttgagagccactgtgttgatgattctgttttggggatttatgtgcagtcagataattcatattttgtatttctgtacgaaatcaatggaacaagacaaaagtaaacttacagaaaattagtaaaaaattttcatatggtctcgtactagagaatataaagcaaataaaagatttttattggctaaaaactaaactttgctacctgtggagtacgtatgtaatgaataaatgatacacatacaaagtgttagaaagctcaaccaaagaagttagcatgttcttttggaaatgagaatgtcttcatgttccagtgacatttagtatctggaatgcagtagtagcccgatcttactttagaggttttaaagttagatttaccaataaatgtctgcaaaaggtattacatctggcttcctgagcaatttgactagttacccaagagttgtgattactatgacatgacgcagtacagctgtaaaaaataaagacaaatttaagtttagtcctggtatgtatacacagctttgctatattacaagaagggtattttctttgtgatgagtttagtgtaataaatcaaacacatatataacctataagtaataggttaaaaaagtataaatatattgaaacactgctcagatttcatagtcttttttttaacaaagcttttttggtacttagtaagcttcttctttgtgttattttttaatagtgaaataccagttgctggcatctattgagtgcccaggtgggcactgttttatgcttcacacatgtttactcagtaaaatttccctacaatgctattaggtaggtattattattatccccattttacagataaggaagctgaaacatggagattttaaagcagttttctggtaactggtggagccaggattcaaaccctggcattctgtttccagagcctatcatgtgacagtctgttattcccagaattctgggaaggcatactctgctattaaatactatatatattagaaataaggcagttcattttatatatgcatgtggtaagattatagaacaaaaagacaacagtcatttaacaaataatagcaaataagctgaagggttgacttcagtaactttagaatgtagttatgtttactgtttttctcatggtcagaacctaatatgttgatttaagcaatgtctatagttaattcattagaatgaaaggacagaaatgtagtggatgataactcaagggagaaaaaagcttgatataatagtttttaaatgtttaatactatttcaaatataggaaccatgagtgaaaaataaactccaggatcgcaaggaatctggggagtatcctaaactcagagttcattctgagttactataaaaagtctgaggacttcaggccaggcatggtggctcactcctgtaatctcagcactttgggaggccgaggcaggcggatcacctgaggtcaggagttcaagaccagcctggccaacgtggtgaaaccccatctctacaaaaatgcaaaaattagctgggcatgatggcacatgcctgttgtcccagatacttgggaggctgaggcaagagaattgcttgaacctgggaggcagaggttgcagtgagccgagatcgagccactgagctctccagcctgggtgacagagcaagactccatctcaaaaaaaaaaaaaaaaaaaaaaaggaactctgagggcctctcagtgggattctaatttctgatacatctttcttttcagggtcactcgcatactactattaggacttcattagagaagcttctttccagaaaagaaagaaaaagccatatgttggaataagttaagaaacattgttaggcttatgggaacaccataaatcatcctataaagcttatttgtagaaccttttacgtttttgaaatggttgacattttatctttgcagttgtctatagaaaagttttgggggtagggattggggaaaaaggattattgtccttgaattatctcctgtgatagaggtctcaggtcttgaaatcagccctttgacgttaatgaatctttatcattaattcttgggggtgggggcggtggtgtggtccttggattctttctaaatcatttctctccaacttggaaatatggttctcttctaacttttaccttttttaaaaaaagtgatgtcttttctggtagaagaaattttatttttgaaaaatgctcataaaaagaaagctacatactttgcagtatcctagtattttaattcattatcataagtaagcagtaattatataggttctattacagaaagtataactgctttattgtattaaatcttctagtcctgtgattggtaggttaatttttttccagctttgtagaagtaccattgtaacaatctccttagtttatggacttggccaaatgttgtattcacaggtaactgtttcttttgaactctgagcatctttctttatcccaggatttctgatatggatagccttgatgtggttaagggtaaatgcaacaaaatcaccttacttggcctttgcctttcgttttacgcttcatagttctccttttctgtcccaaagctaaacatggggtttaactctctcagattatatttagagagtcacttaggtgggattttctaagcacttttattttaactttcatgaaaaatttcaaacatacagaagtagagagaatattataataaaacttccatgtatccatatctcagcttcaacagttgtcacctcatagacagtaatgttttatctgtatttgtacttgctctacttgctccttctaaattattttgaatcaaattccacatctttcataaatattcccagatatgtaatatatagtgattatttttaaaacaaccataatactcttatcacaccttaaaaattagcagcaattacctaatattatcaaacacacagatataaagcatgtaaagatgctgctatcttttagcaattgaaaaattaacatttcagaatgtgattagtgttaaagtggtttttgtcttgtgaacattgtgaaggggagaacgcatgggaaaggtctttttaaattctgtctgagacagtattcttagagttctgggttttttagtcttaaactaaaatgaattaagtctcaatttgctatcaaaatatacaagctgttatacattggccactaaggtgaagtgcaagcacacttgtgataggcgtattatgtgaagtcagaactttaaaaataaggaaacaaacacttttttgaaaggctggaaaaacttccttaacatttaaaaatagttcttaaacagagaaaaatttgtcaggtgattgattggccttaatttgagaaattattagttttcatcttccttttttattggaaggaaaaggaagaaaatagttatttgtgtacttctgatcaagtgacctaaacagttttctttttcctttgctctgtaaaagattagtagtcgtttaaataattgatgttaagtgtctctgaattcctgtgttttgaaggctttgcacatattaactttctcttcctgactgaaaaggatgtgtgtgatagtatctttttacttagttagtctaaatttagatttcttgatcatgaattagaaagcctgtgagtatatgtgaatgttagagtatgactgttttcttatttttagctacttttgctgctgaacttccttttttcactgcttggtgcagttaagggtaaatgcagagctgattctggtgtaatgcagcttctaggacagaacatttgcatataatatgttctataccaggaatttgaaatggggactaaatgcaatttgtgaatgaagcaccttaatttgctaaactaggagctatgtcagattttaaaaaataaagttttgctgtcagttcaggctagtataagttattttctgtaactcaaatgataaaagcaaaagtttaaaacattctctggatcaaatctaattttgaattcctggcttacagagaaagcacttgtttatgtctggttgccatttacccagctccctgctctcccatctgtcagaatgctgacccagtttgggattagaatagggatttaccacacgcacaagtttatacatgcatgcacacatgtacatgtgaatttgtacgtatttcacttaacaaattggattttagcattgatcttctgctaaatggaattttaaaaaaattatctatgattactttgcttttagagttggattacagattacattgaaaaaaatagaaaacctccagaaacgctttcctttctaatacatttcagctattttgcttctggtctctttcctgttcctcccctgacccattcttatttccatcacctcagccggctttatcatcataaccctgtacccctcccctaccaagtagagcagggactaagcagtgattaaaacattggagcaaacctgaatggcttaattcatttaaaaaattcgaaggttctgctgcccatttatccatcagataagaggcaaaacaaacagaaaaacttagctttagttattacagtttatgttttcatcttacgcgtgttgcataccaagctatggtaactgtagacttccccaaatgacattcagattctaaactagaaaatgcttttatttatttactccagaataaataaaatgtcgcagacaagaaggtaatgtattttcctcctaaagtgactttaaagattgaggtggtttagtatttagcactgaaacttggaatcaaacagttctcagtacaaaatgtccaggaataatgaggaaacggcatggcagcactgccatggtttttgtctttgggggattgttgtatgcaggcaggataacttttgcgtctcacatcttgaatccagaggtgatagataaccctaatttacctagcagttaggtatagcagcagtctgctacctagagtttatccaagaacaaggaaatagcaaatgtctccaagcaataaaaatattacacagattcttgtaaccaaatttataaactttactcctagaagattttcagagttcaacattgttccttttttttttttttttttttttttttttgagacagggtcttgctcagtcacccagcctggagtacagtggcacaaacacagtttactgcaaccatgaactcatgggctcaaacaatcctcccacctcagcctcctgagtagttgggaccacaggcatgtgccaccatgcccaacaatttttttttttgtagatacaaaatctcaccatgttgcccgggctggtctcaaactcttgggcttattcaatcctcctaccttgtcctcccaaagtgctgggattacaggcatgagccaatgtacctggctcatttacttttattttagacacatttgctattattttaggtaaacagtttaaaactgattacttcagcacatagcaagagatttgttttagatagtcaaaacagtcagcttatatggtaaaaattccttattgttacttggttctaaaagtaaattccctaaactctgtggttatattccataatttagtcaatttcttcaataccatattgctttaattgaggagaagggactctagacaaagtaatgtaataatattaatattattcaataataaaattgtaatatgtttacagagtgctttttgcttttcagttaaaatactttcattcatattgtcttatttaaaaatagattatttcttcttagtcagatcctggtgacagtggggaaaaaaatcctacaaagctaacagaattcgtagcatagcattctgaagtttagtggaaaatagccctgagcacctacctaatatgtcctaaaagcatcattgtgtgataaatgatatttatgatgactccatgcagaaactggttatttgatagatattgaaaggtgttaaacttacctacatcagaaatgtatagattattcagctgttctcaagttgaggtagctcccaaagataaagctaagatagacctgtatgagttcagttccttcattgcagtaggtaagttatccagacatctttcattgagtgcttttctatttgaattggcatcttgtttaatcactttgtgaatgacatggaaacccactcatctggtaacttttagatagatttttaggcaattcagaaagcacactgagaatttccctaaaatgtcagtaacattgcctgaagttttattttatggttctgggttggaaagacagtacatatttgggaataaagtggcattcagaagagcaacaataaaatggggttttgtttgtttagtttagctgtgggttatacatattccttggcttctagacctcacaaatttatttgttcaggaagttattaacacatttctaacttggataaaatacttttaatatctttgatctatggtaggtgggtaattcatggtcatttcccaaagtatgtatttatcatttttggtatccagactagaggatctcagaagtttgaagctgatttattatatgagatatttctcccccccacacacccatttcccactcatctaactcgttctatttgaaatctcagctgagtctttagaattctctgggatgctgtttcagacccttgtaaatctgtattggtgctcactctttgtgccccagtgacacaggatttctgttgtagtacacactggattgacatttcaattgctactgtgttttgcgcagagttaggacaattcataggggatgggaactaatagttggtgaactaacacagtaataataatcttaaatatttgcccaacatatatttaatagaagaggaataaactgattttataacatttctatatagaaacaaatacctactaattcgttttctactggccaatgcagggtcagttttctagaaataattagacaaaacatttctgaaggtttggtagttttaatcccttagatcttattgcatgatttttctgaaccaggcagctttctaaaggccatttaaaattacacaataaaatttaattaattctggtaaaaatatattgttcagttttggaacttctgctgactgcaaccacacatggccaatcatattccagtggtgtatttctggacagcagcccgcctaggtcattctttaataaaactctggtctatctcattagcttatgtgctgggacagcatggcacatgggcatcttattcaactttataataggcccttacatcttgggcctattacagtgcttggaaaagagtgggtgttaatatttatttgatgacttgttgaaagagtattaaagtttttctctttactcatgtacaaaatttggcttggcatcccaaataaaatttttattattttttattatatagttgttatatatctctatatattaaatgattatttatgataacagtagaagctcttaataggttttcatgtcattgccattaatttgttctagattttctgtttggtagaatataaatttgttttccttgagaacgtctgtaagctagcaggcaggctcagttttagttaaggactgatgagtaaaatttgtaactgctgaaagaccttgtatgatttttgatatttgaagtaattaaaacaacctgtatttattcttattggctgtgcaatataacttcacaaaatctacagcaaaataacattagatactctttaaaaaaaagaaagattctaaattagacctaaaactactgtttcttcttggattagacctaataactcagaatagaaagtaaccctcttgaataagctgaagaagcgtgatttgcatgcattccttcttttgtaactctgaacattatttcattagataaccagaacagtgtcactaatattcattaattacatctttttcttctgaggattttaattttatttcaaaagtggctctgagtcttcttccccaaagcatatgagaatattgtggtggtgtttaaaggttgctttatttcttgaaaataatgatgcaaagtgaatttaaaaagtagcagtttgaggaattgaatacagtcatctctcagtatgagggaaggatttgttcaggaccctaccatcacccaatgccaaaatccacagatgcttcaagtccgtgatataaaatggtgcagtatttgcatataacctatgcacgtcctttcctgtatgttaaattatctctagattacttacaactaatacaatttaatgttgttctatgtattgttttttatttgcattatttttaattgttgcattgttttcagtgttttccaaatattttcaatctgtggttggttgaacctgtgaatgcagagtctcgaggataaagccaactttacaacttttcatattttacttaaataaatatgcctttgccttaagttgttttggtatttcccaggctttggttcttactgaagataattacttttttcattgtaaaaaaagatttatgactttcaagaagaaaaataatttctgagcaaagagaaaatgaagaagaatactatgattgggctagctggagaagcgtttcctgacgttctatgcaattactgaagtttggctgtaatttggctctcagcaaggcaaagggagatatctgattgataataagattcatagtattcataaattaaaactatagcaattgcttaggaaaagaaatttttttcctgacactgaagtctgagagaaatgtcttacataggcccttataaaggagacattgactagttctctccaagtaaatgtaatgggtatttttaatgacgtaactcttagtcacaattgggtaaaaatgactctttagaaaatagcactgtccaatagaaatagaacacaacatatgtaattttaaattttctggtagccacattaaagttaaaagacaacaggtaaaattaattttaataacatttcacttgatatatccaaaatattataatttcaacatctaattgatacaaaattattgatagtgttttaccttttttcatactaagtcttcagaatctaaggtgcattatacttagagcacatctgaattcagatgtcagattttcattagaaatagtctatatttcataaaatttacagttgaaaaaataaattcatatatccaagttccaaacatgcttaaggttttctggtaactgaatctcatatatcaatttttaaatttaaattaatttcaagtgctcaatagctgtatatggccagtagctactgtatggaatagtgcaattctagagtatctagagttagaaaaatcttacctaggagtacacatcagaatcacctgataccttcaacatatatgaccttggaaatgattcagtatgtctggggtggtgccttggagtatgtattttggaaagttccacaaatatattctgatttatacacttggctaagagtgtattaatccagaagagaaaatgagctgcatatacttaaagtgatataaccatgagtagtggttcttgcaggtaggctttgtacaagagttcagcaataagagcccaaagtgcagatattcaacattcccagcctgaaaactcttagaattgaattttgaattggctaaaccctgtgctgatttgaaagggaaggtttacatggggaataaataatggtgagactgtcaatacattcagagaattgtggacttcaagacttaaaccgtgtggcttggagaggcttcttgaaggatacaggaattaagctaggccttttacaaattgataagatttagatgggggagcatttcaagtagaggaacattagtacgagttcaacctatattggagaagaaattttgaagtgagatggagccggagtaagggataaaattttgaattttgtttatttaaagggcagcatgaagatacttggatatttgagagaagatagagagtgtatcagttaggaatgcttttagctgcaaaaacaaccaaccaaaaaaacacaaaaaccccaaacaaccccaactaatagtgactttatcactaaagatatttaattatctcacataacaagaaattgggaaaaaggcattctggctagtctagcagcttagtgatgttatcaagcagccaggtatttttcattattggaggtagcctttttatccttgtgcttgttgctcagtactttcaagatagctgtgtgctctaggtatcacaaccagttgaaagacaagaagagcaactggtgaggaatggcatggagggcatggcagggacagtctatctaccagtttccttccgcagctctctcttctttgcagcataggattaaatttcctagaagcccccatcagtcttccatacacctctttgtccagaactaggtcacatggctagtactagttgcagtggagtttactgtagctctaatgtcctcttaactgtgttaaacattgcttcattttaaaatactcttaggaaggaatgaaacaaacatggcatgtatcaattaatattgagtttagcaattagtaactgcaaaatcacacttagtagattaaaataagtaaagagtttatattattctgcaacaagaaatttggaaagtggcagtccagggctagtacagtggcctgagaagtaccctcgagggaccagtatcctcctgtctacttgctctgctttccttagtttatggatttcctccccatggtccaaagattatcgtataataattccaaagatcacattgtgttctgggtggtgaaaaagtggatgggcaaaaggcttttccctagcagtgctttgagaaatgacccttcctccccaggtactttaacctgtaccaccattgacttgaacgatgtcaagggtctatacatagctagtaaaagttgagtacgttttccaggtctttattgtaaaggcccaaaattcataatttttaacagtgagcaaaagaacacattcccacattgtagccagcctttcaaactaagtcattttgtatccttctgttgtgtgcgcagctacttcttcctaagcagagtgctggtttccaatcatagcttgcattataaacaacatcagttcaaataaggcaaatcatgttccttaatttaaaatatctaattcacacgtagaaaactcactgttacactaaaaatacctgtattttcacttagtagaatattaactagttattaaatatttacaaaggctttgcacaaaatgtactatacaccactggtcttcagtttacaaatccaaaagatgccttgtcttcatcttacttggcctctcagcagcacttaaaacagtacagcatctggccttttaaacactttcttcttttggtttctgtgaccccatatacatgattttcttactgtctcattagctattccctctcagtttctttggccaactctttatttgctttttaaatattagccttcttcagagctcagtctgtgctctcttctatctctctcttttctagaattggatcagttcccaggctaaataccacttaaatgctgatgacccccaaatgtgtatttctagcccagacaatctcctctgaattccttaatcacgtggccagttatttttaacatctccactttttaaaaaacaaatttaggattgatcctattgataccatcatcattctcccagttgctcaatcaggtatgtggaataaccttaattcctcagtttctccattattcatatcacatacctcagcaagttgtattttttactcctaaaatatacagtgggcctttcatattcataggttctgtgtctgtggattaaccaactgtgaattgaaaatatccaggaaaaaaaaatttcacaaagtttcaaaaagcaaaacttgaattttctgcagtctgaacactatgttggatccacacaaatgaattaatatatagtcatttgtattaggtattaaaagtaatttagagtgatttaaagtatataggaggatgtgctaggttatatggaaatactgtgttattttagatcaggaaccagagcgtccttggtttttgttatctgtgggcgggggtcagaaggcagggtcctgaaacatagaccccactaatgcctagagatgactctatatttagtggaaacatatcttcttcactgcctccatccctgtccaggcttttgtcatctcaactaaactcttgcaaagtcttctaaggggtctgtcagcttctgttcctaaggaaagaatgctctatccgtacaacagccatgatgaccttcagtgtaaattggaccatgctccactgctgaaaactttttaatggtttcacagtccactttaatatttaaattccttcccaggctgtgtgagatctgactcttgcttgctcttcagccttattggtggctgtcttcctcagttaccattctgtgctgatttatttattttttcctcagatgtgccaaggctttttcttttctgctttggagtttttatgcatgaagttcccactgcctaaactgttctaccacctactctttgcatttctgactccttcttcaggtctcagtgcaagtatccctttctcaagctccctctccccaggttccctattctaggaccctgttgaccctgttacttctttatagcattttcccacaagttgtcttttgtttgtttgcttgtttacctgtcttcatcgctgtactgttagttccatgttttcagacatccatctatgttttacatcatgtgtacccagtaggtgtctagggtaggtgctcaaaatttttgaatgcatgattaataccttgtagagatgtttatattattttgaggaaaagaaagatttatattctattgagcatgatcatactgtgttaaaaatataaatagtctttagttaatccaattttttttcaattaaaagttaaaaactcttccaacttgcacttttatacctgggcacaacgggagatcattgaatgcaactactacttccctaagaagggaacatagaaaataatatgctactttatatttttacagaaagttacagagcttagaaaatacatacatattgtctcatttgagctttacaatagtgttctgagtagttaggatatttaactttgtgtaagcattggtcttgctactaggcatgtgactttgggaggtaagtcatttgcaaaatgagacaatgagggtggtgtgggtatccatagaattaatatatatgaaaatattttgtaaactacacaaaacaaaacagatgttggtgataatggtattaacactaagaaacttagcttccaggacagttaagtggcatgtctaggatgtcacagctattaagtagtatgattgataaccaaacccaggctgtacagtgaaatggaaaaatcaaaaggttgagtggtaacatattagaatgtcttcataaatcatatgtgtgaggtggggggagtgggagcttgggttttgaaattttgtaattaatttaaagtagtcatgtcatcctttattaaatggtcatatatgcactgtatgcattgagtatacactgagcaaataagaatactatgacacctttttataaatttgatacaaaattaacttgctagctatatattaaatatttagtttttcccatcttaagagttggaaggaaaatggaaggtgatttttaatggtctagaatagattgtaatgaaagctgcttaagcagcttctttttgttcatttttccctttagcaaacagaggctttgagaatttcctcatatatacctgatttctcttagaagcactatgaaagctgttttaatgcatgtttgttaatcattgtggtttttacccactacaaagaatttataaaatagactattataatacgtttaaccattaagtagcaatagacaattcttttaaaatttgaaaaatgaaggaaatattaaaaagtggcaaaaagtcatccatattgttacctcccaaagatagcctttgtaaatattttggtttctgtcttgccaatcttgcagttaactgttagagataagtcttgaatcaactttttccttctctttttcagaattcctttttttattttttcagaacagcaatcatagctgattgcttccttgagggctatatttgatctgaacagtgatgctattaagactacactagatactatacttacagttattagattaagtcatacttcattgaacagcaatgtaaacagttacttggataataataactactgaataaaaaggagctctaaaaattcatagaattaataggaaaaactggttgtagaattgtggttgaagtcaataatttggtggagagcagaaaacaaagagataaaaggcaatgagaattgaagtctgaggtacttaaatcacagaactcaggagcagtaaggcagctggactggcagtctcgattcttatgcagctcaccagtttgtgggctagggaattgagccttgagcagtgaagtgacttacccaagattatatagtcagctagtttaaaagccaggactaggagagtccaaggttcctgacttacagtttaaccttcgtttcccatacaagaagtagcaagaactgggcttgacattatagaaaatgaattatacaaatattaactttatacagtttgtggtacctaggttctctttaacaatagttgggtctctgtggaaaaggaaagaaaatatggtaaactttcagattcaaatgcccaaattcatattcttaccaattcctttttggtatcattactctttctttgtgatttcatcattctgaagtacactacatattagaataactgataattataattgaattgataaaatatggtatatattaaatattagtttggaaatacaatctcacagtaggaaagaacaagatagaggttattataaaacttaaaaattgcaccatagacacaaaagctactgaagaaagcattacagatcacaaaagacaataaagtgaattatgagtttgcacgtgtatcactgggtcaggagagatgacaaagccatggccattataatatcccttcaggcagtgatcacgtgaagccagttttggagtgaggaaaatgctttttaatatttctgaatttaagccaaagaacgcctcagtatttataatgaagcaaagatcttggtctaatttaagaaggtgttagactggggtcagtaaatatatggcactcttgcacctcagcactgcacccaccatactccctgccccccagccctaccctttacttatgacagacatggatgattaataacaactcattttccactaaacctagagatggtttaagatccttcttaggggagcatattttcagcagctcctgtaaattaatgattggcaagagtgataaaatttgttttccaggccggcattagatattttctggatatttttcttgctaaagtagactaatgtaaaagtaagtcaatcaataaccatacaagaagagctaactactcacttgctgagtaataaaggttttttctctatagcacagttttatgtaattggatgctagtgtgtaattttactaatatagaaatacaagatactactttgtggggttttttggttttgttttttggttttgagacagcgtgttgatctgtcacccaggctggagtgcagtggtgcaatcttgactcactgcaacctctgcctcgtgggctcaagctattctcctgcctcagcctcccaagcagctgggactacaggcacacgccaccatgcccagctaattttttgtattttaattagaaatggagttttactgtgttggccaggctggtctcaaactcctgacttcaggtgatctgcccaccttggcctccaaagtgctgggattacaggcatgagccaccatgtccggccacaaggtactactttggatgcataccactttattttagaatggcatttgtaatgccatagttttctggaaatccttagtagttttagaaaatggtagaatttttaagaatttatttaaaagtctagcctgtatataacttaatgttggataattgcatggaaaatgtatataatgaataggtgaaatcatgttctatcatctcagcttcttgaatgttgtgatgtttcaaccattcattcaattaaaaatatgggagggcaagttataattaagccaaaccagttgtactagggagtgattttccccccaagttaaaggagactattttttattaaaaagatagatagcatatatagtcatgtttctcaaagagaaggtagtattgggggtgtaagagccgttttctaagtggagatgcccatgctttcatcccagaggacagacatatcagactcttggaagagggggcccgggccaagaaatataatttgaaaaagctccctaggtgattttgaatctaccttgccctcaaggactgctgaaatctaggaactttaagaatttagattctaaaattgagtttgttttccagacagaattcccaagagagaattactgtggaaagctgctgtagaccatttaatccatccattgtgataaaatggcagacattcttagtttgatataggtgtatgttttacataaatcttagtatttcaaatattttaaatacctcttaattattgagtagtctctttagagagttgttttttatttaaatcattggctttgcttaattaaatggtcccaaatttctgaatcagatggctattttgatatttaataatctggctctttcaagttagtactgttacctgagatacagaattatatgtaaccaagttgtatatatatgtgcatgtgtatttcaggccacatgcacatgtgttgtgtatgttcagatcattagaaggtaggaatgatcgaatgcattataagctgtttctgtaatctctgttgtttatagcaataaatcatgttcattgtggaaatttggaaaaatgtgaaaagtttaaagtagaaatctgaaataactcattatgctatcacctggaaataacatctgttctgttattcagtttcttcctggttcgatctttggaggttctgtttccaggagtttatccatttgttctaggtttttttagactgtgtgcatagaagtattaatagtagtctcccaggattttttttgtattactgtggggtcagtggtgatgctccctttgtcatttcttatttggatcttctcccttttttctagctagtggtctaatttaatcttcaaataaccaactcctggatttgttgatcttttgtatggtttttcacatctcagtttccttcatttcagctctaattttggctatttcttgtcttcggctagttttgggcttaatttgctcttatttctctaattcttctaggtgtaatgttaggttgttaatttgagatctttcagactttttgatatggttatttagtggtataaacttctctctttataaacttccatctttagctgtgtcccagagattttggtatgttatatctttgttctcattagtttcaaagcatttcttgatgtctgccttaattttattgtttacccaaaggtcattcaggagtaggttgttcaatttacctgtaattgtatggttttgagtgattttcttagtattaagttctatttttaatgagctatggtccaagagtatggcagtataatttcaggtttttttttttttatttagctgaggattgtcttatggctgattgtgtgttctattttaaagtatgtgccatgtgcagatgagaagaatgtatattctgaagaatatacattctgaagaatgtatgttttttggtgaagagttctgtagatgtctgttaggtcttttttggtcaagtatcaagttcaggtcttgaaaatctttgctaattttctgccttgattatctgcttaatatagtcagtgggatgttgaagcctcaaactattattgtgtggagatctaagtctctttgtaggtctttaagaacttgttttatcagtctgagtgctcctgtgttgggtgcagatatgtttaggatagttagatcttgttgaattgatccctttactgttatataacgtccatctttgtgttttttgatctttgtgggtttacagtctgttttgtctgaaattaggattgaaaccccttctcccttttttttttctgttttccatttgcttggtagatttttctccatcccttactttgagcctctggatgtcattgcgtgtaagatgagtctcttagagacagcgtaccaatggatcttgcttctttatccggcctgccactctatgccttttaattggggcatttaacccatttacagtcaaggttaatattgatatgtgtggatttgatcctgtcattgtattgttagctggttatcatgtagacttgtttgcatcattcttttatagtgtcagtggtctgtgtacttttgtttttttagtatgtacttctgtgtgtttctgtagtggctagtaatggtcttctttcctttccatatttagcactcctttaaggacctctggtaagttaggtctggtggtgacaaattcacttagcatttgcctatctaaaaaggatcttatttatttctcctttgcttattaaacttagtttggctggatttgaaattcttggttggaaattcttttcttatagaatgctgaatatatttgtataagtgaatgatttgtataagtgacctgcctcttctctctagctgcttttaacattttttattccattttgaccttggagaatctgatgactgtgtgtcttggggatggtattcttatgtagtatctttcagggattctctgcatttcctgaatttgaatgttggcctctttagtgaagttggggaaattttcatggacaatatcctgaaatatgtttcccaagttgcttactttcttcccctttcaggaatgccagttagtcatagatttagtctctttatttcataaccctgtatttctcaggagtttcgttcattcttttttattctcttttttgttgtttttgtctgactgagttcagcaaaccagtcctcaggctttgagactcttgcctcaacttggcttattctgccattaatacttgcaattgcattatgaaattcttttagtgtgtttttcacctctatcagatcagtttggtcatttcttataatgaccacttcatctatcagctcctgcatcattttattgtactccttagattaggtttcatctttctcctgaaccttgatgatcttcatttgtatctctattctgaattatatttctgtgatttcaccccagttggaggacccctgctgggaactagcgtggtcatttggaagaaagaagacaggctggcattttgggttgccaaagttcatgcactggttctttcttctctgtgtgggctgatgttctttaactgtggtgtaactcgagtacagtcagttaacttcttttctggatgttttcagaaggccaaagctttgtgccttgtccttttatttgtgcagggtctttatttgtcactgagttcttgtccttggtttcacagcagggtgtattagcaaagtatttttggtgttgaagtttaagctgtgatccagtagatggtgcttaagcataatggctagtaggtaggctcttgctccactgcgtggcccctctgtatttcctcaccactgcagctgtgcttcctctccctgctctgaaagtgtgggctcctctcccacttaagtggtggctgcaaatctggccttcatactcccaggctgcacactgctgcccttggatgagctcaggcttcatgttcccttcccagtttggaggcaacaggggaagggaccttggcagtggctgtggcagagggcctttcacttgcctcttggggctccaccccagagaaatgcagaccctctatcaatcagtgtgttcggcctggggtggggtggctgcatagtgggctcaagccagggaaccctgcctggtgacgttgagcaatggggaaagaggactttgcggggagacagtctggcctcttcttagggtggctatgacttgctaaaggtatagttaaagcactcagggtcttcactccttccccggtccgagggcaacaagggcagtacaactgaagtggtagaggggctttcagttgtctctgagagcgaaatcagagaaatgctgagccgttgctagtgggaatgttcagccaaggattggggagactgcactgctggcccaagcttggggctctgcttgctgaaaaatgcgggggttgagggctcataatgagaagaagctgagctcctctgtacaatgactgtcatgctttaagtgtgaataaagctctcaggctcttcgtttcttctccagtccaagagcagcaggggcagaaccgctgctattggttgcctctgggagcccctccccagggaaacacagagttactagcagtgggaatgcttagctgggggtaggatggctattctgtggttctgagagcgggtgtgcctgttgaagagtggggagtggggtctcacagagaaaagagactgggctcctctccatagggtggctgtggcatgccagagttgccatcaggccctctgttccttcctcagcttgagggtagcaagggcagtacccctgcatctgcaatggcagaggggctgtgggttgtctctgggattttctcagagaaatgcagagctgccacccactggtgttcgggtaggggcagggtggatgtgctgggggtccaggttgagaggcaccctgtccctacccggaggtgaaaatccatatggaaaacagtctggccctttttccataaggctgctgcaccgtgggggggtccctgtcagtccccagccactaagctgccttctaagcctgagggcaacaggaaagaggtctgttgagcagcaaaaatggctgtctgctccctctgggagatccatcccagggaggttcagagctgctaccagcctgagtgtttgttacttagggcaatgttgctccaacgatttagcagaccggcaggtaactatcctgccgaaaggttgacttgacttattccatccatattttataaatttttatggctgcataatattctttcaagttagtctgccatattttttcttttatcttcttttttttagttgtattaaaacattcacactttatcattgttaggattttagaagacaacatttttatatgtcatagctttttttcttctgcctcttttgaattatttacattgaatcaatttctaggaatggaatctcagttaaaaagagggaatattttttacagcttatgatattaattgccaaatgacttttcaaacaggcttacactgttcaagtgctcctctctctcctcaaatctgcctactcattggccatcagaacttactaactcattcagtcagggttaggaggagaaataagaggctgaaatttaaatccatcagtcttgttactttgttgctgtctcgtcatattttcagcagagcaagatgtcaacactagcatttcaaaatatatcttaaaaattaaatgtgaaattcagtgatttattgatttgaattgaccgcagggtgtttgcggaagtaaaacttaaataatcatgaatataagctcgaaaaggaattactgttcagcaattggattttaaaataaacttttgaaacctttggatgttagtatagtcatccccctattccctgccctagtcatcctagaaaattttattctcagtccattggttctgccattgcataaaatactttgacttttttggcttttttttttcaatacccacaatgtgacaaattttgtcctttgatacttggacttattttgaaaataagcaaaaattattcaaaacaaagtctaaaataaaatggtgataaactgcatggtattattctaggcttaaaagaaaaagccaaatgtgatttgtaaaataataaggcaagttttgtaaataaatgccatgtagaagtgaggtgatggagaacaacagagggaaataacttctaaactaggtttcaaaatacttccaaaatacaggatttgactctttttttcccttcaatggcagcaattgtgcacatccagtccaaaggtaccgctttgaagaaccactcatatgcatgtaaaaagttctatttttgttacagactcataattttatagtcttagtgtatgggagcaaagaaaataatatgtgatcatgtaatttattgcatttaggtaccttttagacatttttacttaaccatataacatcttcagttagtcttattttcaaatgattttaaatatcctatttgctgagtagtttaaaatgtgtgaagttgttgtattgctctagatttctccaagaatgtgctcttgatggtttatcacagtaaaggtatgaattaagtaatacattacttagccgtgattctcaaccaaggcaattttgccccctaggagacatttggcaatgtctgcatacttttttttattgccacaactttgccgggggcagggggaaggggaaggcggcaagggtggaatgccactgatatctagtggatagaagcaagagatgatattatacctcctacaatgcacaaaacagctccccccactacccaaatgaagaatttatctggtctaaaatatcagttgtgctgaggttgagaaaccctatcttagcctaagatcttgggttcagaaacagagctgtattcagtttcccacttacctttggcaagatatttaacctcattcaagcttcagtttccttatctggaaaataaagagaataatatctaccttatataaatatcgttagcacaatttctgagaccgtggtaagcaggcaacacatactgttctcattgttatcactaccaataatatcaagcatgtgaaaaattactaaaattataacgtttgatgagtacttaaacgcatctatagttttttggggtttctcttaattttgctcatttaagaagaattcacatatcctttgtgaaatagctgtgctgttgcaagtatgactacttagaagtttttgttttccacatattttctaattacacttgattcagactactctattcatacttgtattatcaaaataataaggcttaaatgctgtgaaaaatttgtagaatgattgcacatatttagaggactcagtctttagaataaggactgttagtaagcttatggactgtggcctcttcttttttagagctgcatctacagtagtagctatggcttattagagatcttgtctgtgatcatggtaattatggtatttttctctttctttctaatggccccctgaggattttattgacatactttagggaggacaatcagctgatttagtacttgtaccatgccttcattaaagatgtttagggtcgggcgcggtggctcacacctgtaatcccaacactttgggaggctgaggtggtcggatcacctgaggtcaggagtttgagaccagcctgaccaacatggtgaaaccccgtctctactaaaaatacaaaaaattagctgagcatggggatgggtgcctgtaatctagctactccggaggctgaggcaggagaatcgcttgaactcaagaggcagaggttgcagcgagccaagatcgtgtcactgcactctagcctgggcacaacagagcaagactcagtctccaaaaaaaaaatatatatttaatatgccatcaaaaaaaaaaactacattgtgaaaaactgggtaatggtggaaaagaaaaagtagaaggaagcaaagacagaggaatagagggcatcatgattcatgattcctccccttgaagagtttatagtctagttgacatgatatttaagtaatcctcatggatttacagacctaaatgtttggcagatttcatgtattaatagaaggaaggaagtattaataactgagcaatgttaggaaaaggacaaaccagggacagccattttccttaattgaatcttattaacccttacatttaagcataagactaacaacagttttaagacttagaacttacatgatcatatttattttatttgatctttgcagtagtcataaaaggtaaatcaacacttacgtaatgtgcctcccaaatgcatgtaggtaatgtatgtaatgtcaaattagagatttgaaaatgaattggtaaaaatgtaatggcaaaaaaaatgtattggggaatgtcagtgcagaatttgaagggttctttctccagcactatcttggccggtgtaaatgattgtatttcgagaccttaaagaggattagggggattcaccagagaaccacatcctggtgaaaatattgtatagagacattaaattcctataattctaagattctgtctgtaccttcaaatcacattttagtcactaactaagcctgcttctttgaccatgaacatcatatctctttcacaaggaagcaaagtacctagcatttaattttctttctctttttccttttctgacctgaagaaatgtacagtttcattggggagacaaagaccaaccagccaacagaaaactgatactaaaatatgaagaataagaaaaatacattaagaatttttttctttagagcctgtttgataatgttttcaataaataacttctactaatttataaataattaatttataaatacgttaactgcttattccatgccagtataattgaaaagtcagtggttaaagagacatttagactatgttctctttatatgacccacgcttcctgcctttaagttttttcctaaaatcttcctgttatttttctaaatctagaatatgaagcccttgaggaatagcagctgagtttaaacagtacctagtgaaaggctgaaagaatcctcaaaccttctagaagaatgaccttaactgttgtgatcagaatggagaccaagtcatggtagagatccaagatgaaatcattttatcacctaaaagattgtcagcgtttttgattatagccatcttagtgggttggagatagtatttcactgtggttttgatttttattttcctaatgactaaatcatgctgagcatcttttcatgtgcttattgggcagtgtcacttccaatttaaaatatgtaattgagtaatgattttgcttgggatttttaggagaaatgcttataagtttatttgtagtaccataacatttatgagaatttaaggttgaccatttttataagtttagtttattagatttataagaattataggtaattgggaagattcaccagcagttagtggaaatatctaaagaagaaattgaatctgtttaatttataattgcagtttaaaatctaaataattgaaagccagtggtaagtgatacattttgacagatttgtaagttaagtaaaaacttaaaggtaactttaaaaactgggactaattttttgaattttttttgtaattttcataaatcaaatattaattaaaaaataaaattaaacttctagattttattttctgtgcacaaaaactactcctggcacaaaaaccacttccaagggctccaaaagcagctctcatcttcagccttttagcaaatgacttaatttttatcgtctaattatttatattaggccagctctaacatgcttcttcctttgcggtagatctttcaagttttatcttctgttctcttttcaggctttctaattataagaaccgaacaatagaactaagtattttaaaatgccattaaaaagaaaaacttaaaattcttctccttatttaaaaaaaaaaaagagagatcaaagtcttcctctgccacccaggctgtagtgcagtgacacagtcatagctcgttgtagcctcaaacttctgggctccagtgatcctcttacctcagccttccaagtaactgggactgcaggtgcataccaccacacatggctctctctcttttttttttttttttttttttctgagatgaggccttgctatgttgcccaggctggtcttgaactcctggcctcaagtgatcctcctgcctcagcctccctagtagctgcgattacaggcacaagctgccacctctccttagggttgcagtgagaattaaataagtcaatatataaacacctaaaagaggatctggcaagaggtatatggattagcagttattaatagtgttattacctattaataatgttactaattgttaataatataactaatgttagtcactaatgttactaatattattaataatgttacttactaaatcctgactagaggatctagtaagagttatatgtattagcagttattaatgttactactatgtactgcatattaagtatatattttttatattattaggttaaattcttaggagttccctaggatatttgctgccatatatagctcattttttcccctttggaaaatataatccaggttacaaacaatggatttacaagttaagcctttaggacataaaagtttataaatcagcattggttaggctccagattatttagtatttgctagattaaatccagtagtagagttatcccttgaaggcattaggtcttatgcacataaaagtttatgtatgaatatatgtgatcaaaatcactaactccattcatgagcgaatagcctgagtacttgaatttgaaatgaatgtttgctgtcttatcatttaagagtgtcaagataagaatgttttggctacaatttgtaataattgtaagtctctttgagtagaattctgcctttgttattttatagtctttatgcatgcatttaattcttccctgtacctgctgcaagaaaaatgtactcaaatgcatagccaatttcatgatttcagaagcacatattgaagtgtacctgctaatttctgttgcttttgcaggtcttgaatatttaagcattgatatgataagtgcctgataaatacattttgcatggataaattaatatacaggattaactagagcaagatacatcggagaaagggcacccagtgcccaggaagacccattagtagattacttacctagtcataagagtctaaactaggatgctgacaggtgaatggaggaaaaataaaagataaacactgcagaagaaaaattaataaaacctggtgactgcgtagctctataaaaatagttgtgattaaaatacaatttaaaatcatatctgctaccagccatgttctttatatcttcttctaacttctaggatcattattattctctaaattcagttaacctatacctgggtacttagttttcacctaacaaacataactaaagtaggtcagaaaaggtcaacatgcatataggtaggggtgcgtgtgtgtgtgtgtgtgtgtagtgttagtaaagattccctcttattaatgttgaattgctattgaagaaaagtgagaaagtaattttattccttaagaaagcagcttttatggcatagtcatgctttctaaaacttttaagataaagtaaggataataccttcagtattggtaagtgttcaaacattaacatcttgactattctgaaaataagataatatctaataggccaggtgcagtggctcacacttgtaatcccagcacttcgggagggtgaggcgagtggatctcttgaggccaggagtttaagaccagcctggccaacgtggcgaaaccttatctctactaaaaacctaaaaaattaactgggcgtggtgtcacacacctgtaatcccagctacttgggaggctgaggcaggaaaatctcttgaacctggggggtggaggttgcagtgagccaagattgtgccactgcattctagcctgggcgacaaagcaagattctgtctcaaaaaaaggaaaagaaaagccaatagaagaaatgaaagtggtagtaacacttagtaacacacattggttcttgtaatgagaggtccagagactaatttaaatcttttccagactttgtatccgttttatggtgttagttactctgagttatcattgatatatggtagcaacttctggcatccctcacatattcttgaggattgtaggtgtagataattgtagataatagaagtgagtataggctatatcattgattaaaaatagaatatttgagtaatttataaagaggaaatttagaatattaaagtaataagaagaaaactaaaataaataaatagaacattgctaagtaaatagttcacgtcaaagggttgccatacctataccaatttatttggaattctatcttgtcttttataaccttagataattctttaaaaactctgagcctgtttctaaatttgcaaaaaatatgtgatattttctagctcagtgccagggatccattagttcttgaattgtgtctctaacaatgatgcattctggtcttttcatgtccatggctttggataattgtctaatctgcatataccaatctttcctatttatgaatattatttctgctgtctgttagtcgttgacttttccccaggagtttatctgttcttttccttagctgtttctttttaaaatttttcctttcaattttaatttgcactttactattctatagttctcttctttatttcccctctttgaagccatctgctgccatttgttttgctttctgtattgtaatacgaagtgttttgatgctgctagatttatattctctaacaatgagtttatgagcattctgctttttaaaacaaacatagtgtgatgcctttacctctaataaatagcacttaatgattatgttaattagcattcttagcttagaaagtatgcatagatgcagaattttgtgctgtattttatattatgtagtgacagggatgtatttgtcacttttgcttgtcgtttttcctgcttgttatgcaaagctgccctgctgaataatttgtcataccaattctaagtaaattgataaattatgtattagcattttaaaatttaattaataactattaataaaacaccattgtattcaagtaagaattcatgagtattccagagacatctatgtataaataagaacttcaatattaagagcacgtgagatcatggctttctggggcaccactaagtgacagtgtcactagtcacaggttgatgcaaattgtctgagctgaataggactgcaaagcagaggcagtgtgaaacaatcgttttcttcatagacagacagactgtattcttttaaacaggagagcttgctatcacttttgaataataagttaactgacaacatactgtaaagaataggatgatttatttatttatttatttttatttttttccctctttagagaaattggtttttattatcactgtggtctgttccagagcttgtattccaaaatagttgtgggaaatagtctgttatcactcaactgtgtataacggtaaaaaatattagaaaacattttttcttggtaattattggtagatccacttggtggttatacacgaagtgtccagttacatgtatatctttgaaatattttagtaatgttggctatagtttggcacacatactctagtacattattcattcatcctttcaaagtattaaatacctacttttttcaagcactgtgactgaggttgactatatgaattaacttgaattatttttccttttttgatttaaaagcaggatttaatcgagaaacaaaacacaaccaatggaacctcatgtccacaattgttctgtagccacatacgcataataaatgtgcctggtgtaagagaaataagaccagtttaagttttcagattgattttctaccttcaaggaccatgatttaattgggggagttggtaggatatggacataaatggtttcttgctacaataacagatgtgatatatgtaggatgaccttataatttattgtctaaattgaggtacttttgagagtgaaagggggcatagtaatagtgagacagcaaacatgagtcagaattgtcctaggcaagcatggaccctatggtgacagtgattggatatgccagtgattggatggaaactctgaggaaggaaggagtagtgtaggtttgagtggtcacttaggcttcaaaggtgacctcagaaccgaacaagaacaatcagaaagtcattctggtgattcttgccaggataggatttataatgaatatattgctttggctgaaataggaatttggatagggaattagcagtagttggactgaagagtttggattgtaaatatttgatcttaagagttacttaaccttagtgtcccagtttaccatctataaaacggagataacagtacctgtcttatagggtcctatgatgttcaactgtgtacctcatagaaagtactgtgcagcacttgtaagtgattagtaaatgttagctgtctagaacaccctgacagaattttaaacttttaagaatgtttttgagagtacaggatggattgggctgagaaactgacagagagaatttgaaagaattagtaattgggtaagggcaagtgagaaaaaagggcaggagtaaatgatgactgagctttcatgcctaaaggactgagagaccaggagaattcagcagaaataaataagtcaggaaagatatctgttgttaagaaataagttcagttttaaacatatcaaatttgaggggacagtaagctatctacccgatcagaaatggacagctagcagacggagaaatgaaaatggcgcttcatggataattagtttgggaatattccaaatgggtgacagtggaagccttgggagtgaatgagatctctcaaggatggagcagggactgggagagagactgatgagggaaccttggaaaaacccatatttggattataaaaggaagaaaaaccaactgaaagagaggatcaaaggattaaacaagcaggaatagtcttcccgaaggatgtttaaccaaacactagttctgtggggtgggtaacaggtaatatgggaaagaaaattggttctgtagttaaatactcattcactgcaagaattctgtgcccttttaatatgttaacatgcatgacacatctccaagaaggaaacatataaagtagtgttttgtagatttacctgacgtcagaacccctttctccccagaatacctcttgggggttggtgttccagaaaacataactttgggaattataggaacctaatgaggaaagacgtttaagaagtaaggagttaaattgtgtggaatgttacagagactaaggaagatgacaaatgagaagaaggtttttgatgttttcattagatggtcataagtaacctttaggagcacagttcagtagcatggcttcaatagacacaggtttaaaaggaatgaaagataaagagttagtgataaagaaattagagcattggatttatgtaattttacctctattcaagtctaaagtgtgactgataagaatgaattggtcattattgaatgtttatgtgtcctatgtatattattatattcctaaataacgttctctttttacttaatgattttcagatattagtgaggaactttaacagtcatctagaacaatacctctgaggaccattagtttccttttcatagggtgaagtcatacattaaaatgatcttattttctagccatggcatcaagcattaaaccatttccccatgttttcttaaaagtatggggaaagatgcacctttttaaattctgtgtttttacagtgtccatcttatgtgaattttattctaatattaaagaccatctctgggtatattctgctctttcatgcaacagtgatacaaatatttaattgatagttatgctataaaagggggagtcattcttacattcccccgaacaataagtagattattttaatatcagctattttaacatttttaaaggtaacaatgctatgtcataggacttctgactgactttccattacaagtaaaattttgtttctacatcaatacattatgcccaacatatttgaaaaaaagcaaataaacttgaatttcagtgacctggttgtgttagccccattgcctgctgaggtggctgaatgccttacagcaaacccagagtactgtagagctagcaactgtgtttgatcatctctgtattttctggcgcatctagcctagtgcctttttaacacacatttgtgtgttcagtcttttgaagaatcagctgaaagtagaacaatcttgaacacactaataatacaggtatagctctcctccctcttagagattttggcatatgaaagattctgaattttgcagtgaagaaacttacttgaattgaaattttcttttatatttttaaattgtgataaaatacatataacataaagtgtaccatcttaaccattttaaagtgtgcaattcagtggtattttacatttgtgaagttttgctaccatcaccacaatctgtctccagaactcttttcattttgcaaaactgaaactctatgcccattaaacaataattcccgccgggcgtggtggctcacacctgtaatcccagcactttgggaggacgaggctggtggatcacctgaggtcgaaagtttgaaactagcctgaccaacatggtgaaatcccatctctactaaaaatgcaaaattagctgggtgtggtggtgcatgcctgtaatcccagccacttgagaggctgaggcaggaaaatctcttgagcccaggaggtggaggttgcggtgagccgagattgcgccgttacactccagcctgggcaacaagagcaaaactccgtctcaaacacacacacacacacacacacacacacacacacacacacacacacttccccattaagccctacctccattccctggcaactgcattgtttgaattttttaacccatttccaaacttatttcacagtaattaagaattctttttttcttagcatctacttatattccctagaagttccatgggtcagagaaatgcaggattagttttcagttagtatatagcagattaattaaggagtattttgtctcaaaagttgtgtaaatcctaagagaaaacaagcttttctggagaggctattcgaataagatagaaatcaaatatttagaaagaaataggaggagtcttgagagggtgttttggggtggcatcgaagtatgctggaacaagtcctgacctaggaagaagaaaacccaggttctagccagcctctcagggcatctctgtccttgtcttttccttatctatgaactggatgaattctgagactcctagttttaaaaattgttctgtgttgaatgattgaggaatattgtgaaaggcatagaatttaaagtagtactgagaatttgataatagcatagaataagtaggagagagggaatctgggaattgacacaacaaaggagcagacatctcaaaggggatattgtggaaggctcaaataatggtaaggctaagacaaataagtgtagacataaaagatttatcctgtatcatacctggatttattggagtaactagatggttagagagaagagaaagtactatatagtaggttctggaaatgtgccttgcgctagaactattcaaaagaaaacgggtgcctagttgatcttcagtaaatactggttaatttcaggctgtcttatccaaaaaacttccaccatcatgccgtcactaatgggaggtggacagaggaaatagaattgtcatcttcctgaaatacatgaaactccatcatgaatatatactactctaaccctccctgctgtcctctctagtgctttgcctttaccatttccctttctcctttcttagtttagtatcttcagcatttgggtgacagaaacaattgtactaaacagctgttcttaatttaatgagccatgtgacctaaagatactccccaaaacaaagatttctctagaaatcaatccagtgccctagagaaagtacttttgaattcattcaaatttgttatttaagttaatagtatgtatagaaaaccaaagggctaccattgcacattgaaatccggttaaagctgttaccttgtatcctagatgcaagggatatcctacagtcaggttttaaagtgataccataatttaatttcagaatcaatatgttctgtaagcttacaggattttgaacttgcaaaaaaagtaattttaacaataatttgcaagaattctcaataaaacatactgtcagtcttctcatggaattttaattttatcaaagtttcccaaactgaaagtaaatgtacattttaaagtactaaaggaaagagcattatatagttagcgttatgtgatttactaaactgatgatggatataatgatgataatttgtgataatatctaactattagggacttacgtgctgggcactaaatgctttatgaattgtgagttttatattttgattctgaaatgtatttataagaacccaaagttttctttgtttcttcactgatgaagaaaaaaaaaacagtttacatagaaagcaaggaggctaattaactattcctgttcattcatctctatagcccaacagctttttgttcatgttgagtgttcccccaaaaatattttagctaataagtagttgaatggtttctataattcaaaaattattaaatgttgctttggaatgtagttttccacctacattttaaaatgagtcaaaatattctgcaagttcacattccaagtaaatgatatgttgtaaaagttttatttgggaacttaagctagaggactctctgacctctcttatctacctcatagggtaggtaaatgtttccacaagtaaaaacaggaatctcactgagtgttctacctataaggatttgatattaacatttaataaatattagaatctacatcatactaaatgctaaacagaatatagaaaaagatcccgtagcttcttccatccatttagcatatctaaatgtaccctagtttacaacttcatgccttagtctactgaatacaagtaaattcatagttaggaattcagatgtattataggttaaaatctgttttcacagatggcttaaattacttcttcgcaaatatgattgctgccccatttcagtgggggagagaaatcctttcttgacttctccagttctattttgaaattctttttctactctttttttcaaaaaatgggtcattatttcatccaggatgattagatggccaaaggattttttaatgccattccctctcagacatctataagctagaatgtgtgaatcggggtagagggtgaggagtgcaaagcattctaggcagaaggaaaaacctgtgtaaaggccttggggcaagtaagaaattaacagttttgactgaaagacccctgtggttggagcctagtgaggggaagagtggtggagatgatgctggagaataagcaggtccatatagggaccatggtacagagttgctgagtcagttggtctttagtagagtgatatggtagctaggtgctgtgggctcagatgcacctgggctcaaatcacagcttatctgcttactagagtctctaaactctgtcccacaactctagaatgggagagtaatacctttttcagagatgggctaggtagaataaccaagtgcagtacctgaaatatactacaccactcaataaatggcaagctattatttttactttttataactcactgttccacaccctactcaggaatctcagacccactgctgcttcctttttattatttttaaaattcgtccagcaaatatttatcaagcacttacaattacatatcctaactatccctccctcctgtagttatctgtttgtatgtctctcatagcttcaaggttatgagatcctcaaggagtttcatattaaccttttgcaatccaggtaccaagcagtgtctgttttagaaaatgtttgaataaatgaataaaagaaagtttatgaaatacgtaattaccatattttagcgctgcaattgtttgaataatttttattttaaatcagtcttacataggaaaatgaatatatcgcttcctcattctttgtttcttttacagtacagttagcaaaaattcaaaatatgccctttataaattcataactctagaaaatgtttattttaaaatttacatattaaaataagtcactgataggtttatatcttctagatcaagtagctgttttaatatgatgttattttttaaaaactattcattttcaaatgtcaataagaaaaataaccagagaccgacataaacaccaaattataaaaagttgagcacttaaaaaaaatctttttaagacaattataaattaaccatgcagttttcagaaataatacagagaaatccccaacactgttcacccagttttccctaatggtaacatcttacataatcacagtgcagtatcacaacaagaaattgataatgataggccaggcatggaggctcatgcctgtaattctagcactttgggaggctgaggcaggtggatcacctgaggtcaggagttcaagaccagcctggtcaatatggtgaaaccccatctctactaaaaatacaaaaattagccgggcatggtggcgtgcacctgtagtcccagctacttgggaagctgaggcagaagaattgcctgaacccgggagccggaggttgcggcgagccgagatcccgccactgcactccagcctgggtgacagagtgagactccgtctcaaaagaaattggtaatgataaaattcacagactttattaatatttgtccagttttatatgcatttatttgtgtgtgtgtgtgtgtgcatgtgtgtatgtgtttagttctatgcagttttatcacaaatagattcctgtaccaactactacagccaagatacaggacagttccatcacaaggattctttgtgctacccttttataggcaaagtaacccttcctgtctccccttccagctggccattctccatctctataattttgtcatttcaagaatattgtataagtgggatcatatagtatgttaccttttaagcataattcccttgatataagtcgggagttgtttttttttttttccaaagatttgcaaaaagggtctaatacctttcccactggctacctgctgcttgttgccatttagcaaagaaggcaggaatgagcagtagaaaggcaaagggtgcttctgttgatggttttccctaaggaagactggcatgtgaagtagagtatcccaatactcattttattcttaagagattctcagaggagaagtgggaattctttttctgatcaacgtatttgtcttttggtagaaaacagcctttttaaagggcatggtccatctctgtaattatattttatatccaaagaccattctagtcagttccatcttccatcctccctctttctttcccgtcatttttttccatcctgaccaactaaaaacatattattttataaactaagttctatatgtaatttccccaaattgatactatctaacaaatagaaatggcagtttgactaaaaatggttctaacttgaaattacatgcattgaagagttcttgttgtatccattggccttacaggaaatcatcatggtagttctgcctcactaatagtcttgtctgatttgttttgtctcaaaagtaaatataaaaaatatataattcatttgaatgatctaaatgccatctcttaggaactttactacataatagctctcataccaagtcagagtccttattaccagttttcttttagacaggtatgtacacaaagtatataacattttaagctgtaaataagtcttatttttaacccattattgatgtgtcaaggatcccattaccctacaagcagaggtttttaaatgtattttatacttagacttagcttggcttcaaagaagtaaaaaggcctttcactaataaatatttaagtaataagtacttaatattttaaaggaacaagctcacatttatagaaattgtcatacatttactgagaggagctacaattaacattatttatctgaataagccctggaagattcttattatagcataggaacaattaactaataaccagcccggtatccagttatctgcgtgattgctttcaagatttcttctaaaggaaattatgggaatccagtgtttttctccatctttcttacagtcctaaggtatacttgacaagcatactgaggcagattcatggctctagtctagtagcaagcttgtctcatagatataagcataggcccaattaagaccaatctgttaattgtctatatctattaacctagtccgtttgaaaagtagacccaaatgtatacgttaatacggtaacttagaattaattttacttttcaaaatacctgactaaatgatagcatttatgttaactctggcatgttgctgacagtaaagatccagagcccaaaacaaattaaagattgaggtgttcacgcatttgaactatctgcatgaccacagcactaccaagaaacaattattatccattcctgttctacatactatgccactcattcaatacaatgccagaatgctgaagcctaggtttgaatcagctctgacctttctagtctgcactttcagttgcatcttaaaactgaaaaaacagaaatattagtcaacagttactggctgagcacctactactatgtgccaaacactgatccaggcactggatgtttcaggcaagagttactttactcagcagtgcagtgctgtgggtttattgttgctcttttcaattttggacataagcttctttcctgaagcagttttgctataagacttgataaatttttagacttatgtatttacacagttactgttgcagttgtcattttctcccccttccccacccagaagggtgattaggtttcctctgagtagaagattttaaaatcttaacctgctttttgttctcattttatacttccaaactactttcaaactctactgtgagttaacaaactcaaatgttttctggaactaggcagtttcctgagtgtctgaagcaggccagggggagtaaggagggagtagtagggtctgtgtcaaaccgaagattcatacccacctataaacattaaaataatattttttaaatttggttcaaacatatttagaggctatgagtttccaacattctgaacatctagataaatatgaactctttagaccattgatttttgaaatatgaaagtgtaatatcagtttattggcaactgtgatgtgtgttagttttaaattaggaaatgctgagaattttgtggcaggaacccagttaaatttatggagtacagtatgtgtgtcttgttttgtcttgttttggtttggtttggttttcctctcacaagcttttaagcttgtgagtggaaaaaaagagattgggaatgttcaaagataattgaacattatctagaacatctagaacaaggacatctagaacagaaggtcttaggttcaatgaatagtcttcaaaggatccatgaatatcttataactttatttttaaatgttgtatttctatatttctgtgcttaatgttttctataaaaagtaggctttgttgatttatgtttattttatttttttttttagagatggggtctcattctgtcacccaggctggagtgcaatggcatgatcattgcactgtatccccacagcctcgaactctgggtgcaagtaatcctcctgcctcagcctccagagtagctagtactataggcatgtgccaccacacctggcttttttttttttttttttttttaattttttgtagagacagggtcgcaatttgttgcctaggctggtctcaaactcctggcctcaagctgtcctcctgcttcagtctcccaaagtgctgagattacagccgtgagctactgcacctggccaacttcattttttagagcagttctaggttcacagcaaaattgagaaggtggcagagatttcccatttacatttttcccccatgcatgcacggcctcccctattatcagcgttcccccaccagagcggtatttattacaattgatatgcttatttgtctacttaagaaaatcatttatatttctttgaaagcccataccgatacagtacttgatagcgttaactttttaaaatattaatagtttattaggaatatcctgaaatgattgagtactctttgaattaaatgttactctattttaaaagtaatacagacttaatgtgaaaattagaaaatgcaggaatacatgaagaaactaaagatgaaataaggactgttatatttggtacatatccttcaagactttagtttgtacatatatatgtgtgagatatacacatccatgctattgaaatataaccagagttctgctttgtattttagggttttaaactgtcagaagcactatttatttatttatttattttgaggcagagttttgctcttgttgcccaggctggagtgcagtagtgtgatctcggctcactgcaacctctgcctctggggttcaagtgattctcctgcctcagcctcccaagtagccgggactacaagcgcgcatcaccatgctctgctaatattttgtatttttattagagaccgggtttcaccaggttggccaggctggtctcgaactcctgacctcaggtgatccacttgactcagcctcgcaaagtgctgggattacaggcgtgagccaccgcgcctggctagcacttttatttaattcaaagttataaacttataaactgctgtaccagagaggcaagaaaccaagttgctgtaataaaacattttggcagcaagagagtcctgatctctttatatggaatgacaggaaaacaaagtagaaaaatttgtcactgaagatagaaaatataggataggtaggataggtaaatgtagtcttagttataccttttctcaaccttattagtaaacaggttacttgtttagcaacccatgaatattctatatttcgtagcctgttatagcacagcaaaggaatttataacgaaacttgaataaacaagatgtttttagatccaagtaatttagtttttagtttttgttgatttttttgtcaaccttctcaccaatcagtttctattttatcaaaagctgcttcccgttttaaagggagcctcacatttcttatttgctatatatatatatataacttattatatatatatacacacacacacacacacatatatatatatatatatatatttttttttttttttttttgagacagagtctcgctctgtcgcccaggctggagtgcagtggcacaatcttggctcactgcaagctccacctcccaggttcacgccattctcctgcctcagcctcccgagtagctgggactacaggtgcccgccaccatgcctggctaattttttgtgtttttagtagagacggggtttcactgtgttagccaggatggtctcgatctcctgaccttgtgatcctcccgccttggcctcccaaagtgctgggattacaggcgtgagccaccgcgcctggtttatatttttctttgtgtgtattattcaacttaggctgccacagcaaaatacagtagacaggcaaaataccattgccttcttgctctccccacctggagggcaggaagagaagagggagagagcataggagccgagctctttctcttcttataaggccgctgtggtacagacgaggacctcacccttacgatctcactttaactttaattaccctatcctccagacacagtcactttgggaggtaaaacttcaatacagattttggggagatgcgagtcagtccatagcaaataggcatgtgttctgttgttcccacaatactgttttatacctggctgctttctctcacttaatatattgtggctatctgttcgtgtcagatcatacaggtctttatctcatgtcgtttaacagctgcatggatttccatggtaaggatatactatcatttattttcccatttccatattgatagacatcagggaaaatcaaaagtaggctttggtgtcacctttacagatcctaaagactaaatctatttcctttcatcatttttaaatattataatttgagtaaaagcccaatggaaattaattttaagcttaaaaaattttaagaagtattaagttcacataatttgcataactcttaattagaaagcttgaatttaattatattttttctagttaaacacaagtggctgaactactaggggcagaatttcttgggcattaatgactgaagaaccttaaatattccgtataagttcatagggtaatatgtatttgttattcatacattaagagaaaaccatgagtagtaatgtatctgtgaggactgaaattcatattgtgttgcatagatgttaggttccttgcttgaagaattgctcattactgatttgctataggaaataaacaaggtggtactttcgtagagtgtaatcattcttgcagactacttcttgaacttattcaagtggaactcaaagtttttggatcacttctttacagcaacatgttatcagatctcttcctgtattcagctatttggtataattccattctaattagaaaaagcagcaagaaattcttattgggcatattgaaagggtttttcacctggaatgtagattattttcttttatcttctaaaaaacttttaattgaaatatgtagatagaatacaggttctaatatgaaatctacttccactccatctaatgtgaaattcatttgcattacattgaatccagaaatgtgtacatgcatttttataggggagatattttataactttcaacaaaattttcaaataataaattatcaaattggtgaggtgctgggagtgacattggccatggtggtagtaaacatagtaaatcagtgactgctgtaataggcaccaatttattcattgtagactctgacatcttaaagattttctggtatttttaataagaaaaaaaattagtaactaaaaaggagagcttgggtaacctgggacctggcacaattcaaactggtgcaatgaggttctctgttctttatatataaagaaactaggctagatggccttaccagggcacagctctggactggacccaacttttagtaggatcttacttactcttttaacaaaggccaggagtaatagaaacaacacttgtatttctatgacttacagggaaatacatagatatggtgttttttaaaaataatattaaattaattacaacagataaaaattaaacatttgggaaatacattaacaatggtataagcaaatatatattgacttggaaatgtgaagccagtagatctcaaacactttaattctgttatcccccttagggttatcactgaggttgaatttatatcctttgtcccatgtgtcctaccttactccccctaaaaaatatatggtcatgcagttggggctaaaagagctactattattgattccttctttaaccatgataaagttctttaaaattaaagtttcttggctgggcacagtggctcacacctgtaatcccagcagtttgagaggctaaggtgggcggatcacttgaggtcaggagttcaagaccagcctggccaacatagtgaaacctcatctctactaaaaacacaaaaattagctgggcgtggtggtgagcacctgtaatcccagctacttgggaggctgaggcaggagaatggattgagcttgggaggccgaggttgcagtgagccaagattgtaccactacactccagcctgggtgacagagcagagactctgtctcaaaaaaacatacatagtttattgttaattcgtctaggttttaataattttcataggaaaaaaacttgtatatagtttattttcttttaattatattttttaagaagtagaatatcaactaaattttttttctgtttagtgacgagacctgcagtgtcaacatttttattaatttttgggtaaaaatgtatattctataataatagtgataacttgcaaaagttcaattctgaacattgttggagtgattaaatttaaaagtgtaatgaattttggttttcctttgttcatttattatggcaaatatgtctgacacacacacacaccctttaaataataggaaataaaatcaaatatcaaattcccattctttttaaaaaagttttatagaatttaaataaaaaccacaatatggcattggtaataatttaggatgtgattgaaatgaaaagcctttgagtcttcttttttacttaaaaaatttttagatttatgttaaaagaatcattgtcttctttcagataaatttgcgcctcattttggtaagcggaaaaacaaaagagttcctgttttctcctaacgattctgcttctgacattgcaaagcatgtatatgacaattggccaatgggtgagtgatatttttctcttgagtatgaataatgttgattctttatgccctaccttgtctcacaaacattttgaaactgttatataacatttaaaagaacaaccgaaaattgagagtataaggctcagatttagaggatcattgtacccttccttatcttgctcttcagcagtctcattcccaaatggtaaaggagcccagaatgcaatggctctgcttctgtcttagaactgttttaacgtaagtgaaaaaaaatttttttttttttttttttttttttttttttgagatggagtctcgctatgtcgccaggctggagtgcagtggcgtgatcttagctcaccgcaacctctgcctcccgggctcaagtgattcccctacctcagcctcccgagtagctgggacttcaggcacgtgccaccacacccagctaatttttgtatttttggtagaaacagggtttcaccatgtcggccaggatggtctcgatctcttgaccttgtgatccacccacctcggcctcccaaagtgttaggattacaggcgtgagccaccgtgcctagccaaaaaatatttttaataaagaaaaatgcagccagggatggtggctcatacctgtaatcccagcactttgggagaccaaagcaggaggattgcttgaagctaggagtgtgagaccagcctgtgcaacatagcaagatgtcatcactgctaaaaatttaaaaattagccaggcatggtagcacatgcctgtagtcccagctacttgggaggctgaggcaggaggatcacttgaggccaggaatttgaggctgccatgagcaattatcacaccactacattcctgcctgagcaacagagcaagaccctgtctcaaaaaaaaaaaaaaaaaagaaagaaaagaaaaaaaagaaaaaaaaacacaaaatagtgaatatacacacaccttcatatcagtaaacctatttttaccaaaacacaaagaggaaagaacaactatttttaacagataatacattctctgtggtcttctctagatagcctatttaaaattaagtttgaaacaaagttaacttctaattcatgtcagttcttatgttctctgaactactataaggtcaagataattaatgtctgtctgtgctttccattttcaagccagtaaccataacaatcttggaaaatgtgtttggtatttcttattttctttgattttttttttatataataagaccgtcagctgggcgtggtggctcacgtctataatcccaggtctttgggaggctgagacaggcagatcacttgaggtcaaggagttcaagaccaacctggccaacatggtgaaaccccgtctctactaaaaatacaaaatttagctgggcatggtggtgcacccctgtaatccaagctactcaggaggctgaggcaggagaatctcttgaacccgagaggcagagcttgcagtgagctgacattatgcgtctgtactcccgcctgggtgacagagcaagactctgtctcaaaaaaaaaattgcctccctcaagtgaattgttggtttattttcttcctttgaacttccccagtgtcatcttgatccttatgtcatgtatcatagtgatatgatttttttcagctgatttcacttaattttattagcagtagcaatttgaacttttaaaggacaagacttattttgacaaagaacatagtatatgtacaaaatgagtcaattagattagtgtttctcaaccttaaataatatacggagcttttctagaggaagataattcttgtagatctctagttgctgacttaaattatttttattataatgcgtattttaaaatgtagaaacttaaacccagttaaaactctttattcttcttaactcatatacacaatcataaaactaaaaaagattgattcagaaaatgcaaatataactctgaaaccaataatgttcaagttaacaacattaatgtgctagatgatgtatttttgccaaagccagctcactgcttacagcatgaatactgttgagtttgtcatgcctatgttcctacatagtgtttgatgaccaggttgtctgtagagtcaccataaaacctttatttatacagtataacaaattgttactcagttttctcataggtagaatgcatcatttacttgttaagtgaacccctgttctgatctcattagcctcctaacaattaaagaagtactgactgcttggcaccagtacagtcataaatttaatgcacacgtgagtactaaaaccccaaggctgcacttgggttataaagtcactatttaaatcatctagacaatctcctccagatttcattaaaatgaaaatacagattttccagattttcattaaaaaaaaaaatacaatttaaaacttcttgaagaggacttttagaccctaaggacatgtcttggtggattcataggcctaaatttaagaaatactgatttatacaaatactttcaactactggatctttcttcacattagtaaccaagcggctagtttctaagtcagggagatactgaagctataaaggttatagctaagaaagaatttcagaaaagctaaagaaatttgggatctaagaatattggctattctttatagccaggcaggaatagataactatcagtatgaaaagcatttttaaatacccaagaatgatgttgttctaagtgtgatacaaaaagattacctttatgagattttttttggggggagcggtcatagtaagtaatagcttttgatatatggatattatagaaaacataacacaaggcagaaaaagggtaatcactctgaaatttatttgggcagtattgtaacttaaggtaaaagaaatacttttactttcataattacttacttagatattaaaattagtttaaattcaagtataagtctttgccataaatagtatcccaaatgaacagaccatctaccagtactgaatattgattgtatcagtggatgttcccttattttcaaaaaaaagattttgattcccagtatttcctcaggttgccaaatctactcagcagttttagacactgcaaggaataaagagaaatactttaatttttattttacataaaatacttaaattaaaaatctaagtctatattgtatcacataatgtactaaagatcagcaaattaaatacttattgatgttaataacaaatgtgtggcaaatattaatagcagaaaatacttcgtgcaacatacttgttgaaggaattagttttccttagcatacccttctgctatttagtggaaatattactaacaggtggaatagtcagacacatagctattattgggtcaaaggttcaaaaaaatcttgttatacttaggatatgttaataacacctgaaattcttcatttaagctatattctaagatttctctaaattttagatccctggagaggggaagggagatagcatattacaccagtgaagtacgtggaaatcatgacactctgtataagataatgaaacatggggcttcaggtttctgcatctcaaaaaaaaaattcaagtatttttagaatatcagtctttgtttcctgtgaattaaacaattactgtcatttacctttgtatctatggagcacttccatcttgaccagaaatattctattaaacaataattttggaattgatgaattcaaagcaattcatactatagtgttagagacttatttgatctttcttctagaataggagggacctgggaacaatgggatcagaaggcaacaaagccttacaggagacagaagagggaagagactaaaggcatggagcgggggcaggaaatgacggattcatttctcctctgctcatttctgctgtgcctaagttacctagaggcagtggttttatcaaattcacattcatcattttgaatagtcaaaaaaagggcaaaagaaaagtctctagttacttcctttatcttctgtcactctttcagaatactttaaactatttttttgtgttaaccattatctctttctataggaaacaaacacattagaattgttgacaaaaaagacaaaggaattctcagatcattactaaactcaaagcttaaattgttacatctgcaagctcatgaaaattactaaacctttaccctatcataacactagtgtccttaaacctttattttaatggagtggtttccatcttttacaataatataaattataggctgaagttaaatattctgttacccattctgcctaccagtttgtcttattttctttgtgtgtacacttttctagctttcatgtttgtacagtacctccaaatatatataatttttttggtttcttccaagtcttcattttgggtgaggtgaactaaagttgtatcttctctaatgtttactaactgacttcagatagacaataagataatatatcaacattatccaaaagtaaacagtttttttgttattctcaatatcaatatattaactgttttttagatctttgttaagcctgctgttttctagccttaaatgtacattttaacaggtacaaatattggagcattataatactatgtgttaattactggtaattgaaattaattttaaaatgatatttctttttactcagtaggtctttcccaactcatttgtattaactttaaacttggggactacaatttggtacattttagtattctttaagaagcaaaacgagtctttttgcagctcttgctacttaaaagaataagtaataaccaaggttgcggtaaatgtatgaatagtgactgtttctaatagtagtaggaagctccaagggccttctttgtactctaactgatttggatctgaatttttaaaacaatatagtagtaccttaattatatgttggaatatacctaaccagtacactggattcttttcagactgggaagaagagcaggtcagcagtccaaatattctacgacttatttatcaaggacgatttctacatggaaatgtcacattaggaggtaacagccacctttgtaatgggatttaatgtctgtctcatggtagcatgattcgcttgttttaaatgttaatgtctttgaatttgctaaaaaaaatgataaattcaaactatgaattctgcctatttctggtatgcctactccttcacattgtatattctgttaaatttagttttaggactgtagtaagtatttactaccttgtgaaataaactctatcccagtataggtaggattctatacctactattttttaaatgtaacgttattatatttccaaataatatataattcagatgtagtattttaaacttaagactggacacacaaactaggaaaaatttatgatagttttcaaatatatgaagggatgttttcagatgtttctacctgatacagttgctaatcatgtgagaataaagtaggtggctgacattagagcagcattttagcataatagttgaaagaacagattttggaactagactatttaagttatatgttagctgcactacttactggctgtgtaaaccttgggcaagtgacttaaccaacctgtgttccagtttcctcatcagtaaaatggaattacagtagtgcctacctcataggttaagaagggtaaattactttatatattcaaagtgcttacgtgcataaatggtgcttggcacatagtaaacaccttaattgttagctattattgttctttatatatgattggagaaatgtagctcaatattgcccccttatggggtatattttctaccatcaacaggatttgatggtagttttgaaaataggtatttcaaatatattcagataattggaaacgtataggcaaatgaaatggtctatctaaatatatatttcactgaatatagtctgagtttttcctctaaacctaatatttaatctatttttccttaaaggtagaatatttgcattcattcattcagcatgtatttattaaattcttatgggccaacactgtgctaagcacttgggaatacaggattgaataagacagaagctctcccttcaggttgctctagtattacataggacaaacagataaaatgcactggtaaaaatcctgggcaataagggctaaagtagatgaatgcaaatgattttatgacaatgtcaagtgagtaaaacatttcaggctataatctcacactgagtttcactggtagtattataactggtctaaaaaatgctgctatctactaagagatatctggcactttaaaatggagcttttttgatttgtagctttttttttatagcttttgtataaatagatggaccaactcttaatgctcttcatgtaagaattgactgttagctccctggctatattgtacattcattaaggatgggaccatgttctagtctttttaaaattctccatggctcatacaagatcttatgtgaattaaaaattggtaaatgttggttgaatttaatctatcgattatatgagtgaaccttgaaatgctccatttcccttttgagtattgatctatgtgagcaatttcccaccaactccattccttaattatcttttctgttgtgacctcagagtttgaacttcatattaaagctcatagaatttgtgttaaaatcaaaactattgatttattcccactaaagtataattttttaccagtatttttttgaaatctgttttagaataatgaacagattgacttatgtaattattattgtaattctgtgttgctgtccttcttttcaaaaacaataaactatctctagtgtagaagcatggcctggacctccgcgttaataattgtagctggatgtttgagcaagtttggataacaacattcaactatttgtcttttgggtctcagtttttctttttagcctccctgtgttcttcaatgtgaataataaagaagatagcacacagggaaatacaaccatctttaaatatttgcgtggcctgtgtggaagaaggctttgtgtggccctagaacttgctctgtatagccctgtgaattagacttaggatcagtaactgaaaatcaaagacagttttctcttcaatataggaaagaatatgtgaacatgttgagctacctaaagaaagaatagactgccagggaaagttagtgagatcttgttataggtagtggtcaagcagtggatgaccacgaagtagtgggtatacagccatgggtggaattcagccattatgcagacaaagtaggaagcctgggcattctctgccattcttgaaattttctgcttaagtttcaggttgaaatgtttggttatcaaatgtcttaaaacatagccctgaatcccccctttttaaaatagaacctttatagccatatagagtttcatttcattaaaggaaaggtgtgacagcagccttgttaatcggagggtgaagaagatgatcagctaaagctttggcattcagtatggcccagattagcatttccaaaaatgtggctctgaaatagtgggcatgagactcatctaggatacttattttaaaatgcagatttctgcatgccctctctccccaacccccatctcctaattttactagtgaattgaattcctgggtgatttttatgtacgctaaaggttgaaaacctctattctggatattgtactgtgtcataggagagagcagaagcatccacagtgaaaggaagaaaacgcattttagattctggtattcctcttctttcacatttttaaatgttattaacatcaatacctactatttctagttaaaattcagatggagaagaaaaataatagctcccacgcattacatttgtaacttcaaatggtaagcctctcaggagctttccaggcctgtcttgacattttttacatatgtatctcagtttacctaccttttttctcagattcattttccttgctatctcaaaatgatgatggtagtatatactgaatgctttctttgtaccaagttctgtgcaaagcactttgcttggattgtttgatttaatggacacagctacaaagggcaggtaatggaattagtatctccagtttagttgaggaaacagaagcttagagggtaagtaacttgctgagagttacacagttggaagtagcagagatgaaaatttgtaatccaggtctgtcttattagagtcaagaagacgggtatgagaatgatatacagcttggtatgtgtacattttaagttcagttcaaggtttgaaatgttgatcaggctttcccaactatttagtgaaaattttaataacataaagtcttacttacattttgatttaagtcaggcctaggaagttattctaaaagcctcccttttttcattatgtatttatgggccatcgtgcttcatttgaacatcagaggttaaaagtgtagaccaaataatggctggccaactttaaatgagattggaactcaccttgaatatatgaaatagtactagtgttgaagataattaggattctttttaaaatctgcatgttaaccatcatcctatagagcaggttttaaaaagcaggtagctggagtggaggatcattattgctaagtgatgatcttaggccttacttcagtttgtagtttttgaagagagggtagtttgaggtgtcagaactaaaacataacaactatagaaacagttctagaagctaaatataccagctgcttctaattttatacacagagtaacaaagggatttaccatgaaactcagtatttgtatttgccttagtggacatgggtgtgtgttctatgtctgaaatatttcatgataaaatttattaaatttatgagtgaaaaaatgttataaagacttgattaggaaacagtgattattgataatgccaagaaagtgattattttaacctaatctttttaagaaagttcttttctaatggacgaatacagggtgagaataaatgtttaaaatcaagtttatttcttgcatttctacatcatagtagcctgttcagtgcagtaattttattaggcaatagacaagtaattagatttagaaatgaatatctcttaatctaaacttttacctaatatagaaaagagtattcttttaaaaaaaatttaatcctttctcctctaaaggtggcctctgatattagccaattacatattttttcttatatcatctcttaatatggataaatgtgtcaagcaaatggctatataactgcaaaaaataatttctaaattttaaatgttatttctgataatattaacctaattttgtgaaggtactctgagttaagttgaatctgttaaagaagtcataaaaaagcaatcaatttttaaaatggttttaaatctggatagtgattttaataggtcgatatatgtgtaactaatcatcttttgcttttcacatagcattaaaacttccttttggcaaaacaacagtgatgcatttggtggccagagagacattaccagagccaaactctcaaggtaagccatgcactggaaaagtatctcagttgaggcacaaagacaggcattcaaaaatgctaggtttttcttggatatgctgagggaagggaagtttgcatagtttatgaatagagattgtcaagcaaataaccagacatttttgaaacatgctaaaattaaaagaacatttattacagcttcttaattttgaaaaatgcaaacatttttaaaaactcaaaactactacttcctacacttgattgcctagcccattttcccctccagttctagaatttttataaacgaggctcttcttcgttttccctaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcactaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcggaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaatattccatataaataagtttagcctttataaaaatgaagttgcaggctgacattacattctgtacttactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataattctggtgtatttgcctattctttatttcactactgtttatgtctttttttctttcttcagttaatgatactcttcagtaaaaatcaacattgagccagcctttgctatagtttagcaaaatcaaagggaagtatcagccaaaatttaatatgccttcataccgtttttatttgtaactttttcgagcattccagtttgttttccatttttgtgttataatatggtcacttgttagccaaatggagtgattggggtggagtgattggggtgggggagaaggcacatgacctataattacaaacacagctataattgaaacacagctgcaggctgtgctggagtctaggcacagtttttgtggccagggtagggtggggttcttgggtgtgagcagtggtagttgggtgtgactcctggcttaccctgaccccctgccagttggtgtgtttccttcagaaggcagtggcttctatgaggcttttacacaggaggtggttgacttctgaaagagatcatggatagaactaaatgagaaacacttagttcttaaatatcagagtttaaagcagtactgaaatgtgaaaaccaatttcacttactacattattttatagtcttcgacagtgatgtcagatgtttgtcttttaatatttttcatattcctctttttcaaaatgacagctttcaagaaatatggagtaggcatagtaaattcccatttggggaaaggaaatgcccatctctttcacgtgagtcaaccaataaaaaaggagttgggtaaacacattttctaaaatggctctggaagtggtttgttgttagaagtcttagaagagtctggctggttttagaatgtagtaattacacattcaaacattatttggtatcttttattttctacacatgttcttgaagcttatttgatgtaagggaagtcttacaatgaagtgggagaaactttgctatagttaaataatacaaggaggcagcagaacctggaggggaaccgggacaagccgcagcagagtgggaccctcagaattcttgtaggaacatacaggaagacatctgggagttggccagttctcagttgtctgccagacgagatagtttttcttcttccctgcatgctggaacctgtttccccttatgtccttccttaccacatggttttccgtgggcatcactcacctgggttccattagggtgccactcccccagtgtttctcaggagcatttttttttaagtctgataattttaacacatctacattttgactgatgctgttcttcagtcctcagagttcagaaaaccacaagaatagctgggctttggagtcaagcctgactttgttctgggtgattttgaagaagttacttaatatctgagcttcagttttttcatttataaaaattaacacatagtttagagggttgtaaggtttattttaaaataaatatttagagcactgatttgtctgagaactcatgcaagctagcaaacctgtcagaaggccttatgttggaaataaagtgctgggcatcaacgtatactctaaactttatggaagtagcttatgaaaaggccagagaaaatgtggatgatgctgtgttcatttaaaaggaagatgagtggggacatctcaaaaataagctctggaatagaaggaaaataggggacccagtaatgacacagcttcagatgtgtatatgcgaggtaccaggtcatacatagagcttagacatgttaacataaggacataaacataactgtcaaaatctgagatgctatttgttactagggtacaaaaatacactgttcaaaagaaatgggtctaataaaggtgggaaactatatcaagaatacacaaagggaacttagacctgagagggaaagtaaatgaggagtatgtgaataatgaaaaaagacaaaaatatgattgtcaggttatattgtactttttc

SEQ ID NO: 15573 - DNA, 10396 bp, Human
cttctcccatggaacacttctgagaaacacccctccagctttgacatgtatgggaaaaaaggcactggggttattgagcccttactgtgtgtcactttgtgtggatggctttgcagagttttcccccagctcccctcggaggaaactgaggccagagagaggccctggttaacaaatgtgttttgttccaaatcctggactcagactactattctttactatctcctttggtcctaactgttgagagggggaggattggagacgactagaacatgcaaggcctgtggtttagggctgtcgtctgcaagcagaagtttgtggctctggtttccaggaggctacaggacacccacatggcacagcttcctgacaaaatggcagctaatcaaatctgcctacctttccacccccacactgacgtttgcctccaccggaactccttttctgtaagaactgatggcccccacagccttcacaagtacccacagtctcactccatatcttcctcccttgaacagaaactgagagtaacccgcttataaggaagtccggcaaatccttttccctcttcatactcattttcctcacctggaaatgagagggggtggagagggactcaagttgggccagatcagcatttttcaaactgagtttcagcagagctcatatttctctcccctctccaccctgagccccgtgttttacataatggaattagaagaaagattttaattggctggtgttccctggtgaagaaagctgaaagccatgggactaaaaactctgaggatacctctagtgctgagattcaaggattctaatatttggccattgtcttagaaggcaaaggcttccactagctgattacaactcagccaggatctccttagctgggtaacactgacagtgtttgcagaactgcttgtgctagctgagggcttacctggggaccagagggggccttcacttccctgagagggtgaactaactgatagatctgttgggccctcatctttccaaacagtcattaagcctggtgtgggcgtctgaactcaccatccagctcccactgtaccctcctttcttggagattgggaggaagcaccgtgtcctggaatgtccagggctttggaatccagctagactcaggtttgaatcccagctctgccaacttactagctttgtgaccaccagtaaattacttctctaagtctagtttccctaactttccttcctgtaaaatggacctaattgtccctgtcacacagaggactgttgtgacaatgaaatgagatgatgtagaaaaagcccttgatgccaccctgaacacaaggtggagcaagcaccctctgaaaaggcatctgacaggcactgcatggtcactgcttttacctgcagtctttcctgtaaggctgtgaactcaccaaggtcagagacattaacctacttccataatgcttggcacacaaactgggctcagcaaatgtatagtgaatgagtaggcagatgtggagtacagtgaagacagctgcctctgggcccctccacgataaacactgtgggatctgtctagactgaacaggacaaagaggactccaggcttccatcacacgggagcctgttctggagctgcagcagaatggctagggtcccgggggggtaagaagaggcagttgcacttggaaggcatggaggggacatccccacatagtctgaggacactgtcacatcccgagccagttggtccagtgaggatggacactcccacacctctattctcatatggagcatggccagctcaattatagctctgctgctgaccctcttgggcaagtctcagctctttatggcctcagttggccctgatgacttctgatggcccttccagcacttccagtgaccccatttttctgggctcccagaggaggtgctggagagcattaaggaccgtaacttccactgccctgtgcccctatgatgcagattcctttctctttcagatgcatttcatcttctcagatacagcggtgcttctgtttgatttctggagtgtccacagtcctgctggtaagaattggggacctcagacttgtagcttggaaagccttgtagtactaggcaagggagaatctgggttctcttgattctctgtgggcatttaagtgaggctgattcctctggcataaacactgagcaggaacttcacagttataattccatttgtaaccactccccttcagatcgcaaagggctccattatcttactgatcctcacaaaggccgagaggcagggaggcagcttttccctctgttacagggcaagaaactaaagcccagagacaggaagagagactcgtgcagggtcacacagtaagtacgcatcagagccactactagatcaaggcctccgggtgtcacctggcacctcccttatccagggctcattgttctgcaccagttcagaagcccacagcagctgctggagatgagacaccaatttgaaaggaaagaatattcctttgatttgaaaaggcagagtttgtcactaattcatgaagaagttatttttcaacttaaataactgcatcttaaaaagagactggaaacagcccaaatgcccattattgcgggtgcagattaaataaattatggtcagccctacaatgggttactatttcttgttatctattgctgaataaacagtggcttaaaacaagtcattttatcattctctctcaaggttctgtgagttgactggacccaggtgagtggtccttactgaaggtctctcatgcagtatagtcaaacagtggctggaagtagggtcatttggaagagttcctcactctcatgccaagtggctgatactggttgttagctaggacctcagctggagttgttggctggacacctacatgtggcatctcctatggcctgggcttcctcgtggcagagtggctagattccaagatcgagtgtcgcaagagaacaaggtagaagtacgtgggattttcaagacctagccttggaaatcagatagcattacttctacctttattggctgaagcagtcacgaaggtcttcctaggctaaaggagagggaacaaacatggaccccaccacttgatggcaggagtgttgacatcataagaaggggatgtggggtgggatacattggagtggctgtctttggaaaatgtaatctatcacagatacgatgaagccactggggaaaaggtaaatctgtgtgaactgaggtaaaactggatgataaagtcaaatgcaaaacagtatgcgtagataggatgctgtcatttggacaaacagaggctgatatatacattgagtaacagaggttgctctggggaggagaattggggtgaagagagattggggtgggaagaaaactgatctttctctttttttgaaatggagtctctgtcgcccaggctggaatgcagtggcgcgatcttggctcactgcaatctccacctcccaggttcaagcaattctcttgcctcagcctaccgagtagctgggactacaggcaggcaccacaatgcccagctaatttttctgtatttttagtagagacagggtttcaccacgttggccaggctggtctcaaactcctgacctcaagtgatccacccacctcgacctcccaaagtgctgggattacaggcatgagctaccacacccggcctgaattttcattgtattcttttttgcactgtttgaagtttcaccatgtacatgaaattacctataattttatgttttaaaaacctgcatctgtcagatgatttcctcctgggagcctgtgggaaaaaaaacccaactttttccttttcctacgctccacacacttctgtgaccagatgtgtaggctttccctcagtgacaacttttctgataccagctgggtgtcctacaactcagttcaaatctgacactaaccagagttagtgcagatcccacaagttaagggtacagtcccacaaggctgccccctgcttcaggcaccaattgcaagtcccagcttgtctcccgtacttctggccaactggctatatgtcagggttcccataacgcctttgttgggatcaattatttgatagaatggttcacaacactcaaggaaacacttaaaaagagtacaaatgggccaggtgtggtggctcatgcctgtaatcccagcactttgggaggccgaggcgagtggatcacctgaggttaggagttcaagaccagcctgaccaacatggtcaaaccccgtctctactaaaaatacaaaaaaattagccaggcgtggtggggggtgtctgtaatcccagctacttgggaggctgaggcaagataattgcttgaatcctgaggcaagataattgcttgaatccaggaggtggaggttgcagtgagccaagattgcgccactgcactccagcctgggcaacagagcgagactccatctaaaaaaaaaaagtacaatgaatagctgtgtggaaaagatgcatggggcaaggcatgtaggagggggttcagagcctccaggccctccctgggcttgccaccttccaggtacccccatgtgttcacagcagctggaagcttttcaaatcctgtccttttaaaaaaattattcatatataatagttgtacatgttttggggtacacgtgatattttgatacctatatacaatatgtaatgatccaatcagggtgactggggtgtttatcacctcaaacatttatctttgtgttgggaacattacaattctattttgaaatatacaataaattatggttaactataaatttccctactgtactgtcgaatacaacaacttattccttctatctaaactgcattcttttgggtttctatggagtcttcatatggaggaatgattgatgacctcattggccactggtgatcaattcaaccttcagtccctgtctccttccagaggtagggagtggggctgaaagtgccaacctccaagcacaagtttggctcccctggcaaccagcccccatccaggagcctcagccatcagtcatctcattagcatataaaaagacaccacttgacagcgtttccaagggttctagaagtcgtgtgccaggaaaccagggcagaaacaggatatatatctcttattatgtcgcagagtccagtaaaatactttagctggaccacttattatccctcttagtgaaacaaaagtagtaattaacagttaattttacacagcagctctaataagcacttgatagttttggtaaaataatttattgggtttttcccctattataaaagtaatatatataaaagaaaccttagaaagttaggcaagaacataaaaaccacctgtatcctactttgctgagataactattactcttgtgctatttatctttccttccagacattttttgcatacttacatataaataggaccttgcagtactcatcacttaacaagaagtcacgacagatttgtgcagcctgctgggggagtgggtggggtaatggtacgtggcttcttcaccctcagcccctggatttttcaggtggcttctcttcctgatctcaaagccacactccagctaagaaaagtctggtgaagacagtgaagaagttcggaactcagcaagggtggggaagaaggtgcaggatagaggtggatggagtggattccatgaacaggtggaggtgctggaagggaaacagtgctggcctggccaggtctccacaactctgcctcctttgacaggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtacaggcagtgggtatgggaaaggggcagaagcctcacattcaccctgagagacaggctggcccagacagcattagccccacttcacagagaggacagcgaggcccagggaaggaccaggacttgccaaagtggctacacatagccaagtgaactagagctcatgtctcctgatgcccaggccaaagcactctgtgaacagccagccacttgagaggctcagaaggctttctttagggaacagtgatcttcaggtgcaggcccctatctagcaaatgaggtggccacccaccctcccccaaatctcaccagttccatgggtcactaggctcccatatccaggaggggatctgcagctgtcctgaagcaatgtatcccacttggtgggaggaggatgacaagctctcctctcctcccttcccactcgaatcaggcaaccatttagggtccctgttctgccctctgtccagccccagcctcacctgtgcttaataagcctgcccgctccatcactagccaccctacatgggtgtctcagatcttcacaactgcactgcaagggaagtattctcattcctgttttactgataaggaatcttacgttcagagaggttaagacatttgtctaggccacttttagttagtggcaggtctaggaactgataatgtcacctaagaccatgctttttctttccattgtcatactgcctcccgaagtagattcaggggggaaatatgccttactgatgattttctcttattccttatcagaaagacagattatagataccctcattttcccctttgcctaggatgccaggaagcttgaaaccaaatgtagtgaagatatgtctctttaaaaataaatctcgagttttttctgggggcgggggtgggaggggcagaaagaaatcactcctgggttaagcatacaagttataaatcaatcgggtcacgtaactcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaatagtctatgactgttctgttctcctaattccaacagaaagcacatgaacccttgtaacaactgcaggggctgagtggggctaatagaactggtagtactctttataagcctgtctgaggacagagtccatccatctgctacaaagacaactctgctcagggaaacccagccctgaaatgctgcacccaggtagacaccccagaatgccaactgaggcaagtcaagtcattcttcattcatgtaacaagtattaattgagtacatgctataagaaaagtaactgtcacacggactttaagcacctgtgttggcacaattactcagcatcttctctccctgcgggcagaagcaaatataatagccactagttaatttacaataagaaataactgccctagaaagtagactatgtcacacctttaggactgatcagggcattcccccatgtttgcagggaactggaaagctgcctggtgtctcaagaagcctgtttctaaaagcatcaccgccccttcccccaaccagtgacagtcaggctgtgctggccaagagcccaggctctggaatcagatggccaggatttgaattcttgtgctgaggcttcctagatatgtaactttgggcaaattactttacctctctaagtctcagttttctcctctataaaatggtgataacactgtcttctgcagtggttgctggagataagccagtctgtgaaagtgccaaacagcaccgccttttgttaagcaacaaagaaataattagttctcactgcctcccaggtccgcacacgggagacatatccaaagcctgcaaggatgatgccaggccagatgaagtggaattttgggtcctatcttttaaaacatttaaaatcaagaaacattttttattaaaattaattattctgtttttttaaagactgattgcataatctttggaagatcctggaatcaagaaaatgaccacaagtattttctcactactgttctctgcataagtcctggtcccatgagttctaagggaatggaagctgctctcaaagtgaagaatccctcaggtgccatgaacaatggaaagaagggaccctctcaccttctttgcatggcttcctagactgcaggactaagcctgcaggagcaagaggatgactggactggtcctcacagaaccatcatgccccagggatgagctaggactacagtggtgactttctttgaaagcctaaaagttccagggttaggtatcaaagggagtaaatatgccacaacgttttgtgcacattaactgacccagatctgtaagactcctacccttagattcccaaaagagcacagacagcccttggaaccaaactcaatttttctccaagggcttgggtcaagtttcattatagacatttattttagttttattttcaaagtcattgacctcttgtatcagatttaaggcaaagaagaagatacatgtcccaggactataggccaggctgttgactgcactgggatttagatggtgtaatctcccttagttctaccagggagacctcagcccaggtcttgttgccggggcacagttgagcactggattcaggtagaggagggctcccaggtcagtctgagagttaatgaagagattaaaaagtctggcagaggacaggactcttacaggtgactggcttggaggggaacctaccagtccttcttccaacttgctgctgaaatcccagtgttcttgaagacagggttatgatcctcttcaccaggtctggcgggggtggggctcagaaggtggccaacccaccctctgagcccaaatattgttcccagaatgctcaccttgacctcaccctgtggctcgcctagacccagggttggctgtgcaaaatcatgcttagggaagggttgcagagaaacctttgcaccagtttcctgggtcttcatcccagccagtcaatgtcatcgtcatcatcatcatctccaaaaa

SEQ ID NO: 15574 - DNA, 17488 bp, Human
caaagtgctaggattacaggtgtgagccaccacacccagcctaatctccctttcaatcctccccatctccccagtggaaatcactattctgagtcctaacaacacagcttaattttgcttgattgtgtagttaatataaatgaaatcatattatatactcttttgtgtctcacttcttttactcaacaatatgtttaagatttattcatattattgcattcacaatactgaaagattaaggtaaaatgtttcaaaaggtggaggctggggggagagtgggaacaggtctttcagtcaagaagaagaaaagacatgggggaaataagctacaccaaacagcaacattttaaaatttcccgttctatttgggttcttagatggttctaattatttttagttaccaataacctcagggaaggaatgagtgtcaggaaagaaatgtcgggcagggaatctaggaaaaaacaaataataattgcccctatggagtgtggttattagcaggcattgcagagagagcccagtgtaacatggggcaaattatttaatctagctggcaattgttttcccaatccgtaaagtgagaatagtaacatcgttgctgtcaagattagataaatgaatgtaaaatgcatggtactgtccctgactctttaatgcacagcaaacattatttgctttctatccccttccttgttgaatacagatcagaactccagtagctggaaactaagcagtgtcatatttccctagccttacgccgctaggccccttaaatttaaaatataaagtatacaacaggtttggggtacagattttgagaaatttaaaaaaaaatttttttttgagacagagtctccctctgtcacccaggctggaatgcagtggcatgatctcagcccattacaacctccgcctcccgggttcaagcgattctcctgcctcagcctcccgagtagctgggattacaggagcccgccaccacgcccggctaattttttgtatttttagtagagacagggtttcaccatgttggtcaggctggtcttgaactcctgacctcaagagatccgcccgccttggcctcccaaagtgctgggattacaggcgtgagccaccgaaccgggctgagaaataaaatctgagaataagtgtaatgtaacccactagtgtcctctacatttgaaagtcaacttttcaataatccctgaagaaccacctgaaaggcattgcttcgctagggcgatgatgcccgatcgccattttactcatccaatcctactggtttacccaggccccataagcctcaccagatccctcttgcctctgcacatctccaatctccataaagacctttgatcggatctatcattgtacctatcataggtctgatgcccctatcaagacttggagttttcctaaacgcccatgtctttcacatcacatctctcaactcatagcattgccgtaccctgagaaataaatgaagctggtacaaattttctctgaaaacttggaagcctggcgctgaactcaacaactttagcttagtccgcaaaaatggacttagctaatactgtgttaggcataatggtgctgttttaacggctttgacatccaattattctttcaccaagccattaaccagagccaagtttgccctaggctgggcaaaggaatgctgtgaagtgaaacctgggctgtaaccgcctccgaggccggctcacacccagggaccctcccaagcggttcctgcgccccctcgtggcctccctcctgcagttcgctgcacaagcgcagggcccggagcggggacgggcgggccctccaggccctcgacacacccaattggccaggcctcgttgcgtgtgggcggggccgcggctggagcggaggagccccccagaagagcgccttcagggggcgtggcctggactgtggagggggcggaccgtggggaagctgcttccgggtgagccccccccgctcttacgcggtctgtgggagaccggagcgggagacagcggtgacaggagcagcggccgggagcccttagggaggcaggtgagcgggggctggatgcggggagatagcgggcctggagggcggctccagggcgaggcggggactgtggcaccaagagtcctgcgtccccagattgtgctgtgcgcctgaagccctggcggtgcagccgtgcacggagtcccgtggagcgtttgtttgggctggattatcccgctgcagccgaggttgggggcccgggttcggggctccgcacctcttctctggggttcaccctctcggataccgcctgggcagactccatcgatgcagaacccgaggtgcgggtggtggttggtgggggggtagggaggtgaaaacaataacagccgttttgtactaagcgttgcgtgcattgaccattcatttattttatttatttatttatttttgagacggagtttcgctcttgttgcccaggctggagtgcaatggcgcgatctcagctcactgcaacctccgcctcccgggttcaagcgattctcctgcctcagcctgccaactagctgggattacaggcgtgtgccaccacgcctgctaatttttgtatttttagtagagatggggtttctccctgttggtcaggctagtctcgaactcccgagctcaggtgattcgcccacctcggcctcccaaagtgctgggattacaggcgtgagccaccacgcccggcctgacccattcatttcttacaacaacccattgaggtcggttctagtccccatttactaaacgaagaaactgaggtcacacaactagaaagctacagaactaggatttgtacccacatctatcagactccagagcccacatacttaaccatcctgctaccaacagcagccaggcccagagtctggctcacccaaagctctccacaagcccaacctgctgggaaacagatttgatatctatccttaaagtatggaggtgtcatggtgggcactgaggactgggctgctggagaccttcccccagatctgccgctgacccactgcgtgatcctgggcctgtgtctacccctctctgagcccagtttcacccttgtttcagtgatacaatcagcaaactttaagaagactcttagccaagatattctaggattctgggaatggcagcttctcctacgtctaaatggctaaccccagaggcgatcaggctcttcaaagccccagggcaaggctggggtctcattcttctctttaatccctgtgtctagcacttcagcaggcccatagtagatattcaagaaatgtgggttggctgaataaacacttcatctcttttcagaactgcatgacagctgctctcctgggcctttgtggggctttggatttctcagttctggccaccttctatctagctggctctcctgactgcctcctccctggccagtggcagagcctgccagggctggcagcaggtcctaaccctctgtgcgaagacccacagcctctggaatcctcagcatagtacaacttgcaggggtggggggtggcacatgaagctcatagcccctcctggtagcagtgctcagggcccaacttcagttactcccagtttggggatgttgccttccatgggaggagatactttcatattaaatctgaaacacttcttatccttcactgtcccctcttccatgaaaccacccttgactcagagacacagtccctctgacagcacctggtccacccctctactctggcagcccggtggtgattattttgtttttcctccaccacataacctgctggaaggcagggactccacttcagaaatcttggaaaaccctgtggcccacaagggtttgagctcatattcccatctggtgaggtgcagaaggcacagagctgtgccaggacatctcgttccaacccagccccactcctaatagtaataaaagtagctacatgtttactgtgcagctacttggtgccagacacctaccttatccctatcaataatctccacagccttgcaagttagagatatcatgcctattttgtagattatgaaatgaacactgaaaggtcaattactttgcccaaaattacacagcagagcatagaccaaacctgggactgtctgaccctgaaacatggatctttctgcaccgccctatactctgcgtcccagcaaagctaacctgtctgatgtggttgggcagaggtgctggacctcctggcggctcgctcctgtcttcagtgtggtaatgtcacaggcatttaaattgtggtttgcaagctcgcttgatttgggagaagtgccctcccagtctgtgaaattctcccaaactctaagggcctttttgcaaagcaaaacccaccctgcatttggctctgccaatatgtgattcagggggtgttttcccactcacagaatggagtgggaaactccacttattaagtacctcttacaatggaatgactctatggtgtaggtatcagggcactgaaatagaagccaggagctgcagggtcagtttatagctctgtatgtcactcactgtgatctccaaaagtcccgttgcctctttataccccattttccacattaaagtgtaagggattaaacaggattggcaattttcaagcttttaatattttcagcactgacagccgtttctcaaatcaaatctgtctctgaatcttaaaattcaaaaacagatcaaagtggactgctgtagtgagactgttccctttactctaaccctgccccggtctcaggctcctaggcagtcctgccccagggtttctgctaagcaggagccagttgttccctcagcctcctaaaagcgatggggagttgaggccagtggaatgcagctttggattcagaagccagaaaacaacagagattgtttgtgggaagtgagtcagagagattagacctctcttcaacatctgactagactctagaatggcattaagcaagtcactgaaccgctcagagcctctgtttccttatcactaaaagttaggacaattcttgcaatgaaatgagatactactaccaagtacttcagtgctgtgcccagcacagaacgaatacactcagtatgtttttcttttgtttcttctgtctctccagcacccaaagcagaaacagtatgggcagagagacgcctactgaatcaggtgtttatcagtattatgaaatacagtatataaaacccagcatttggagtccagaacaaattcaaattctggctcagtcactaagtagctatgtggtcttgggcaactggcttacattttggtaattctctcaatattcaaaaatattctctcggccaggtgcggtggctcacgcctgtaatcccagcactttgggaggcagaggcgggcggatcacttgaagtcaggagtttgagaccagcctggccaacatggcgaaaccctgtctctactaaaaatacaaaaattagccaagcatggtcatgcatgcctgtagtcccatctatttgggaggctgaggcaggagaatcacttgaacccaggaggtggaggttgcagtgagccgagatcgaaccactgcactccagcttgggtgacagagccagactctgtctcaaaaaaaaaaaaaaaaaaagaaaaggaaaaaaaactcctggcagacatgagagcaaaatcgagtacgaaatgggcagctgggacctcatatctactgaataattgtctgtttggaggttgagacatgactggggaggcctggcctgcccctgtgttaggtgatggggctggcccacccaggggtgtggcagcagggctggcccctgtgtgacttgtgataaccccaccctaccaaggaggaagactggataaaatgggcccctgagatggctgaaggcagctaaaggggcctaagagactatggggagaagggcagccagttcctaggcagccctgccccactgtttctgataagcaggaggcagttgttccctcagcctcctgaaagcaatgaggagttgaggccacgggaatgcagctttggattccagaagccaaggacctgttacaaaggtggttttctgggaagcaaattagagggattagacctggcttcgacatctgacttgactccaacctaccaaaggatctcccagttcacctgggagttaacacaccagggttctagtccttttgctcgctgtgtggctttgggtaagtccttgcccctctctggaccttgaggtcccattcatacaaaaagcagttggactcaggcctgccagcccccatttttgtggctcttccccgcccctccccatcctttggctatgggatagtctcccaggcacctccaaaaggaagtgtctaaaacagagctctccacctcctctccaagcccagctccccactgccctcttcctgccctgtccctgtctccgctgccctttagatcaggcaggcaggcaggcctagagcatccgccctgagacactgcctgttggctgccttaagacgccccttccttctctgcccgcagcctccccagcctctgcattcctctgcttcctgtctgctctgctcagcctgcaggattgatcttcccaaagccaggtgtcaaccaggccactaaccctacccactgctcagaaatcttcccacagcctcagcctggccccctcttatccatcccctccatacacacttgcctcagctcctcaaaacagtccacagccatcctccttccccacctttgcccctttcttcccttcctaaggaaatattggcccccttctctccaccaggctgaacccactcatcctgcaaaaccaagttcaacgccctgtcattttcttttttttttttttttttgagatggagtctcacactgtcgcccaggctagagtgcaatgggtgcactctcggctcactgcaacctctgcctcctaggttcaatcgattcttctgcctcagcctccagaggaactctgactacaggtgcacaccaccacacccagctaatttttgtatttttatttttatttctatttatttatttattgtgagatggagtttctctcttgttgcccatgctggagtgcaatggcacgatctcggctcattgcaacctccgcctcccaagttcaaaggattctcctatctcagcttctgaagtagctgggattacaggcgtgtgccaccacacccggctaatttttttttatttttagtagagatggggtttcaccatgttggtcaggctggtctcaaactcctgacctcaagtgatccacccacctcggcctcccaaagtgctgggattacaggcgtgagccaccgtgcctggcctaatttttgtatttttagtagagacggagtttcaccacattggccagcctggtctcaaactccagacctcaagtgatccacccgcctcagcctcccaaagtgctggggttacaggtgtgagccactacgcctggcgcctgtcttcttctaatatgcctcttctgacctcctcactcccattggagccatggctcacttctggtcaggctccatgcactcaatcagccctgcctgccaggactgtagtgcccacttgatgagaaatcacctgtgaaaatgccaggcatggtctggcacacagtaggtgctcaagaaacaaatgttaatgccccagcttccttctgtcttgtgtccactaatttggcatttggagcatatttttgtacttcacgtaattaaatatttactgtgtgccaaggtcagtgtgtgacagagcactgtaggggaggcaaaaatgaaccaactctggaccttgccctgcagaagctctgtctactggcatgaggtaagacaggtccacagataacttacataagagagactgcaatctggacaagacagcctcagtgggagagggaaggagaaccctgtagatttgggtgcggggaggctgtggggagagcacagcctttcaggtaaagggacaaggttaggaaagcaagaaggtgtagcttgtgctcgtggagcccaggaaactccttgggctagaaaagatttggtggcactctatacagtgtatgtgtctgtctgtctatctaacatgaatggtactattttctcctattggtgtgcattgtacctaacaaaaaatccatgtcccaagtacttttctcttttctttctttctttttttttttggaatgaagtcttgctctgtcgcccaggctggagtgaagtggcgctatctcggcttactgcaacctcctcctcctggattcaagcagttctcctgcctcagcctccccagtagctgggattacaggcacgcaccaccacgcccagctaattttttttgtatttttagtagaggtggggtttaactgtgttggccaggctggtctcgaactcctgacctcaagtgatctgcccatctcagcctcccaaagtgctgagattataggtgtgagccgccatgcccggccaacagtacttttctctagaggtagaattgcaggggatttttctctttttgcttatctgcacttttctaaaagttctgccatgaacacgggcattttttgtggaataaacaaagtttaaatgttggctagatcagtgcttctttatgcataaggaaggattagttcttttttttctatttccaatttattgattctttgataaaatgcaatgcaataaaattattatttttttttagagacgtctccctctctcacccaggctggagtgcagtggtgcaatcatagcttactgcaaccttgaactcctgggctcaagcgatcctcttgctttagcctcctgagtagctgggactacaggtgtggaccaccacacctggctgatttttaaactttttgtagatacagggtctcgccatgttgcccaggctggtctcgaactcttgggctcaagccatcctgccacctcagcctcccaaagtgccgggattacaggcgtgagccaccatgcccagctagaaaattacttttttggctaggcaccgtggctcacgcctgtaatcccggcactttgggaggctgaggcaggcagattgcttgagcccaggagttcgagaccatcctgggaagcatggcaagacctccatctctacaaaaaattcgaaaattagctggatgttgtggtgcacacctgcagtcccagctacttgggaggctgagttgggagaaacagttgagcccgggaggtcaaggctgcagtgagtcgagattgcaccactgcactccagcctgggcgacagagaccctgtgtgaaaaaaaaaaaaagaagagaattttttttaaacagtcattgcttgctcagatgtttactttaaaagataataatgaacaagaagcagtcacataaaatacaagcccaaattttatatcattagattctgattgtcatgaaagtttctaaagacttactttcatttctcaacttaccttgttgaccagcagggattggtgaaccatgctgtgagtagcattgggctagagagaggggaggcaggaatctagaagagctgttttccagatgtgaccatctcctgaggacagggaccatgtctcatgtgccacccatcaccccccacagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtgagtctccaagaatgggccaggcctctgctctgctggttggggttggggttggggagggagtgttgactggagcgggcatcagtatggctgggggtggcaaagtgagctgtcagcttgaaattcaaggcactggaagcaggctacttggattaaggacaggaatcttaggaacaaaacaaactttgaaagaactcattcatcccatttggaaaattagaagaataacccttgcctgccatcctgagctcttgcagtaagacagaagctgagaaggtgctctgtacattgtaaagtgctatgtacctgtaagagatggcagtcattgaggctgggcacggtggctcacgcctgtaatcccagcactttgggaggctgaggcaggcggatcacgaggtcaggagatcgagaccatcctggctaatatggtgaaaccctgtctctactaaaaacacaaagaaattagccaggcgtggtggcgggtgcctgtagtcccagctacttgggaggctgaggcaggagaatggcgtgaacccgggaggcggagcttgcagtgagccgagattgcaccacttcactccagcctgggcgacagagccagactccatctcaaaaaaaaaaaaaaaaaaaaagagatggcaatcgtgattgttaataataatgcagacatttactgagtacttactatctaccaggtactatgctaagcacctacacacattatctcattcaattctgagagcatttgtatgaagaaggagtagctatcctctagaacatcagctccatgagggcagggatgtttgtctattttgttcactgttgtatcatcagggcctagaacagtacttggcacataataagtactcaataaatatttgttgaatgaatgaattaaccacgcatgatatagatgaaggcctaaggctcaaagagatgatagaacttggccacggtcacccaggcagtaagtggctgggatagaaagcaaggacctgccaaattcagagtccaagttcttaaccacttaattccttcctgtaattaccgttcttttagtacagttgctagtgttgtcactgttattcttgttgttcctattattatttcaggccctgggcttggccaggcagggaagccagacactggatcccatcctcctcccaccatctccacttccatatttctttcctgcttcccaaccatccctctcagtcgcccccgcaccactggcccttcccacagctaccaatccatatcccacccccgctcttgcagggatgttcctgatgacatacagcctatcaccagcctcccaggagtggccaggtaggagacgtggagttggggggccagcgggtggtggagggagagattccacaggtggaagtgctgggaggcagaagcagacctaggaagtagaagatgcggacagacagacattagctcagtagaggaaagggtttccccggggccagagctgttccacagtggaaggggcagccccataaagtaaagagctacccatcacccgagacgtcgtggcagaggctgttgcagaagggagctgaactgcagatgggagttcaaaaagagggcctcgaaggagccttccacagccgaattccggagctctgctactcagggcctcagtcttccctcctatttagtggatgcatccctgccccttctgtcctgggggcttgagccctcctggtgccatatgcagcttggtttctaacagaggcacacagtgtggtggggtccggaggaccgttgcctgggacctgccttccttcaacccctctacccacacccacacaggtatggtgtgaagcggctggaagagatgctgaggcccttggtggaagagggcctacgctgtgtcttgatctttggcgtccccagcagagttcccaaggtgaagaatcaaaggaagggctaagaagggaggttgcgctcacgcccgtaatcccagcactttgggaggccaaagtgggtggatcacttgagcccaggattttgagaccagcctggacaacatggcaaaacccatctctacaaaaaatacaaaagttagctgggtgtgggggtatgtgcctgtagtcccagctactcgggaggtggagaggtgggaggattgcttgagcccagaaagtcgaggctgcagtgagccaaaatcgcgccagtgcactctagcctgggtgacagagcaagaccctgtctccaatacaaacagaaaaaggaagggaggttgggcaaaggtggactgagggtccacactgactgcaccctcactcccacattgtgctggccctggggccacaggtgaatggacgtggtctttgcccttaagtcagcacccatgtagggtcggtcctctgtgcttccttatccaggggctgtgatgatgaaggaaggagaaggccagggctatgctctgtgatggctgtcatcctgccttccaaagctacatgtaatagacacactgctttgtccctcccctgcccctaggacgagcggggttccgcagctgactccgaggagtccccagctattgaggcaatccatctgttgaggaagaccttccccaacctcctggtggcctgtgatgtctgcctgtgtccctacacctcccatggtcactgcggtgagttccctccctcccaccagccctgctgccacccacactcctactgcccacttctcaacagggtggggacaggccagggcccaaggtgctccccaaaacccagtcatctgtcctgaagggctcctgagtgaaaacggagcattccgggctgaggagagccgccagcggctggctgaggtggcattggcgtatgccaaggcaggtgagtgaaccaccagcagggatgggcacctctgggtcaggaggtggcagagtggctaggagggccccagagttctgaaggccaccctctgccccccaggatgtcaggtggtagccccgtcggacatgatggatggacgcgtggaagccatcaaagaggccctgatggcacatggacttggcaacagggtaagggcagggaatgcagcacagggctggcaggagatagtctgcaccagccctgcccccgtgtctgctaagaatcacagaactgccgggcgtgttggctcacacctgtagtcccagcactttgggaggctgaggcaggtagatcacttgaggtcaggggttcaagaccagcctggccaacatggtgaaaccccatctctactaaaaacacaaaaattagctgggcgtggtggcaggcgcctgtaatcccagctactggggaggctgaggcaggagaatcgcttgaacccacgaggcagtgagctgagatcatgccactgcacttcagcctggatgacagagctagactccatctcaaaaaaaaaaagaatcacagaactgaagacagtgctggatgaggctttggggaaccatttaaacctctgggcctctgcagggaaatcaagcccagcactccaacaggaccagaacacaggcagtctccttcccagcctaggttctttctctccctgccacatcaccctgggatacctggcaagggccgaataagccaagacctccattgtctccccataggtatcggtgatgagctacagtgccaaatttgcttcctgtttctatggccctttccggtgagcaggggtgggcaggggtctgctgtgaatccctggccctttggcccaaagctggagcccaccctgatgactctgctttgcagggatgcagctaagtcaagcccagcttttggggaccgccgctgctaccagctgccccctggagcacgaggcctggctctccgagctgtggtgagtgactaggacttgagccccaccctcagccccctcctaggcaccacccacattataccctcatcccttaggaccgggatgtacgggaaggagctgacatgctcatggtgaagccgggaatgccctacctggacatcgtgcgggaggtaaaggacaaggtgagcacaggtacgaggcaaagggggctcagggggctgggacagagttttccacagactctggaatctcagagttggaagcagtttgcccttaagcatgcatcctctcctccccttccctgcccaggaaccatcgtggccttctatgtcggggcttgcacgagcctcaaacagccctgctttaacagttcaagagtgggccaggctgccagccgcagtaacccaggacacggggctcaagatggtcacagattgagcaggggggaagggacgcttccagagccacatccaccctccatttcagcctgtctccctgtctgcttccctgcagcaccctgacctccctctcgccgtgtaccacgtctctggagagtttgccatgctgtggcatggagcccaggccggggcatttgatctcaaggctgccgtactggaggccatgactgccttccgcagagcaggtaggcaggcaagggtggggtgttttgacctgcgccacagggactgataagcactctgcctagatcggggaacgacgtcctgagagcttgggatcttattccgggaattactagtgatctaaacagacacacactgaggaagagatatggaactgcagcatagaacacggcccggtgaagcaagcagagcccttcatttttggttgtgagaacgtgggcaagccacttctctgaacctcagtgtcctcacccataactggataactggggataagatacctggtgcgtggttgtcctgaggattaaatgaagtaatatcactccataaaggggactcattttgttagaattgcacaccagcatgggaaggaacttgcctcttacctatttccttcactgtgcattttattctttggtaaactgaggccccaaaagaggaaatgacttgcccaagaaatagagtttcccaaagctgggctccgtctcatgtggtgtgcccacaggctgtgcttcttcatggtagccttcttccccgcctggccttcccatcgcagaaggtgtgctcagagctgatcagcgtccccccagcaactttctgcatctctcccaacacaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgctgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaagtacagtttctactgaatgtcttgtttcatactgttgtaaagtcaaaaattgtgaattgaatgatcacagttcggggaccatctgcaattagccccagttatagggggagaccaaggagaccaggcacctacttggttgcaagtgatggaaatccagttcaatagcaaagaaggacatgattggttttcataactggattgagataaggacaggtgtggttgggcccagggtcaaaccccatggaggtctctgtccctttctaactctcgtctgtgtttgccccagctttatactcaggtgggtttttgccacttgccagcaacatgatcctcaataattctaggcttaaatagttgttaagatttgtaatcccagagaaagagccttcctgtcccatcactcacatagcaaatctctggaggtctctgattgggcctgttcaggccacatggtccactcttggctcagtcactgtaaacaatgggatgggagatggcgccacaattgaccaggtaggcctcattacacag

SEQ ID NO: 15575 - DNA, 24656 bp, Human
  misc_feature (1)...(24656): n = A,T,C or G
cgccacgacccagctgggttcacagacaggagctgcctcctcccactgcaggcgggtgacccaaggcccccactgccctatacctgcccagatcgcggggcactcgggctccgcagctctctggccgcgctcggggtccggggagccgggctgcggctggggggcctggaggatgagggcgaagactcgagctggactgcggagagggtgccggcgcgggccgggcttggggggaggacacgaccgggcctccgcccccggataccgcacgcgccgatatagaggggccggcccctggccccggcgcggcgggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccggtggcagcggcggctcgggctgcgcctcccgttgccgtcgctgctgcggctttgtctcccccggggagggggtcccggcggctctgcgttttcgggctctcggtcccggcgccgtcgttttccgcctcctgcggcccgggcccccgtctgggtccgaccctgcggggcctcgccttggcgcttgggctcctgcccggcaggtttccgcgcgtcccctgtccccgaccctcgggctgggcgcttccgcctccaggttttctctccgtgtttctgtagctccccggcctcgtctctccggggctcctctcgtctcggcgtctctgtctgtcgtctatcgttgtgtctctggctctgcgtcagtctctcttgggttttctcttcgggcctccgctgtctctccgagtctctgatccaatcccccacccctcgtttctctctctctctctctctctcgtactctctctctctctctctctctctctgtctccctgtctctctccatccctaccctgtgtctcgtccccgccgggttctctctagctgggcgtctcagtgtctgtgtctctggcactctcggactggcctcgtgtctgcgcccggtggcgtcggtcgttgtctctcgccagagtttcttcccatctctggctcccccggactctgtctctgcctccttcgtctctgtcgggttcccagaacacccgggccgggcgccccagcgctcctgggtcccctggcgtcttccccgcggctgagcccatctctttttctcagaatcggggttttgttctcagacaaacgaatcccaatcgaagcgcatcgaacccgagggccccagatcgggcgcgacggggtccgcgcgggaggagccccccggacggggcgggagcgtggggcctggcaggggaaggccgggcgcggggactgcaccggacccaccccgggacgctgcgcggggcgctcggtgggtgccggcggcagcgcctgggcacagagaggggattacgcgacgggccggcgacagcggctggggcggcggccgcggggaccccaggctgccggtctccgccggccctccctgacccgctgtccctccgcaggcggacgccgcgggcatggactattcgtacgacgaggacctggacgagctgtgccccgtgtgcggggacaaggtgtccggctaccactacggactgctcacgtgtgagagctgcaaggtgagcggcgagcgcgcggcaggggtgcggcagacgggcgctgcggggcctcgctgactctcagctcccgcagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaaggtgcgcgccgcgcgggcctcgacccctgaccccccacagcctgagggggtagggggtgggggtgggagaggggctgaggggatagtaccattggccttcgcgaaggcccctcgtgcgacattagggcccagtcgctgcaagagaaccgggcgctggcgctgggtgggcctcgggcggggaagggacgctggcaaggccagcctgggttgggctgagaagtatccaaaagtgaaccctatggagatgactctttccccagcccctgccagggccccagcacagggtcggcagagctcctccctctgtgaggaggtccccatgcccccaaaatacccaaccccagccagcagaggccaagtcccagtgcccgcactgtcagtcaggctgggtgacattgggcaaaatccttaacctctctaaaccgcagatttcccatgtgaaacatgggcttggccggatggagcggctcatgcctgtaattccagcatttgggaggctgaggcaagaggatcacttgagcccagaagtttaagaccagcctgggcaacatggagaaaccttgtatctataaaatataaaaaagtagctgggcgtggtgacatgtgcctgtagtcctagctactcaggaggctgaggtggggggatcacttgagcctggaaagtcgaggctgcagtgagctatgatcacaccactccactccagcctgggcgagagggaaaccctgtctcaaaaaataagtacataaaaataaaaaagaaagaaaagaaaaggcagaaagagaaagaaagaaaagaaaaatgggcttaacggcagcgccttcctccagtgagtgagtgtggggatcggtgcaggcaagctgaaggtgcctaggcgttcattgccgcaggttagctgtcaagcccatcacgctttccattaggatctgcccaccaccaccgcccagcccccacacattcagctgcccatctgcttgtctgtccgtccatccaaagggctctctggtttattggctcagccagtgagattccttcccgtcatgttcttagccaggccctgagggggccgggcagtgggggacaattgaattgcccccaagaaacccaggcccctctttgcctccctaccctcaaccccagctctcagcccagagaggaggaggtaagttttggcaggaaagatttgagcttctggaggtggccggtcactggactgtgtgctgaacaggcagtggttgattaaggtcttggaacagtgtagaaagccccaggtggctctgagagtggtggaccacatgccctgccacctggagaaaggactcctggatgggagaggggacatcctgtcctgtccccagagcccatgcccctagtgccaggtcccaaggggccagatagctggctgttgtgggcagtagaaactcccgtgcagcctgcgagcagcacagcgctgcccaccccagggggcaggaagattggccaggcagccccccagccatcatccctgctgagcaccaccaccccctctctcctgctctttcccctcgcccagatcccagggtggggccctgtctgagcaggggcggggggcacactccagctgcagagatgtacctgttgggtctggctgatgacacattcctcgccaggcggaggagcttctagtcggcaagagaggtcccctcccccagcatagagccttggccagctctaaacttggcttcacattcgcagccagtgaaggatacttgagtcattttgaagcaggagctcaacagtcaggcagtcagtcaacaaacagctggaccctggggccagcggtgaacaaggctgaccagggtccccttccggtcaccatctccctgccaggccttatgctagacacctgagcccagaacttagcccgcaggagcacatggcatgatccactcagcatgataagagtgggcaaggacagggcacctggggcaaggacagtagagcccgtttgcatgaatccaggagtgcttcctggaagtagtgacattgaggctgggtgttcagcaagcacaagagaaaaaaaaaagtttgagtcagaaggaaaatgaaaggcagggtggaggaggaaggagatgtgtcaaacagaggagtggaggtgagttcggtggagtggaaggagaggggtcttagcagggattgcctgaaaagctgagcagggccttgaatgccaggcaaaggagactgacttcccctgtggtcagtgggagccatgaaagggtgttgagcaggggagagagcggtcagatttgtttggaaaggatctgtggtggggcagcatggaagggggcttagagagggtgagtctgaccctctgcccctgcccacagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtgagtctctcctcccgcccggctggccctgcatcatggtcctcccggctgcccaagccttagcccgactgtcctttggatagggccatccttcccactggcttcaggcagtacctggggacccggaggccaccctggggacattaaggagcatttccacttatcacagcctcctgggtccccgctccctccctctccttctctcctccttgagcctctgctcaaggagccactgctgctttgatctctgcctctgtctcttcctactgtgtctctcccttgcatgttgtctctctgcttcttggtgtctctgcaaccccttcagcctctggggttccctattctggggctctctcagtactcatttccctcattctctgagaccctgggctccctcaaaggactagctgagtccttgggagactgtcttgcctccccaggcttcagcctagtgttgggaagggggtccggcccatcctgtcctcccattcagggaggctggcaaggattggcagtgtcacacacagatgggggctcttagtgttttagagtttggggcatttgtgggccattctccttcccagctaaggtgaaagatcctcctgcctctgcaaatcttgcgtatgctggatggtcatgtgcatgtgtgtgggtgttcaggaagctagataggtaggtgggtgggggattccagggtctgccactgatcttccctggcgaggcagccttcctctatggcatggccttctttccccctgggtcgaggtacctgatgctacagtaatcaggaaagcagcaggagaaactgaggctagacataggaaagaacttcccagtcttcccacctagtggcttgaagagcctgaggccccagaactgcccctccagtgccctggctctctgagacctccctagaggcccctccagctgaccaaggcctgcccctccctggcctgggttcaggcactctttcacccagggctattggtgtttagctttcccaggctgaccccctggctgttctggggctgggtgtaaacagcagggcccgttgcccccactgctggggccactgcagccttgagcagcattgtcaatgctgacgccactcgggcctgggcttcctccaggggcatgaggccggatgggctgggggcactgcctgccctggctggtaggtgggggtgggtgctccgagccctaggggcatcgcgggactggggcctgggccatctgggagtcgaggattgatggtggtggctacggcttccaccgtggagcgcctgtcatggctgaggcctggggatgtaccatgtgtctgtcatggggtgggtttctcaccccagccccttctcaacactgcccgcctctctggtccgacctaatggatgaggcaaaaggcagggtcttgaatactcccacctgccttctgctcatggctggaggccctggtggggatgaggaccccaagcatcttgggttggttgctagcttccctccagacttcccatgcaccccccgtgcagaggggaggaggagcagggcattcccggccttccagaaccctggattgaggggcagggcacttcctctggctgccttcctagtctcccggggattttcacgcaggatgggaagggcttttgtcccagctttgctgagtgttttttcctgcttctggcttctccgtggtccaaaccttcctgcttccccttctcaaagtctttgaattgagcccgggattatgagcagtggtcaccagcttctctaaaggggccttgcagataagtaccagcccagcccttagagcgcctctcgtaagccatgtggaagttcttttccactggtccagtggaccctgggctggtgtctctttgcaaagtccagaggtgaggagacagaaaagtgggaggggtgtgggtgactccggcgtctcttctagctgatcattcatttccccacctccagacaggacacatcttagcagacagaagagggggctctctggctctgagagtggagcagcccttgggctggacactggggacattaaaatcatctggacccaggaagctgccagcctggaggagaagtcagacatgcacttagataatgccagtgcgaggtgcccagggctctgagagccacggaaggggcagaggggaccctggggggagagcaaacagctctaactaaggaagtcggagaacagttctgtgcctttctagaaagtagagaaggttcagggaattccaggcagtgggcacagcagaggcgaaggtcccgaaatgtgaagaggcatcgtgttccgggagttccaatgggcctgtgaagcagggctggagaggttggcagggccagagcagagcctggagcaggagtgggtccttgggcagtgggtgatggatggctgcggggctggctggggctccaggttccgggtcagggaggggctcccctgacagagcttgggctctgagcagaggcccactcagccctctgatgctgatgacatcttgctgctcgggaggagtcctggagtctcagctgagctctcaggggtgccaggggcccagttgtgtccgatgctgagctccaaatgccctcttggggtcttcctcccccatcttctttcccagctggtatgggggtccctccgtctccatgtttccatctcacaccaatcccagcatggtagattcgatagtagcacagaagtgaatatcaaagactagaatcagagaggcctgttgtcaagttccagctctgtcacttacatgctgtatgattttgggcaagtgacttcactcctccgggcctcagtttcctcgtcttgaaaatgggaggagttgaaataatgtccaccccattggattgtggtaaagggttagtgagtaaggacaggggaagaactgagcgcgggcagtttcggaagtggggtcgcagcacccttcctctcttccccttagctacactgtttaatcgacgcctgcaggcttatgcaggccttggcggggaggcagcagggagagacacattggacccaagctcctctgagcacacgattgttctgggaccgtctgagggtcactttgtcctgcgcttataaagcaactttttccctgtgaggtggaagaaactcacctgtacctgctgcttggtgggcagcagtgcccagggcccaggcagtcagcctctcgtcacttactgcgaaggacaggctgggaggatgcaagggaggacccggggggacggtgggggccaggagtgcccagtgacccattttgacatccgttcaccctcaacatccagctccgaggcccccactgacagcagatttaactgcccagatagacggtttcatttaagcggcagtaactgtcagtcctgggctgacaaatgacacctcactgaccactctgccggcagagcgcagtggccagcccgtggtgtgtcagccaccagagaattacacagcccaccggccttcacagccagaccaatcggaccccagggggctccagaggggccctgctgggagggaggtcagcttggcacccataaataccgggtctctgaggcagcctgcagagcgtcaaggctccaggaagatttgtggcggtccggtgggaggggtggatggctgatgtgcccagcagacaggccaggctggtgggagacccaagggctggggctgcaaatgtcattgttcccagggcgacaaggaggcctgagggtagaggagcctttagcttagggaggaaacttcggaaagtgaaaaccaaccctctctggttaaaggaacctcttagccacctgctttctcatgcaggggggctggcagctatggccctgtggttttcttttaaataaaaagaggttgtgtgtgtgtgtgtgtgtgtgtgcgcattctcatctgtgtggggagtgttttggagtttggtgtctttatgcatccatctgtccacccaaggaaagcagtgagtacaagacctgcttggccaaggggcaggtgggatcccggccgggcagcatccacgtaagaaccaacagcaggtccaccgattcccatacatcccaatgtgtgttcttacgttttaaccaaaaaagagagaaattacatttcctgcttcacaaaacaggaaattagggtggaggatgcatggccggatgggggctcgaatgcagggcacggggcaccaaagcctcagcgaccatattgtggctctgtgcccctggcacccctatcagcctcactgggcagggctgccccatccagggtctaaggtctgggtacagagcctgctcccagggctgggccagccgggtcaccgtgacccatctgcttttggcctgaagccttatctcctcattctaccccttatcgctcctccgccacctccccacccccttgtgtcttcgttctgggcgcaagcgtgtctgctcctgtgggcctgcgaggggcggggggacaagcctggccctgcaccaccacctgggtgtctacggtgggcctgagtttttcttgctgccagtgtgacccctgggcaggcccctccttcccaggtctcaggaggttctcaggtccccagaagtctggccggtaggaacctctgggcagagcccagctgcctgaagcccgagtgttgcctccggcaggcctctgtttccttatctgtaatgtgggcagaatgtcggcagggcaggggtgaggtgtcctgtgccacactgggcgccgtgcctggtgataggtgccctctgagccttggctccctcctggaaaccgcggctccatgggggctggcacttccaaggagagatacggagagatggccgagtcagcccctgcccaggcctcagtctctccgggaccctcccagtcagggctgagcctgggggcacacggctgatggtaggggctctgggaagaaagctttgctgggagctggagggagctctggacccagaggtgaggtgtggatggagggaatggacacagacctccctcttttccaccacgtgggcccggaggtctgtctgtgtgcagttcctgacttctccctctccttttctccccttctgtctgcctgaggacacaggccccagggacgccccaggagagaaggggaacagagagcggggtgcttctatctcctacgagacagagctgttcattaggcttggcccagttcccctctgactgggggccgcccctaggtggggagcagtccctctgagcctctggtcccaggtagagagtggtctctgtgtgcctctggccccaggtggggagtggcccttctgagcccctggcccccagtggggagtggtctctctgagtctctggccccaggtggtgagtggcccctctgagtctctggccccaggtggggagtggcctctctgtgtctctggccccaggtgggcagtggtccctctgctctctgtgcttgtcttggggagcaccttgccagtcatcagcccctctgaccactgctctggggcccagagaagagctgaacaccagttctgcctccccagacctcacaggtattggtgaagacagaggcatttaactgatgccatgagatgttgcagattctgcatccagagggtggagagggcctcgaggaaggagagggatcaggtagaggatctgtagaggaggcaaggagcctgtgagagaccaggaactcctggatggcaaggagggtgagtgagaggtcctcttccacacctagtggttaagagcgcaaatctggaactagacagagctgtgtggcctctctgttcagtttcttctctctatcatgtgggtggcgactatacgaaactcgcagggctgtagggctgcagtggaatgactgtcagctgtcatggtttgcatttgccatagggcacggcccaggaaggtgcgccagaagtgtcttttgggtcgatggtggccagctggtgagtggcacgggctgagagggatggggctgtgtctgcccaggcccatctgcagtgcccagtgtgcttccaaatacccagaagggctcgttttgtcacagtggagattgtggaccgggaatgccagccgtggccctggcctggccctgcctctgtgtgatcccgggagagtctcttgccctttccgggtggcggattcctcagctgaaaaatagggattggggccaggggatccctggctctgcttctgagtcctgcagagtcaaaggacactccaaacaggggctggccctgcccctgcaccgagtgtctctggccgcagcctgggcattcggaatcagccccttgttgctgttcgtttctgcttcatgtgccaggccattgccgcccccctgctcatgccctgggcctgacctcaggccaggtgggacctccctcctcctcctgagcctgagagctctgcgtaggcccgggggggaagcccttggtttctccctcatggctcctgtttgagcagttggggctgccagaggtgtgaccgaccacaggcttttaaatgtggacaaggttaaaattaataataaccttgccaggcatttgtaggagtcctttgcagagcacctgcatggacattagtcactaacatgtatggcatacctaacatgtactggactgtccgctcagtactttgcccactttacagatgagaaaactgaggcacagaaaggttaccaggacttacgtaaagtcatacaaaagacagaggtggggcctgaagcctggcccattcaacccccaaacatccctttgttaactggccagacctctgttgcactttgatagcctagacatctgggtagatgggcacagagaggttagcttgcccaggctgcacgcctagttgggtctcagtgggaggagaaggggtgagaggaaggtccctggaccctggctggagcccggccccccgcgtgcctcttccttccaggtggccgaccagatgacgctgctgcagaactgctggagcgagctgctggtgttcgaccacatctaccgccaggtccagcacggcaaggagggcagcatcctgctggtcaccgggcaggaggtgaccagtccctcggccccgcccctgggccccgccctggccccgctgtgcacttccaggattcagggccccggagaggaggacccaggcctctcggggctggctctgggcaccctaattatcagccctttccccacgttcatggaacacccactggcccaaaccctctgtgagcagccctggcccaggcttgagaggcgccggcccctgggagccctgctcttggggagcagctcagggggtgtgggcatggtgaggagaggctcatggaggaggaggtgatggtggccctgggtctggaaataacacactggagttggctggggaatgagggatgaggggggcagtccccacgtctaccgcaggctcagagagggtggaagtgtggagcccccgggccctgctggtgccggtgtgggggtggcatgaggtgagagatgagggaggctagagggttgctagtgctggcttagcaggcaaaccttgcaggccctaaatctcgaatgaatgaatgaatgaatgaatgggcaaagggctccagagagctcagagtcggaatttgggcccccttagagcagggaatgaggatctggggagtagaaagtccagatgcagcaggggtccggggagagctttaggaggaggagggacatggccaggtggtatctgaggaggcaggcggaggggtcaggatgggaggtggggggccagggtggggacacgggggcacagccacggaggaagactcacctggagagatgggctgtagggaaagagagggagggggggaggcagagaagggggttgatggccagggtccagcctgctggcaggagtgccactctcaggtggggacacaggaagggccgtggggtcggtgggtgctgtggggtggggaagacagactctgctcccagctccagccctcccaggcccccactgctcatctccagctctctcctcggtgtcacaggccatcggggcaggaggacgggacgggcagcactggtcccaggggggtgtctttggggctccctgtgagcgcaggtgcctgcagtctgcatgaagtgtgggtgtccgcaggctggctgagtctctgtggccatgggaatgcctgtttgtgtgtgtgtgtgtgtgtgcctgcctgtgttttattgtgcaaaatctccacacacatcagtgtgtgggtgtcactgtcttcccatcaacccgtaaatgtgatcacatacatgggtgtatgtgttgccgtgagtgtgagcgtacaagggcgggtgtggccgtgtgcacacgtgtgtgccttcacttcacagagtgggcgaccccatgactgtgctcgtgtgtgtgtgtgtgtgactctgagctgagctgtgacccagcgtgtaggtgtgaacatgggggctctgggaagccatgtggatgtgtctgtgtgtccccacacaggcctgccctccccaacccctcccctcccagcatgtagaggggccccctgagctgctggtgctgctgggcctggtgctggggtttgtgtgtgaaggaggggtggacgcgggcagaacgtgggtgcctcagctccgggcttggcgggttgaggagagctcggaagggtgggcccggcagcgtccccggggctgtgcagatgttacccgtgcctggctcggcaccaaggctgggccctcctgacgccagcccatctgacctgcacctccaatccatgccctcagccctgcatcccccatcagagagccacctgcccggacccacgtcctctgactgtcccccgccccgtgccctctgcccccaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctgggtgagtgcagctccagtgacagagaggtggagacagccagaggcgggtgggtgggagggtgggtgaggctgaagaggtagccctgctgtggccagagtggccacgaaggagcctcggggagaaaggacccctcccttactcattcagtgaacaaaggtctgagggcccccggccagggcctggctcttaaatgggggctgctcccgctctggtggcccatgtgactttaggatttttattccaggctcccatcctggggtccctgttttctctaatccctggatctagggggccccaattttgactgtacctcctgggggcctggacccctttgctcatgcacacgtgcatccattcattgactctacaaacaggcaccgagaaattgcactggagaaggcactgggaataccgctgtgagcaaaaaccccccaagcccagcccttgtggtactgaccttctctaggggagacagatcatgagcataatatgattagtaagacgtaggttcctaacacgattaggcaggcatagccaggaaggttgtgaccagtgctaaggaggaaaagaaagcagaggagaggcagagagcaggcctggcccagcccagcccggccacccacctcactccccaagcacttggggggtctccttcccgttgccctcctgaccccaaccctgcctgggccactccagtctgcaccctcactccctggaaagccatcacaaatgccctccccatgcccagagatgctgaggacatagctgtcccttgccaatcgtgaaaagacctacagcctgggtggttagggctgagacagagagatgggtgtggcttagggaaccctgggtggggagcagagctctttctggaaggcttcctggaagaggggcatctgagcagggttttggaggatgagtaggagttttctgggggaatgaattattttgcagtgatgcaggtgggatgggatagagatgagtgagtgcttcatcacctggagagggggcaggattaaggtattgtcttggtggctggcattatagtcacagtctgcgaggggcatgcctgccagagagagggaggagtggggagtggggagtgttgtggaggcataggggattaacgaaaagtgggaagcccagtgcttgggtgggattgcgatgtcatcctctcctgccctgtggctgggtgcagtgggctgggtctcccgattctggcagaacaggctggtaactggagggcttttctgcaaggcccctttagccacctctcaggacaccagccggggctctgcaggggtcagcaggggacagccattggggtggggggcgggtaggatcttgggcagccagttaggagctgtggcctgaaatccttacaggagcctcagggacccaggctcggttggctgcagctggggaagctccctcctacctctgcccgcaacggcaccttccccgcagcctgccaggctcagcagactggcacaggatagagtcacagatgtgcgtggtgggggtctgtgtggttggggcgtggagcctgcaggaattacgtgaacgtctgtctctgcatgcgtgcgtgctggcatgtgcaaacgatgaactttcatacgcttgtggtttctgaagtgttagcctgtgtgaagagtttgtgtgtgactggggatggaccgggagatctgggaacatgagtaatttgtggggaagggtggtgcttggaggcacctagaattggagtgtgtgtccgcgggagtccgggtggtttgtaaggtgagagttcttgacctggctgccatcacaaggccactgggagggccttaaggaggggtaggtggagggtgggctatcagccagcaggctcctttgccagggctctgtctgtccttgggtgtcccctgaagggcagggacattgtcttggcccccagcccctcttcccaccaaagccctgtgcatagctctggcggctgccgggggtgaatccaggacttctccttctctgggacttaaggaagatggcagagctgagccctcttctcttgggtccaggtgtgggcgtgctcaaaactggaagtgccccaccctcatgtcatgctggtcatcagcctttttttccagatgcagcagctgaggcctgagaggtgggagaggctccagtgctgggctggaacaggctgagttgaggggagaagggtgcgtgcgtgcgcactcgtgctgtgtgtgtgacagaagcaaggtggcacagcgcttaggaaagggaactaggtggggatgaggagtggattctaaatctggtctctggtctctttctggctgtgtgcccttgggcaagtcactcccctctctgagcttctatttcccccatctgtagagtgaccctcctagtaatccctaacttgttacaaggattaaataagagaattccccaaagtgtcccagtgcttggctgacccctgggaagtgtgtgtcggaattgttttaatcataatcaccattattaagttaatgtgcatatgcgtaagtgaaagaatgaagtgaatgaatgaagcagctcacagtctccatctgtatcattgtgtctggcacagtgccttatccttgggcacaggaacatgggtctggctgatgtgggtgggtgagccctgagcccagcaggccaggaacctggtgaggttgggggtgccagaggaggaacaggaggagattccaggaccccagctgatggcaagcagtgagagagggatgtagggggctgcagaggcctttggctggccagttccaggttgggagaggaaccccatcagttcagtgtgatcagggttgggtcagaggggagaaaccagcaccacttggctatccgggaaggcttccggggggtgggggctctgagctgggcctagcagtatgaataggagcattctgggtgaaaaaaaaacaagcagcactaatagctttccagactcaaggaacagcttgcacaaagttctggggaatcctgaaagttctgtgtggctgcaggggtggggacggggtggggagtaggctggcgaggggacaggagctgagctgtgcaaagccttgaatgccggggcctggtaccttgaactttcccttaagcaggcagtaacatgatgaaattcgcattttatcaagacccttctaagtgcagcatgggaaaaggatggcaggcaggcagcccagagccctggcagaggctagacctggggctgggctggagcagactccagggtctggagcagaggtctcctctcctgatcccacccagaccaccagagctggggctccagggaaactgggacccggagagggaccgccacttgccagcagacctccagctggcgcgcagggcgtccccctcgggggcggctccgccctgggccggacagcctggccacgagtgcttgtgctcccccacctgccccaccgccctgcggctcactcagcgcctccttcgcgcctgcctccgcataagggtgccatttggtgtctaaatagccgtctcgggagggcgcggaggcaggtaaggaggtttaattaaaattagtgcctctctcctggcaatcacggtatttatgaagatgggcccggctggcattgttctgccgaggacttaatcgaagcttaatggattgacctaacattcgatttcctgacttccattgaggcggcggcagcagcattcccttaagcgtttgcaatttacccactgctccgcgccaacaaaaggcggcctgaatagcagccccactcgaggggccattgtgcgcgggggcgcctgcctgagttaccgctattgggacaacattctttatgcctcgctggaatgaaaggattattcaaatattcaattaaaccatgaaaagggggcttttctgagaacctgggggcccccagctctgcagagctagcgggctgctctccgaggtgggggctccatctcccagctccctccgacctccacctccgcgagtgccgggagctgagcgggcttggggggcgcaggctcctctccaacatgccggtctccaaccttcgggcgcccagggcccagagctgggcatgcagatgagagccagctccttgccaccctgtgaggcagagatgaattttcccctgttgtgcagatgacaggaaactgcagctcagagaggggaagtgacttgcccaaggtcacccagctggttgtaaagccgggatctgaacccctgacacatgaagggggcgtctccaggtttgtttgaccccgctcccgtgtctgctggaagaacggtgtggtgttctgtgcgttgctggcaccgtcacatgtgttatccgctggaatcttcacaatgatctctttagagactgggggttcagggaggcttggggaaggggagtgacttgtacaaggtctccagatgaggaggaaggcaagtctagagtccagagtagcctctctgggggaatcctagaaccccaggggtgggggatctcggacagaactcatggatggcatgggacataaagttatgtccaatcccacaggaacatgcatcccagcttgacccagctcctgggcagggggccccagtcctgcttgcctatcatgggagacttgggctttggtgtcagagagacttgggtttgaatccaggctctggcaccttgtgtgtcttgagggggccctggttccctgagccctggggatgcactgccctgcctgtctggatgtctgctgagatgaaccgagctgggtgcaaggtgcctggggggtgcccgggaaactgggtctgggcttctggactgtagccactgaggctccgttagcgactgtgcttccctcccccggccctgtggctgacctctgggggcagtcgggggtttccaacctgctgagagctgggaagccatagaactgctgggggtgggggcatccctgaaacctgtcctccttctgcacccacccccgcacccccgcttcggtgtccctggcgcagtgctgctgagaacagtaaatcccggtaaagccgaggccctggtcttccccagccccctcccgcccctgcccctactgcggtatcctggccggtcctccccactccagctgcttcctccaggaccctttactgatgtgtggccttgagctggtccctgtccccctccggacccccattatgaattgtcagaagagaatgtcaggagacttgctcagcccaggatggtggggagcgaaggcagatgggacagggatggggccagcaggagctcagctaggtgacatgacttcccatgacctttgaatatgtctggggcagcccaggctagggagtagggctgttccatacagttgggcaggtcattcactgcacaagagcacctgggccaggaggcgttgggatggatatagcagtatctctctggacaacggggaacttccatgtaattggcataaaggtgccttcagggttagtggtgaccctggggaagtgaggaagaaagtgctcctggctcgcttcagaagggagggtgaggagcctgggctgggctgggaggatggaggccaggtcctgccgtccacccccgggcccagctcgggtttccctaaatccgactttggacaacacaggcctcagcaggcgcgctgggggcggccagggatcagggttgccaggagcgtggcgctctcctggtgcagcgggtgttaagggggattagggggccagggctgcacatgctgcctctggacgcccccgcagctgcagggctgggggtgatggggtggaggagaagtgggtggatgaccattttctgagccactggtcaccccatcccaggcaaggccaggctagaatttgaggcctggggacagattctgtgggttcctgctgaccctgtgcccccaggctgggcacctcctagaaatgctgcccaggagctgaaagaggcctgcaagctgtgacaggaacttgggtgacaagaaactgaccctggctctccccctccagggaggaggaaggctggtcaagtcggggcggggcaggtagcattgcacctcagcagcggctgggattcgaatccacgtctgtctcactccaaagacattttactttctgtctcttcactgcacctcgggtgtggcggacacatcagttgcactcctctgttcaatcattggtgcacgcagagccaaaccccctccacccctccccaaagggagcccttccttgatgtttaatgcgggtcgtcctgtttgcccctgtcttcccatggcacgtctgctttgtgtacaagctttatttatttatttatttatttatttatttagagacagagtcttgctctgttgcccaggctggaatgcagtggtgcaatctcggctcacagcaaccaccacctcccgggttcacctgattcaccagcctcaacctcccaagtagctgggattacaggtgcgcgccaccatgcctcggtaattttttttgtatttttagtagagatggggtttcaccatgttggccaggctggtctcgaactcctgacctcaagtgacccacctaccttggcctcccaaactactaggatgacaggtgtgaaccactacgcccggccaacaagcatttctagtttatgtacatggctgagccttatcgatctcatcctgacctcccttctgtgatttttgttttccgctcagtcccaggctttgccctgcattgtgtgggctccctgacttctgcctattgcacacgactccttggggtgcggtcaccacgtggccatccaggccccctccttgccaccatgagcagagatggcccctgactcatgagctttggcttaggattttttgactttacggtggtgtagaagttgaaaaacatgcattccgcagaaagcatgcctggagtacccatgtaacccttctgttttgcgttttcagcatggtgttcagtaaaccccatgagatgttcaacgctttattgtaaaataggcttgcgtcaggtgattttgccaactgtagggtaatgtggtctgagcacatttaaggtaggccaggctgtgatgtgcagcaggtcaggcatagtaaatgccttctgacttacgatattttcagcttgcgataggttagccaggatgtcagcgcatctgcactcctgcagtgaatgtgcatgctcccccatggccccatgagagtccttcctgggggtactggagcctgtctgttggtcataggggagactaaaagcacatgccagctgtcctctagaatggggccaccagtcctcctgcattgcagcatgagatgggatactcccacccacagtgcgcctctgtgggcgtggtgctgatggggtgacagtggtgatggtggcagagtggggatgcggatggcaacggtcatggagatgaggcatcagtgatgatggagacaagatggctttgatcgtgccagggggatggtgttggttatggcagcaatggttggccatgacggcggtgagagcagctcccattgtgatggcattattgtggtgccagctaacccaacccaccgagcttctcacgtgccagacactgttcttcagagcactttccacacagcggctccctaaattctcaggacaaggttgtgaagttggtactgtcgtcacgcccattttacagatgggggaccgagaggttcaataactgcccagggatcctccccgagggaggctggtgatgggcttcataattcttgttcattgtgaccactgtggtgatgatgatggcagtgatgatggtgacaggtgactgtggttgggtggttgatggtggcggtggccatgttcatgaaaaacacaggcatgtgggtattggtgacgatggtggtgtttgtcaaccagggtgacagcaatggtgatggcgacacggtgccaacggggagaccatgttgcatggttggtggcagcaatgcccatgtctttgatggtcatagggaaggtggtattggtgatgctggtgacggtgttggcccagccctgatgggcatggatggtgacgcgatggtgaccgagaacctccctttgcagatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctctgcatggttcattttctgatgcccaccgaggagccccagccccgtcccagaggccgctgcccctgagttctgacactgtgtgtttgggaagtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgatggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttccagctacctttgcctgtgtacgttctggggccaaagcagaacggcccgggtggattccgggtggtctaggttggggcagcgctctgacttggatggaggtggcacgcagaccctctttgcttcaaaactctgaggaggcaggtgggtggcggggccgggtggggggacaccaggcactgttggggtttgggacccacctcatccctgggaccctgaggcactgggaggccagggggatgctgtagcctctctgcctgttgcatgctggccatgccagctcagcccccatcttggggcagaaggagcagccatttaaggggcacctactgtgtgccaccctcatctcactgtccccgcagcagccctgtgaggcaggggttatactctaggaggggaaggcacttgccaagggcccatgagccacagacctgggagaccagacccctcagagccctgccctttcctgtctgccccaccacgtc

SEQ ID NO: 15576 - DNA, 97424 bp, Human
atccaggatggtctcgatctcctgaccttgtgatccgcctgcgtcggcctcccaaagtgctgggattacaggcgtgagccaccgcgcccggcccaaacttcttatccttgaaatggcagatattcagtgtcttcctcccaccccatccctcccccttgactgaagccccaagaaagggccatattttgttcactcctttatcccagtgcctagaaaagtacctggcccatggaaggtgctcatagatgtgtcgggtgaaccaatgactgaactaatgtttgctgcatgaatatggccagtatcacaaatcctctagtaacactgcaatacgctgtctcagaacttcgatttctttctattatttgttgcagtgtttatttcttctatttaacttttcaatctgtctgacatttattgtggtgtatatcatgggaggcaaggctgtaaacagatctccagctaaacggctaaacaatttgcagaacaatccatttcctccccattggtttgtgatgtctgcattttcatccacaagagctgggaccaggcccgctcctgtgggccagctgctgcctcgtctgccctcttgttccagaagcccagggctatgctgttcctgaggcagggctgcctagtgattggccacacaggcactggaattagacaatctgccgtgcactttccagctcaaccacttaccatctgggtgactttgaacaaaagaatttgctttttattgttgttgtccaggttggagtgcagtggtgcgatcatagctcactgcagctgctaactcctatgctcaagagaccctcccgcctcagcgtcccgagtagctgggactgcaggcaggcactaccacacccagctaattcttacatttttctgtagacatggggttttgctatattgcccaggctggcctcaaactcccagcctcaaggcatcctcccacctcagcctcccatagtactgggattacaggtgtgagccaccgcacccagcctgaaatttcatttctaagcctcaaagcccatctgtaaaatgggcacaagggtaacgttggcacacgtggtggacgctccgttggtgtcattattacagatcacggccagttgaagcacttccactcatttggcaaacagaagccagacgggcattcaccctgtgcccagtacagtgctgcgcccaagcaggcagtcagtgtccctggctccagccctcctggggtgcagcacagttttgaatgtggaggggaggcagcaggggtggaaacagcccagccaggagcggccgctctcggtgcggggaggaggtgaagtgagaactgagctgcttgggtctcagggaggctctgacttctagagggggcgttcaacattctttagtggggacttttactacttccagaaacctctgcacattggctcttgctggtcccccgggggccacaggaagtgggagctccagatgaagagtcgctggcactttgagggcagggggcagggccttcccctcatcggaatactcttggagcctacttcagtgcctgcattcagctggtgcacaataagtgcttgttactgtgccaatttcagtatgactagggctgtggtaggagcaatgctaggcgatggggaatccgaagacgcacaggagtccaagggttggctgactgcagaccctcatcataagtctagagccggagaagatggggagacgccggcctgcgccctgtgagtctgggcctcagtcttcccatctctgaaatggggaaggggttcctcggccgagcggatcggccgcagaactcggcggagtcgaggggtccaggcccaggaaggacgccgccggggcgccccccgcccctcaagcttgcgtggcggcagcgcgcacgagcgctgggggcggcgcggccccgcggcggggaggggcgggcgcgcgggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggtgagtcgcctggggctggggccgggccggtggggccccgcggcccggagaagggcgggggccgggcggcggggccgtcacccccagccgggccgagggcgggcgcgcgcccacggctccgcgggggagagcgggaggcgggcgcgagtgtggccgcgcggggctgagcgtgtcggcggccgggcgggcgggggcggcgtgtccgcgtgtcccggggtgtgcgcgtccccggcgggtgtgcgtgtgcaccccggagcgtctggtggcgttgttggggtgagtgcgtgcggggacgcgggcatggctccccgctacccacttcccgagtggggacgacgggcggaggagtgtgccgggcgccgcagggagtacgtgcgggtctcagggagtgtgtgtgtgcacgtgtgtgcattccaaagtgatttgtgtgcaagcacatgcgtgagcctagaagggcgaaagtatgcctgtgtgggtgtgagtataacgagtgtgcagggccgtgcgagcgtgtttattactgaggttgaggggccggccccctttgcgcccaccaggcctttgcacagtgatggcccccgagccagggagcccgtggagagagaagcggcctggcatgggctgggggtcggggctgggcctgatccggtgaaccaggggccaggagggcagactcagagcctggctgggcctgacagaggcaaaggtcttagagccaggctgcggcagggccactggcaggaccctctctgcatacacaggctgggcgagcggaggctgtggtgggcccctcggccgggcacccgaggacgtgtgttttcctaaatatcctccaggctctcctgtctttgttcttgtctctctccagccaggcctggggggctgaccctagacttgcctgtgtatgtgggggcctctctgcctgccctgctaagtagacggatcttttgatttatttatacctctcctaggctccaagtgtgaatcccaggacagtaacaaattgatcacagcgggcttgggacaccagcttccgaggtctgtccttgcagttttgactgacaggcttttgtgtgtgtgcgtgctctctaactgttgaaaatctttgcagctgaaagtcttaattgctttaaggcaaactttagaaattccagagctccctagttggtctgacttttccaaattcagcttgccttttttgggggaaaatgtcgccttagtttggtgtacagtacgtgcaggcaggtcttggaggcacgtttaaaaaccctgtcgttaatggaagaagaatttcattgaaagggacgcagagccgtctggaagcgcctgccccggactcagcgagtttggactcagcgagtttgagcttaccgaatgaactttggacgtcttcttttagcaaacaaaacctggaaggaagcaaaaaagacccacattctttttcttttttctcctgaaaatgaaaaaaagaaaacaccttctgggtttgctggaaatgccccctctccttcccccatcaaggccaagccctcgctgcgtcccccacccccaaataaaatatgcctgtggggagccgtggaatgagtcactccctggcagagagcctgacgggcaaacatttgggaaggttcttgcctaacttcccagaagaaaaggcccaggatttaaaatggtccctgtggtttgtcagcctctgctgtcccgtctgcttcggaaatgactaaaaagtagtttgtatctccacaaaataaagtctcagactgaaggccttagacccaggttggtctggatttagagctgtttgggtttccagaaatggagcgcctggctttaactggtggcatttctggtgggtttgaacaagggcagaggagggaaatggggaggaagttcccttttgcggagcagaaggggctgtgtgctgggagccgttctagggggtgtgaatctcccgttggtcttctgtgacagaaaatgcttttggttttgtgcacaaggaaactgaggcacacgggggtcaagcctgtgtcctggggcagctgagaggaggtgggggcagaatccgaagtcacctgcccagcctcacagcctttcctctttccattgcacttgggatatggtatttgactggctaaggtgcacagacctagtgctgagtactttagcacacatccgttcattttctgctcatcgtagatagggtttattatccccatttcacaaatgataaaactgaggttcagagacatgacttgcataatttcattaaagtagcaccacgatagatggtccccatttatttttatttatttatttatttatttttgagacagagtctcactctgttgcccaggctggagtacagtggcgcaatctcagctccctgcaccctctgcctcctgggttcaagtgagcctcctgcctcagcctcctcctgagtagctgggattataggcaggtgccaccacgcccagataatttttgtatttttagtagagatggggtttcactgtgttggccagccaggctggtctcgaactcctgacctcaggtgatccgcccgccttggcctcccaaagtgctggaattacaggcatgagccaccatgcccggccatgtccccatttactgaggatatactgtgtgctaggtctggtgctgtattttacccagtccactcaccaacactaagatggaagctgtcacgatgcccatttacagatgaggaaactggggcacagagagatgagagaatgcgccaaagaccatgtgctaatacgcagcagagctggatttgaacccaggcttgtctgagcagagcccatggtctccccactgtactaggaaggtagcaggcactgtgggctggatgcctggcctgtgctgaggttcagtgtcgttttcctgatcttacagagagggaggttaagtaacttgggcagggtcataaacccacaaatggcagagtcgggattcgaacccatgtctctgattccagagttcctcaccttaaaccacatctggctgcctttgtcgtgctttgctcctgttgcatgctgcaaagccaagtaggttaagacaggctaggttcctgcagggctgggttgcccgagacctgggagaggtcttccagaaggcactgctggccttcctcgcccagggccagagctactggagagaaagggctgctgttcacattttttcttttctttaagtgccccagatacttttcataagggaagtgtcaaaacaattgtcaaaaggagaagaatatttccttcctcttctcaggctagaccaagcaagggagttggagggtggagagtggagggacctggtgaatcatccaagattaaatacgggcaggcactgccaggcttgtgtggagatgaggctgggacactgttcgcaggaagagtccggtgttctggccccctgatgtcaccttcacgggcctgactcacagtcctaaatatctgacagcgagatcgcttgtaggtaggcttcttgtcacttgtcatttaagtcccctgcctgccttttttccctgctcatttccatttcgatcacggcttctactacatgtgcttgaaatgaatgttgtgtgtgaggacctgtgtggtttgggccatgttgtgcccccctgccagtgtccttcggtgttgaaaggaaaaggtatttctctcccttccatgtatgttctgcaaattgacgaacatttgcaaattgctttgagatgcgttaatttaaggtgtgaaataatagatcttgtgcgaaggctcagccacatttctggcattgatggatttttctcccgtctggcctgtgatttggggaggtaaaaatagtccttttttccacatttttatctttttttttttttgctgacatcattcttaggaagtggtgtgcacatgccgtggaactttacatggaacatggagctctggggagcaggagtgctcttggagtgaggggtggtctgcggtggcccaggcaccccctggctgtccgtgaaatggctttgaaatgagcaggcactgttgagggcctcagtggctttttggtatttggctgtcttttcacttatgactcttgggtaatggcaagataacttttggggaaaatgttagtttaaaaagaaaaaaaatcaggccagcactttcactcattcctgtctgagctggtcccttcctttggccaaagctgaactaaaccaatggccttctcagactcgacttccagacagaggagccgacattggggcaaatcagttggtggtgtaatttcctgtgatgttaactttgggaacttgaacttggagtgggagctagcattttgacatgtgtccctctaacaggacttgcttgtgtggaaacagacccccacatacatggctgcgccattgtctccaattctggatttttccacagatgacttctcgggtgatctggtggtaaaggcacaggtcttctagccaggccttcttggcctccagcaagggcaggatcacagcaccccaccagacctgactggccaccaccgctgtagctgtggctgggcgagtgggggggccatgggaattgaaagatggggtggccgagatctgaaatgcattcagttgcagtggcctggatctgcacggagccgttctttctttctcttagacatctgcatggtggtgacctcatagaattctaagaaaaaaggggctttatgtaggaattccatagagtgtgaaggaatttggacaggggaagggggagggaagttgccattcagagcctgcagtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcaggtgagtggcagtatgggaattagtccacaggccccttctcgaatgcctgccctctcttgttccttgtcctcaacgtctttgaaacttgggcttgttgggaagacacctgcaaaaggatggatgcacatgaccttcagctctaatgaatcaagctgctgatgaggaattcactgggctcccaatccagagagcttcgcacacacccactggggttgagacgagcactgggtttatttattgtggacttttggagtctgaaggactcttgccacccatctgtttcacggaacagaacctgaggctcagagggagcaaggcgctcccccacagccgcattgagagcctgagcctgggcacccgatggagtgaatgaggctggagtcccagacctgcctctcatgagcacgtcgcccactgagcctcagcgtcatcatctggaaaacagggataatattatgacctcagaagcttcgggggaggaagtaagtgaaataatgcatttcagatgctcagcgccttttaagtgcttgatgctcattccccaagattacatgagagacatggaaaatctttaatgaccaaggacccacccagggtcactcagccgggacccttggtccgtggcccagagtgtctccagtgcccctgcattgaggccctaaacaaggccagaagcaggtgccggggacccctctggattccaccagagcaccttcctaggatcatggctcccaaaacggaagggaaggagacagcgcagtttgcaaagaggcaggatttaagcaccagggtggccctgtggcgcctcaggaaaatgtttgcctgtcagtatctgctctcgttcccacctgtccccacaaagcgaggccataagtcctcggcgtggcattggagggtctctgaaggccctgagagctgtgtcagccacggtgtgttatgaagcaaggcagatgttttgttaattatttacacagcgtcggccccgcagaggactgcgctgacaggagcggctgtcacaggcctggccgtggggcagaagtgagcagccgtcttcccctggcagtcctcctgaaaaggtctgcatggcaaggcctgagggagtcctgcacattttatgcccccgccccccaaagccatttgggtttcccttaaactggcttgttttcctgagccggtggagagatccttgtcctccggaagtggctatcgctctggggcggcttctctgccagctcgtcacaccctagacccagctgtagtctgtgtggtgggagagggtgtcaccaggctctggaggtccactcctctgtagtcacctcatgcaaggagggcttcacaggggcccagcctctactccctcatccggaaaacgggccagtaacaccaggcaccagccccgtgatcctcaggcacccttgggggtgatctgccttagaaattcaactttaggattagaattctgctaagaggtaccatgtgacaaaaaaggtagtgtaaaaatcacaaagaccaggacaggctcatgcctataatcccagcactttgagaggccgaggcgggcagatcacttgaggtcaggagtttgagaccagcccagccaacatggcaaaaccccatcgctactaaaaatacgaaaaattagctgggcgtggtggtggacacctttaatcccagctactcgggagcctgaggagcctgaggcgtgagaatcacttgaacctgggagacagaggctgcagtgagctgagattgtgccactgcactccagcctaggcaacagagcgagactctgtatcaaaaaaaaaaaaaaaaaaaaaaaaagagttctgcaaagaatggcacctggcatcagagctttccctgaaaggccactaaggatgaggaacgtgagctccggggaggcgaagggggcaaagccacctgcctgttgcctgttttacataaggaggttttgcataggagtcattttaagatacatgaagtagccagaatagataaatccacatagacctaaagcagattggtggtttccagggcctttggggaggggagactggggagcgactgattaagggacatgggtttttattggggtgacgcagacgttttggaaccggatgaaggtggtggttgcacaacattgtgattgtaatacatcccatccagcggtttgctttaaagtggttaaatatatctgagaaaaatgttaaacataaaagttttggccaggcacggtggctcacgcctgtaatcccagcactttgggaggccgaggcaggcggatcacgagctcaggagtttgagaccagcctgaccaatatggtgaaaccccatctctactaaaaatacaaaaattagctgggcgtggtggcgtgtgcctgtaatcccagctactcaggaggctgaggcaggagaatcacttgaacccaggaggcggaggttgcagtgagccgagatggcgccactgcactccagcttgggcaatagagtgagactccgtctcaaaaaaaaaaagacaagtttgtcttgctttaaaaaaaaaaatacctctccttttacagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggctggtgtgtggcacgttatctcattctttcatgacgtatgtccggatggaagtcctgggtcaggcattgtgctgggagcccacacgaagaccctctaatggccccacccattggcctctcaccacctggtggggacagaggctgtcacaaccccttcttaggtgctcttgatcaatttgcaggtggcattttttgggatgtagtctctggggaagtaggagagcttccggcagtgaggggtgtttgaacccacctggagggagacgtggggtttgccagagggctgagagggctggggtgaagggcaggtagaccccaaggtggagaggcaggtggggccggtgggtgagaggtggggctgtggaacttcctcctgcttctttggcctttgctcctgtcggtagatggccttaccaggcacttactgtgggccatgttctaatctaacccttaacctgagggaactcacttcatcctcccagtgatgccgtgatgtgggtatcgttctgcccattttatagatgaggaaacagagacccagagagtccaggatctgtggtgcttgacgagcatcagcctgagtgctgtgaggacacccacagcatgggggtctgagctgaaaattggaggacagaggctgccctccggaagtgaccaggatgtgccctcaggaagtgaccagctgcccagctcaggacctgtgtgagggcccccaggcagctggaaggaacagtgtgcacccaggtaccatgccagggcccctgagcatccgtcttgtcatcgcatagttgtaacctgcctcacagactgaacatgcactctagaaggggatgggacttggtctgtggaccacaacagtgttctccatggccagcattgtgcctgacacataggaggagctcaattaatatttgttgagtgaatgggaagttttaagtaggcacgcggccggatccttggagaatgtttatatggagtgaacgaatctgttagcaaacgttcctcactcccctcagtgggctgtgcagggctgtattgagctgagctggcccttccctgggagaagaggtttcttagagaaatgctcatcctcgaattattccaatgaggaggaacctaagcccagaagggctctacctcccagagttacaggctctccttcctatgccccttccctgccgaggcagctcccacatgtctgcataggagggctttgggttggaatgggtcagtgctgtgtcttaaagctgcattttctaccaagcacacactttgtttagagggcatatcttttggggttgctttgaggaaaggctaaccaagccacctctgagcacagacatgactttttggcaaatgagcaggaccccagattacaccccatcttagaaagtaggaaacccagcattgaaagaggaaagattctgcagctgatgtggccttggcgggccaccagcgtgggtgcccagatggcaggatcactgggcaccacatggcacacagaagagagcaaaggagagggagtccgcccctgggcttggcaggtccggtcgagtccgcctggattcagttacaacaggacctcgagtgggcacggcgtgccggactgagtcagtgtgtgtacatttcctttgttcgtctcctccgggaatgtagtggccttttgtgtgtgttttaaatgccagcctccttacctaacccaagaggaaatgaggactgggtttttgtctgtgcagacgctgggacaagtgtgggagccgcctgctcttggagccagcctagtggtgacagcgtggcatttggaaaacattctgtggttttctccaaggggtgatgggcacaccaggtgctgggccgcccctgagctggccactgggaccctgaaatgaggaagccctgtgaccaggtttcatgatgccattcagcaagggacggctgagcaccacatgccttcttggcccctggggaaacacacaggaatcagatgaggtccctgccccgtcttcctggggaaacatgcagagaaaatacttgtactctgagctaacacctttcactcgcacagacctttatggtgttctgtgtcttcagacattgatcacctgtaggtgagacacatcatggccccactttccaaactcccaaacgggctgtgatctgtagaagtatttagtgccattcagggacaggagagatggtttggaagatgctgtctgctgtgcgaagtctctggatgctcaaatggcttatggggtggcatctttgaaattacccagtcctgaaaatttcaggacatatggtcactgtgatgtgctaatgttagcaattgagatatttaatgacccagaaaaaccccttttcctacccagtgcaggttactggagagcctttatttctcaggaggagggtcttacacagtgtaatttggaccagcagatagggagtcattatccctcattcatttattagctaattaagtggtttatctggtcacacatttactccttcaattgccattcatccagcactgtttgctgatgtacctggcctggtgctgggtactgggggtggaatgaaacagaacaaatatgactgagtccctactgtgtgccagcccatagggtgtgctgtgtgccacaggtgaatgcattcacttcccagtggacatttaacaaccacctactgtgtgcagactcatggagatgcagaaatgcaaatggcacagtccgtagtggtttggacacttgtggtgttttgatggggtctttagtcctggctctctctctgcttgctgtgatatacccagtcagccactgttcacaggccacgtggtgacgtccccagaatgaaccagaaacaatccagatgccccaggaaccgacgtgagaacaaggcatccccttcacacgttgtgtctcagttcagcgtcttgccaccacccagcattttgagacagaatgtgagatcgcgtggttggctaaatacataaatattttatgtctcgatattctgaaaatgaagcccaaatgcacagaactgcagcacatcagtgctatagatcatatgttataataatctgatgacatgttgtttaaatatttatggactgatgcgacatgacaatgggggagagaggaggctcggagcagagtctcggcagatgcgggaaggagggagcagattcctgtgatcccgagaagcgtcacaggacacctgggtttctgatgtgatgttttggggttttatgacaaaaacagtggctgacatttattgagcgcttgccgagtgctgtacccttcactgataccatgtcattgaatcatcacagcattcccagatggtggggctcttattaaccccaagttacagaggggaaactgaagcccagggcaagtcagtggtccaccccagaccccacagctagtgagtggcccaggagcaaatccaggctgaccccattctgcattctagctcttaattactgtgccgtgctactctaggggtgacaggtcatatctgaaaaccccccacccctgcctgggtgaccccttgcttggtgctaactggactttttttttttttgagatggagtttcactcttgtcacccaggctggagtgcaatggcacgatcttggcttaccgcaacctctgcctcccgggttcaagcaattctcctgccgcagcctcccgagtagctgggattacaggcacccaccaccacgcccggctaatttttttttgtatttttagtagagatgggtttcaccatgttggccaggctggtctcgagtgatccgcctgcctcggtggactttctaaatcacaggaaaggaaggtgatgtctgtaaaatgtcggatgggattggaaggcacaaggaatgaatagcttaggaggggcagggagtcgtgtggaagggccactgcagcccggtgcctggcacatagtaggtgctcaggaaatgtggttcttgagcctctgcccttctctttgttgttggttttgcagagtcattaagggagtttactgcagactgtcccccatataagtgtcctgtggcccctgagcctttgcctcagcctctctctctccctgcagtgccctgggaggaatcaactgacagccctttcagtctcccacagtccagccagttaaatcaaggtgttccccttttatagaggagtctcctagagccaaccgcagcatccctgcctttgggagccacctggaatgtgccagctgcagtagccgttccttccacgccccccccccatgctgtctgtggggcttgccactgagtgctccatctccccatgtgctccatcccccggcatctgctgccattggtcctgcctgttgcgttacttctctgtgccctggagcccctcaagcacagaggcctcgaaaggttgatcagacatcctcagcacctggagcggggcctggcacacaagacggcaatgaacggccaaccctagaagttcaccccacaagacctgcagggcgggggctgagtgtccaagaagcctcttgggaagggatggtcttagacctagtggtgtcttcccattctgcagaggcctagggatgtccccaggtccccagagtgggaggggaagggtcagaagtccatggaaataaaacacagggccagctacaaaatttgtggggcccagtgcaaaatgaagatgcaagttcccttgttcaaaaagcagtaaaaaaaaaacacaaaagttttttcctttcctttgcaatctctttccatctgtcatgatgttttttgtttgctatttaatgtctcactccctggacacaagatactttcagggtgagtgcagacctcacaggtgtgggcacacctgcccccgaccctcctgcctgcatccgggcccctgctgcaggtaacgggtggcagaggttgctgggtgcgggagcaggcagctgaatacccgtcctggggaggcagctgagactctgtgctgccagcatgtgctccattattccaccagactccacttaacacagattcaaagatgacatgaagcatttcaggacagtgaaagcacagcatgaagccctacgcttggggctcccttcttagggcagggccaggtcacctggacatgaagccagcctgatgggaggggccatagcacccacacacacatttcacacagagcaagggccttatgttggttctctccacagagctggggccagatctgatttgaagggaaagttctgtgttaagcactgtctgcagactgctggcccagcaggttagtcggccagccaggggctctccctcttcatccggagcctctggtgccaaagacacaccatggtcagccctccctgacttaatctctcacaccattgccagagattgttgcagtaacaaacccaacccctctgacttccgctccttgagtgacaagggtcagaaatcgagtggcgcggttgccaaccttctcactcaggaacaacgccaaacacgtggtgccccagagatcagagagggtgaggagcttggattccaccagctgtcacgctgttcccagccccaaaatggggaggctcagcacccacagggagtgacgtctggttactctgaaaacatggacaaggaggctcaggtgaggggtacttacttagtacccactgtgcaccggagacccggccaagtactttccgtgtgttgccttcgttaatcctcgtgacaactttgagctgatcctgtttttcagatgaagttaactgaggctcagagaatgaagctgccagtccaaagccataaaccacacactttggaaactgagatttgaacccaggcccggctggccccagagttagtgctctttgcacacgaatcccaggcacactggctggctgaggtccctccctggctgggcctcttgcccccaccgtctgctgcatctgcatctgcaggacaggggccagacctcagcgctgctgcctgtccactcctgcccctgagcagtccatccttgttcttggcagggagcagatctcagggccacagctccagcttttctcctgcaaggcctggccagctctgtggctgtacttgtgcccagagagacaggtggcagcggcagagttaggcacacctggccgtgagccacacccaccttgtgctccccgtgtctcctgggcttgttaccgcccactcaggcctctgttttcccatttgtggagcaaggggtaatagcagatcctgtctctggggcagttttcccaatctattgtggtaagggtgtatagtcctcagttccacgccaggcccagaagaggcctttgatactctgtgttgatggtaaacgacatggtatggggtgagctcggagcttggtggcccctgtgacgctctggggagcgcttccccaggccacagggcaggctctcagtccagagctgccctccctaaggaattcatcccttccttgttttctttgttcattcatttcatcccacagatccaggcgctctgctgagatacagtaatgagccccaggcatgaagtccctgcctgcacagggctggtgctgtggttcctaaacaagaaaccggtgcagggttcctggccaggcagtgctggggagaggtagctgggacagcgtggtggcccatggctgccacaaagaatggagttccttcaatctctttcttccattaaagggcaatccctggggatttaacatgctgcctttcgtgtgaggtcccagcactcccagcgtcctgggaaggcctcatcgggctttgctttgcttcaaggtgtctttgagaaatcagtttttccagttgcaatgtgggagttttccccaggctctcctgagactcacaaccgctccccctaacgctgctggtcatggagacccacctgggccaggccctggtcacatgtgatcgcatcgacctctcttggtgaccttgagagtcaggtcctattaattcattttacagatgaggaaagggaggctgagtgaggctgcatcatttgctgaggagcacagtgtgcccactgccaagtcaggatttgaacccacgcccgtggcttccagaccacactatcggaaccactctgccctagtgtgaatggatgtttttttaattcttggcagcagaaaaaccaaagattctgctcaaagcagtagactctcagcggcccatgtgtcagggctgtgctgggtgctgcaggagagctctgcagagaagaatagagacagactgttggtgctaaaattggcctgaaaaatgaccatttccgcgtgagccaggattgcgttgactccttgctccaaggctgtgaggtgtgtggggttaggttcatgtgacagatgaggaagtggaggctcagagaggctgtgtggcttgccaaggtcacacagccccgggcggccttattccacatccacctgctctgtctgccatcatccatggtggtctccggactagctttggcctccccaacatcctgcatttggataaactgaggcctaaagaacaattcagggcttgatcccgaatgggggaggggacggaaccctttgcatgcttgtggaaatggacactcattccacagcgaaactgccttcaaaatgccactgattctcagggcaggagaagacttaagaaatgacagcgggcagtcagggcacgtgtgtctgtgacagcagaggggcccgtatccacccttcctgggaccgacagccagggtgatggggttttatagcatctggaacaggcaagccttttataagaaaatgtttccaaagttgtcccgtcccaccgttggcaagcagtccttaaacggcaaagaaacagccgtgctctgcattcacgaaatggtgagctggcatttaggccatttatttaaagcgggagttgaggaggctaaagacttcagttctgagtggcggctcgcagcctcactgcagcaggggagcgtaatcttcagggttttcttcccatttacgggtttttttgttgttgttgtatatttgtaaaatgaggcttctgctggcaaaagcaggttttagcgagtgcggcggctcttccaggacctaataaggccccaacggagggtgaattccagcaacactttccttccccacatggcccccccattccgtcttgcctcatacactttgggcacagggtaccattcatcttgcttcccattaatggaattaccgccatcacttctgtgggatgagatgggccctttggaactgtcttggggacagaggcaggattggccgccaggcagttttgcttagaggggaagggaaagaaagagagggagagaaaactcttacaaatggatgcttccttgggtggtaaagatccttggccatggaggacagaggccgcagggcccatccaatctgcttcctgcgcatgtcccgtgtgagcctcgctgtggcagggcatgtgatggccccagtggcagatgtgaacggggcttgacacctgtgtaccacagccccttgacttcagaagaagggaaggagggacccagcatttatgggctgctgacagatgcctggcactgtgctggccaaaatttgggaagtggtatctctgtcctcatttttagatgaaacagcagagtcccagagagtgtagacacttgctttgagtcacacagctcatgagcagtagcactgaagtttgaacctcagtctgtccattttcgtggaggaccagcagtgcccctccttgaggctccagaagcagcagagtgtggactcacagtccgggtacctgtcagcagcctgtcccagcatcacctcccaattccccaagaaagtgagcagacatctggagggtttttgctttcatgtaagaatgctgatcgaggacaatgctgaatatcatgtattccacctggacatctgatagaatttcaggggtctgggatcctgagaatgagggagggaggttgggagctgaccggtctgacgcactgtgcttgccattctgcatgtccatttgtagcaaggctggcaatcattgtcctctccagtgccggctctgatagattgataggggctgcccgagatgccatgttgagaaggctttggagactggcattgattagcaatgtctgctgtgtgcacaggaatgaaaagatggatgtgaaaaggaccgacctaacttagtacaattcttaacctgagcagggaccccaggggcacgagctctgcttagttcttgtgattagttcatcgtgtgcctcaccacacttccatcccagtaaactccaggagggtgagactgtgcacagcacacagtgggaattccacagataacagaaggaaggattgatgaaggctctgcagcccccaaagagccaacagttggaatcctacagtgaatgtttttaaaaacgtaattttaaacttctagggatgagatgtaggtgcccacttatttaaaccagggccatttcatccacgtcactaacttgccggatgtctttgagtcatggtttcacctgcctgagcctcggtttcctcatcttcactcccagcactgtggaggggtgacctggttgatgacggtcatggagcccagaacccatgggtaacggggtcagcattcagaagtgtcagctccagctgcctgcccccgcctgccgggccctgtcctctgccaggcggagctcctggttctctgggtctgtaatgctttccttctcacttctcagacatcactgcttctggggagtctcctctgacctcagcacactgcttagaaacccctgcttggtgcctccatagccccttctgcatcttccccaacatggccccccaccctgtgaggcccactaatggccagtcccctgccccaggatcccctccagggctaggactgagccactttcctctgtggtcccagtgctcagcccagggcctggcctggcaaaggcctcggtgacggtaatgaggggagggagcaatgcacccttcgtttgttcctcaggcctgtggccatggggacagctgagatgctgagaccactgtgtccaaagcccaggccttttctggggacagataggtcagcgggacggatggaaccagctctgtgactcacatacccattgtgcctgctgcggtgatcctttaaacgacagttaggtttgatcctgcgggaggtgggtgtttggaaaggttttgagcaggggagtggcccccctgaagcagagtgtggcccgtggaggctggggggctgggaggcggctgtgaacttcaggagagaggagggggaacggggctgtcctggggagagtggggagaagtggggagcagcctggaacagtgccgggcacctggtgtccacagcctgagctcctacctggagacccctggatcagggagtaaagaattctgggctgcaagtcagaagaaatgctccccaggggcttcagtggctccagagtctcaggaatcatctctggatgggtgactggggcaagggtgggctggggccctggtcttagtctcctcatcagtcaaggagggcaatgtgctttttgcccttgactctcctctgaccctggcccttcatacctggatctggcttgggagcagggtgaggccgaggcccacagaagccatagggtcagcctaagagcaagagtggaaaaagaaaaatcatgaagcaataatgagcccgtggtacatcgaaggggccattgaatccccgtggactcaggacgacagtggctggaacagtggttgtctatgtgtggctggagtgtgtgcagaggggccagtgcttgagcctgaatcttcacagcccctcctccatacatgcaaatcctaacagtatgttattattgatatgtaaatattagctattagctttttaaacaataattcctcctcctattgctattgtggctcgttcatcagagcacccttcagatcagtaggggttggccaggtggcgaaggcctgcagttagagcatggggagactgcgtgagcaggtgcagaggtgggaaacagcagttgcaggaaccataagtggctccgtggagctgacgtggtggaggacagacatcacctgggcttgggcttgatgggtcaaggggtcttaggtgctaagctcaggagggatggcaacccagaaaccttgaaggtggataaggaaggggagatggggtcttaggaatatgtgtctggtggcgcgtgtggaaaatgacggtgctaaggctgggaggacttagaggccagtggggaggcccaggtgctgatgccactgtggacattcctgagcctctcagctacctgaggccgcacttccacccaaaaagagtccttggctgggccgggtgtggtggctcacacctgtaattccagcactttgggaggccaaggcaggtggattgcttgaggccaggagctcgaaaccagcctggccaacatggtgaaatcccacctctactaaaaataacaaaaattaaccaggcatggtggcacacgcctgtaatcccagctacttgggaggctgaggcaggagaatctcttgaacatgggaggcggaggttgcagtgagccgagcttgtgccattgcactccaacctgggcaagagagtgaggctccatctcaaaaacaaaacaaagaatcctcagctctttctcccatcccaccaccttctcctaccctttcctgctgggtgttggggcagcggagggctctccccttggcaccctcagcctctctcggctttcctgtgaaaaaccaggccgatgcctgccgacttgtgagaataaatgataaaatctgtgacgctcccagcactgcctggggagaggaaggaaagtgttgtcttccctaaattcctatttctgcgtgtcgtttattctcttccctgtcagagaagttgttttgcttcctggggacgagagaggcccgcgttcacgggagcgcgcccgcaggccccatccaggcaggtcggcggccacggaattcatttgtatccccaatttccaggctgcctcgtgaatctgcaagagccctgctcctcatgtgctgtggagagtgcatcgtgttgtccctgtgactgatttctgatcctccctgcatttatttgtttatttgggtctgagaagtccaaagtgaagctgtgagaaggggcgcctttgagttttaatacgggatgcaccatcatataaggacactttggtcaacagcagactgcgtatgtgacgttggtcccataagattataatgccatcttttgactgtaccttttccacgtgtaaacacacaaatactgaccatttcattactgtcgactgcagtactcggtacaggaccatgcggtacaggtgtgtagcccaggagtgacaggcgacaccctatcgcctaggtgtgggggaggcgagaccgtctgggtttgtgtaagtcaactccaagacgttcacacagtgacaaaatcgcctcgtcatgcatttctcagagtgtgtccctgtcgctaagcgatgtgtgactgtttatatctgtggtactttgtaggcgttgggggcatgggctgggtttgtaggttcccctaggtgagcagtagtgtcccaggcattgaggagggctgtttccaggtctgtccgggtgtcgttttccgtggaggagaagttgctcaagaagatgagcccaggctagcccacaagccctcaccccctcgcagacccaggtggctgcaggaggattctagaggagactgggttctgcccgccaacagggggctcagccacacccccccacccctggcccaccataggacttagtgcccacttgggatgcggtcagaatatttttaggttgaatgggcgcatgagggtggggagacgcatgcgtcagataccggctggatgacttcatgtatgttggttgacacattatacagctggggagactgagactcagagaggctgagggtcttggctaagatgcccagcaaagaagtcttcataccacatctgactccccgctcccttgagaattcccgtcacctagagcacccgtcccagcccctgccgcagtgctggggaggatcagtggagaccagggtggggggaccaagcacgatctcagacctcctgtgtaccggggcactttgcctacacagtctcatcttcagtagatctctttcctggttttctgatcacaaaagtgaggcttagagaggtgatcaatttgggcgaagtttcccagcaaataggtggagtgtcccatatttcaattctggcctggcctggagaggatggggggcttcaacctgtcttggtgggatagcctgggctgtgataccggaggcatcactttcccaccaagaaagagcaggagggtctttatgggggcaaacagggcagggagctccccctcggacccctgggaaacatggggctagattgggcccgacaccagcccagtccctttgcagcctactccagcctttctcttccctttttttttttttttttttgagacggagtctcactctgtcacccaggctggagtgcagtggcacgatctcggctcactgcaacctctgctccccgggttcaagcgattctcctgcctcagccacccgagtagctgggactgcaggcacacaccacaacgcctggctaatttttgtatttttagtagaggcaggggtttcaccatgttggccaggctggtctcgaactcctgacctcaagtgatttgcctgcctcggcctcccaaagtgctgggattacatgcgtgagccacgcgcctggcccagcctttctctttctgacttcacttgccccacctgtgcagtgggaggacaggagaacccctttgtctgttgagtgctgattatgtgccaaggaatttgctgcatgatctgatctgatggccccagtgactctttgaaacccggccccttattggcaccacccagtcactccctggctgcgtttccctcaaggcacgtatcgctgtctgaaatgaccatgtctgttcactctcatgtctgtgtctacctcccaaccacgcaaaacctgtgggaggggaaggccttctctctcttgtccactcctgtgtccccaacccctcggacagcacatggcttcacaagcttctcaagaaatgcttggcaaatgatggcagagtgggttaaccctggtgttctcaaaaagggaatggaggcccacagagggcaggcccatccctgggtcacactgccagggcaggattggagcccctgcctgtccagggtcagctggggcctctctcactgaccagctttgagcctggaattccaggtgtgcctggctgtgtccttgcaggttcacaccgcccaaagaaacttccagtccacacttgtggctttggatcagctcagaaaaagtgtgtcctgtgactgctcgaggaatctgggcatttagcccagaaaagagtgtgtttcctggcttcctgagaactggggcccaccctgcccctggtctaggcgtgcagaacaggagggaggggagttgaaatcggggcctggaagggtacggcgtcagaccttatcatctgagtgaggcttgccgctcacgctgagactgtcccagccgagcactccaggagagggtatccccaccattggagcgtccttagagatggcagcagcgcctggagttgctggagaagaaacattcctcacgctcatgcgaatgtttccctgggctgctgtcccagcactgggtaccgtggggcagacatgggtgtgacgttttccaagcacgaggtgaccagtgtccattgggtcatcaggcctccagggccacatgtttggaaagctattcctggagcaccaggcatctggcacctcgctctgtggctaggcacgggtttatgaggggaccctgcagagagctggggtcctcagccttgacatttgcacattgtgtataatttcacgctttgctttgcttttttctcttcatttttttctttttttgagacagggtcttgctctgttgcccaggctggagggtagtgtcgtgatctcggctcactgcagccttgacttcctgggctcaagggatcctcccacctcagcctcccaagcagctggtgctacaggtgcatgccaccacagctaatttttgtattttttgtggagatggggtttctccacatgttggccaggctggtctcgaactcctgacctcaggtgatccacccacctcagcctcacaaagcgcttttgtttttcttgagaaagatcagagcttccctgctgcatctcccgcttttcgcttgtgttttcttttcttcctcaccagcaggctgcctggtgactggcctgggggcctcttccctcagaccaggaaatcacccagtactccgagagtgttcactagaattaccctcatgttcactggaatatactggtcagatttctgagagggagaccccctttttgtactcataggagaatggaggaggccggccatgcttctcctcagccacgattgaaaaagtcacctagcacagtggcctgagtccactggttcccaaatcccagacccaggccaggcctagggccgtgtgaagtcttccgcggacccacggtgaaataagaaaaggaaggcctggcttggcatagctactttccatgtcagctgttttttcttttttttttttttttttttttttttttttggaggcagaatctcactctgtcgcccagactggagtgcagtggtgcgatcccagctcactgcaagctccacctccagggttgaagtgattctcctgcttcagcctcctgagtagctgggattacaggtgcctgccaccacacccagctaattttgtattttagtagagacagggttttaccatgctagccaggctgatctcgaactcccgacctcaggtgatctgcctacctcggcctcccaaagtgctgggattacaggcgtaagccaccacacccggcctgtcctttcttttatgaaagatggtgatactaggtggacgttttattttagatgccagaaaactctggcaacctatgtctatcttcaaaatgtgggagaggctgtccaggcctgtgacacctccaggcccggaagccattgatgtacttctgtaccccagacacagaagtggagcccggggcagactttgatgcctcaagaacctctgagtcatggccacacgtgagcccccggctctgccctggtgtgcggtggggcgtattggtttcctagggatattataacaaattactgcaaactgggtgcttgaaaacaatagaaattcattctctcttggagaatcctggaggcgtgatgcctgaaatcaggctggtggtaggctcagttcccgtggaggctctgacaaagcacctgccgtgcctttttctggcttctggcaggcgctagccaccctccttgttccttgttccgtgttccgtggctcgtctacacatccctccagtgctcgcctctgtcgccacatggccttcttccttgtgcgtctgtctctgtgtccatccctcatagaaagacacccgtcattgaatttgggccaccctaatcccatgtgaccccagcttaacttgattagtatctccaagtaagggcctatgccccagttccagatagacaagggtttggggggaacattactctgggggcgtaagggatgaggagggcaggtccagggagcctgccctcattcccaggaggagacaggagaccaaggagcagagtctggcgggggaacgctgtcaccacagcaagggccaggctggggccacagggggtgggtcagacacgcccactgaatactcaggggcacgggagggccgggatccccctgactctctgcatcccagattcattcctacgctttcatacaggccccaaagacaagtgctgagtagatctgggtcttcagcacgatgttttttaaaaacaggcttgcagcgtttggtcctttggtggcaccagccaggaccactgagggctgagaacgtctcagcgcccagcataggccgccagccctggctctgctcttttgggttagagagcggcccctcccagtaatgacagggcccgccattcccggcagcgcccaccagcacagcctcccccgctttgtggacaaagggcagcctgtggggcaggaaggagggaatccagcctcccctgttcccccagaggcctttatctattttggcaaaggccctgtgatcagacgtttccgccctgacaactccctgccaagtgatctcaagcaagggagtcccagagccctgctgagccccacttctctcctgtgaagtaggaggcacagttccagccctgaccctctcaggaaggctggggatgacaaggcaaacccttcccgtgcctagcccagggcctggcacatagtaggtgctcagtcaatactgaatgagagagagcatcttggagcccagaacgtaaatttcatgccactcctgcgacggagcctcagtggggcctcttgggaaggagaatctataggcatttccttccccacgtcctaggacacagttagctgagacgaccgggcaggggtggggaagttgagtgcacgggtgtagcactggacggaggacagaggctgctaagctgcatctcaggcattgattggcattgaggaaaacccacctagacttggtatcgcgggagggagggtcatgtgcagggagccctggaagggagcctggagagctgggtgccagccctggctctgcaccccttaccagccatgtgcaggtcatggcagtgccctgtggatcctacttcctgagcctcccctctgcaggcttgatgccactgctgtcatttcggcctctatcccacaactcgcacagggcttgcctcacctttaggcctttgcacgtgccatgccctctgcctggagtgccctgcccctattcctccactcagagctgcttcccgttccgaggaaaaatcccatgccccaggtagactgcacgcacattttcttgtgtttccacaccctgctttgcagagcagcgggcaccctggttgtagtttaagggacgcctgagagccccattgaggatggagattggtcccccttgcctggcacacgcttggtgcccagcacttgtgtgtccattgagtgagcaaataatggaatgtctggaggcatgtgacgcctctgctgtgtggcttggtttccccatctttaaaataccagatgtgggccaggcgcagtggctctcgcctataatcccagcactttgggaggctgaggcgggaggatcacctgaggttgggaattcgagaccagcctggccaacatgttgaaaccctgtctctactaaaaatacaaaaattagccaggtgtggtggtgcatgtctgtaatcccagctacttgggaggctgagacacgataattgcttgaactagggaggcggaggttgcagtgatccaagatggcaccactgcactccatactgggcgaagaccgagactccgtctctaagtaaataaataaaataaaatactggatgtggactgatggagtccttggggatctggtgaaacatgaggcctcaagtgaacggactcgggtctttcctgctcccaggagtggaatgggagcgtggcagcgaccacgcacacgtttgtttaatgattatccaatgttgacccaaaactatgagcaaagctccggggattttctgggcgttcagcacaaaattcccagttaatgggttccagtgtcttaaaaaggcaggactgaggcggtctctatggagttgttctgactgcagctgggccctgtccttccacacctgcccctgcaggaattctccggacgcctgtggagggaagaatgtgtgtgtctggggtccaagaccacatgcaccgcctggtggaactttctctgctcttgcatgtctggtgggagcttcccttaatgacacaggatctgccgagattcatccccaactccaggctggcaccagtgttcaagcccctgcctctgctgtctcccaggtcttcaaatttacaccactctgactctcagtttccctatctgcaaaatgaaggcaggaatgcccacctcatggggtgagccagtggacccaaatacgtggtgcagtaggtgccacggagtagtggcacgtgattttgtggctgttagtgtgagtattccttactttagagagcagaggaaaacacatcagcagattgtttaagccaaaaaatgtctgttgtttgaagaatttcgttttggaaggcaagcccaggttttgggtcagaaccgtattccctcaggcacggcacggttgaacgtcgaggcatattttacaggcttggtgaccgctcaagcctttgagccctccatgcgggtgctctgaggtcagacttttcgggaagccctcacacagctggtctgcttgtcgcgttggtagcaccgtttccacagagcaggctctgtttggctatgaatagatgtttttctcactcttttcttggatgcctgaatggcaggctcccctcctgcagtctcagaggccgacctgcatgtaaaactccaagcggacatcagagtgggttcgtctgttcctgcttggacttgaggctctcagcaaggctcaaagagctgggtcgatggccaccatgacccagggagcctcccgagagtctcccaggctatagtttctgaaggctactgagtgaactgaagaaatcagagttcatggaagaggcagcagatccgagcaacagccgagattgaggaggatggttcaggatctccaaacacaggcccgctggctccactgtgtccaagccgcagatgcaaagcctgttaggacagaaaggacacgagatagcagccagggccggccgcaggcaggagggccgggccaccagcagttaggagtgtgggttctggagccacacaaccggggttcagatcccagttttcccacctctattgggcagcatactgtaagcctcagttttccccttctgtaaaacggagataataatttacctgtctcacaaggctgttatgaggattaaagtaagttaacatcactcaagtgcatagaacgatgctgggtacatactaaataaatacagataaactgaggcccagagagggcaagggacttcgctgtggtcactcagcaagtcattggggcagccaaggctgaaactcatgactcctagtctcgtgaacggttcccccctccctgccctcccccgcagtcagactttttaaacactgccttttgcagaggaaatcgcgtgacccttcagcccacaagaattccgactgcacagaatgtctgaaacctcttcgggctggctgggggccttgttgcaattctattcagctgttagttctttttttcccctctctttcttttaaagctctataggatcctcctttcccttctccacaaatagaaaaattaacctcttgacaaaggagttggaagacttgagtccctgctgtgtgtcccggaaccaatcccccagcctcaggttccccggctgtgaaatgagaaggtgtcctctgttgacagggaggtggccccacctgccagtctgtgattgccacagagacaagccagccaagaagtgccaccctggacgaaggtcgggtgagtgctgattaaacaaaatctggtgacgcatccttctaagaagcgaggcgaaacccaccagagatgctgcgtgcttctgcccacctcctcgtgtcaaaggtgatttgagtcatcagcctggcctgcacttttctcgctctcctgtttccttgcagtgctcctgggctcctgagccactcggggctgaggcccgggggccagttgtgtcccatctgcaggccccagggcattagacctgaggggcctggtcaccttctgatttctgctgggcgccccagccatgagctccagaggctgccagcctagggtgtgagtctgtctccgaagctgctgacatgagtagggacttcccctctctgagctttagttccttatctgtgaaatgggtgcatgagccctgcctggcagggtgagatgaggtacacaagccctatcctacttcactcccctcttccttcctgcccgaaaggccctggctcacctgggatccagctggggcacagcaggtgttgatatgtccacctgctgccccccggctgtgatatgcccccctggctgcgggggacagagggacagctggccacaccgggaagcctggggacagaccctgggacatcagggtcaggagcgtacagggtgcagccctcttggcctagtgatggggatccctaggggaaagacctaggggccaggaggtcatggagacaagactcgaacccaggattggggcccccaggtcctcctgtcctttgtgtaggctcactttcaggttaccctggcaccagcaggggccagcctggttgggcctgggaattcagagatgggtgccaaggtgggcctggagcacgacgtaggcagacacggggccgagccccaccttgctacccgctggtaaggggccttgggcaagtcgtggccactcctgagcccccatctcctcatctcaaaaatgaacatcattcccactcttcccacctttcaaggttgtcatgcggctccctatgatagtgtggacaaaagtcactctgtagaccatcaagaactgaccaggccagatgcggtggctcatgcctgtaatcccaacactttgggaggctgaggtgggtggatcacctgaggtcaggagtttgaaactagcctggccaacatggtgaaaccccatctttactaaaaatagaaagatttgctgggtgtagtggcatgcaggtataaccctggatacttgggagggtgaggcaggagaatctcttgaacctgggaggtggaggttacagtgagccaagattgcaccattgcactccagcctaggtgacagagtgacactgtctcaaaaaagaaaaaaaaaccgcccagaagaaatgtgtcatttcaccctctggaaccatgagccctgtgatcatgaggcacaatcgtcatgtaaatatatagggtctctcaccagccacgggccaagatttattttatggagacagtgggggagggggccagctcagtttcattgtcctggtaactttgtaaaatgctttgccatcacttcccagctcctgggaggatgcagcaggagctgtgcagcctctctcgccctcccaaaaggcggatccccagaggccctggacacctccttccaggtccacaggcccaaaggcctggtgtccataaggctggggttccctggaaagtgggtttctggaaatacttgttgcagggatatcgctgttgcgtgagggctggttgtttatgataacaggaatcataacagtggcagtacccacattgattgattgattgattgagacagagtctcactccatcacccaggctggagtgcagtggcgcgacctcaattcactgcaacctctgcctcctgggttcaagtgattctcctgaatcaagtgattcagtgctcagcctcctgagcagctgggattacaggtacccgcccccacacccagctaattttttgtatttttagtaaaaatggggttttgccatgttggccaggctggtctcgaactcttgacctcaagtgatccactcacctcggcctcccaaagttctgggattacaggcgtgagccaccctgctcggcccagtacccacatttattaagctcttctgcatacccgggccctgataatcctgggctggtattttacctgcatgtaaagtacctcacttggtcctcacggcagccctacaagatgggtcctactgtggctactagtttataaaagagggaactgcaaagggatgaccctgggactggcccaggctcacatgggcggatggaggcagcaccgaatttgtactcggggctctcagacccctgagcttgctgcctctccacctccccacagcctggcctgctcttctcagatccaggacactgcctccctgcagcccccttcattgccccacgttgaaattaacggccccttctgtgattcagcaacgcagttaagtacattggggttttttggttggtgtttcgttttttgtttttttagaaagagggtcttgctctttcacccaggtggaatgcagtggcacaatactagctctccacagccttgaactcctgggcttaagtgatccttccatctcagccttccaaagtgctaggattacaggtgtgagccaccacgcctgacctagttaagactttgattggacaccccccccgccccccccgccacacacacacacacacacacacacacacacacacacacactccatctgctccttcgctgaggggagggtgctctggacacactgctgaggatgtccaggtcaggactcaggcctgcattcccatccaagctctgcctctgcagctaggactccctgagtctcagtttcctcatctgtcaaatggatacactgtctgccttccagggttgttttgtgagcacacaggctggcactatccctgaaggatctggcccagcacccgacactgatggggtgccctggatgcatgcctccatatacacacctccatggctgtgtgttggggagcccaggaggcatccaagccacagccccacgtcactatggctactatgcatgaggaaggcagtgtgcaggggctggagggctcagaagtgatccagggtccaagaacaaattcccttagcaattccagaccgaaaagatctggttttctagtgcccagaaatgagcacgtgattaaatacaggatccccagtttaattccagagcaacccagtgaatcacagatcctttgtcagccgtataagaagcatctgcacaagaagggcgcttctagactgtggagtccaacccactcatgttgcaggtggggaaactgaggcccaaagatagcctgtgactttcccaagaccatgcagccctatgggagtctggcctgtatgagtcctgggccaccagaccacacacagcacagctcagagcacaagccactcctgcggagctaaaaatggccacatacttcctaagcccaactccagggttcagtgaggatcctggtaaggagagcgacacaggaaggtgcaggggttgccatggtgtggccccagatgctgtgattacgcgccagccccgtcacaccgtacgggtggtaggactgggcaaagaagacgccgccacctggatgcactgaggtgtgcacagccacgtggagatgatgctgggggctcacggtgactctcaggaggccctggcctggcctatctggagccttctctgtgaaatgaggctggtaacgcccactagcagggttgtaggggacatggatctgtggccacctcctcaaggggtgccacacgcaccaggtcctgactgggagtccggcccccagggcctgtggatggctggcctgggcccagcctccgcccccaagggtgctggcacctggcatgtgcccgacagttggggccggctggtgggaaggtgtgtgtcaggtggcggagcctcggtgccaggatctcactcacgcgtcctccagggcctcagctgctgtatgcctgtgtcagtcccagtggcgatgagctgcagatggggcacaggggtggtttgcccagggcagaagtggctcgttctgaaaaaggaagcaggtgctggccacggagagcccctcttggggaccaggggctggggctggcctgcagagcccagattcctctcacagactgggtggcggggggtctgtctggcctctgtgcccttgatcccacggtgtcctctactgggaatccccttcccctttagtccaaaccctgctggtccttctgggccacctcaggttttctacctgttgtccaaagctccccgtgacctggccccgccagaagcagcagccatgggtccttttcctgagcagcttcgtgctctttttagcttgtgggtagcagttccagggcctgctcctggggacctgtaagaacaggaactgtgtctgagtcattgcagggtcccgaagggaagacgaacactcctcatcctctgatcctggatccgcaccctcgttttggagaatgcagggcccgaataaagatgcaataacaatcaaataacaaccccactgatggggtatctgccttgtgccccgcctggccctaagctctttcaactcgtgcaatgtcatgtaacccaccagcaccccgggcagtagatactacccttgtccctgttttacccgtgagaatgcaggtgcacacaactgggacgtggctaagccagaacttgaaccaggactgccgcctgccagggctctcatctcatgggcaaccaaggatttgggcccagtttacaaaggagagaatagaaagggttaagcttttaaaggaacagcaagggccggtcacggtggctcacgcctgtaatcttaccactttgggaggccgaggtcagcagatcacctgaggttaggagttcgagaccagcctgaccaacatggagaaaccccatctctactaaaaatacaaaattagccgggcatggtggtgggtgtctgtaatcccaactgcttgggagcctgaggcaggagaatcgcttgaacctcggaggcggaggttgcggtgagccaagatcatgctgctgtactccagcctgggcaacaagagcgaaactccatctcaaataaataaataaataaacaaacagcaagaacagttatgcttttcagcattttgctgggccccagtgtggataggtggggagcgagcacaaggaccaaaggaaaggacccttgtccctccctgagcctacactggtctaatcgggtggtgctgccatcagattccagtccctggtaagcagggggctccgtggcggctgtgacaagttccattcactttggaggtggcagccggagctatttttagagcagcgcatggtgggggagtttccttttggcggtgtctggggaccggagtcttgggaaggggaagtcccatgcggagacagaggcccttcttcctgcacccaccccagcccagagaggcgacccagctccctggaggcccaggcacctcatgtctgccctcaacccagagtggagcagaccttccctggagcttctcaggagccacttcaaaaggtaccctgactttctctgcctcctgctgtgggaaccgcttgctcttaggggtgtgtccagcgagggatggggaaccaggccccagggacctccagggctggagctccagggaccttgacctggctgcacctctgccacccaccgctggctcagccacctgctggtggggctgcccattcagccagtcccaccaacctgacaggacctttgccactagcctgggacaggggtggctgctgatggctgctttcacattgagtaatccctgggcttggccagaacttctgagtttccagggaagcagaaaaagcaattctttctctagggtgggttttgtctgccccttcctgcctgtgggaaggagagaaaattaggggaggccacgggcttgaaagctttccctgcatggaggccactggatgggattctagatgctcgcctgggacccagggtgagttttttacaaacaccgaagccctccagcccccggggctgttccacttggtccttcttccactgtcagtcagcagggtagtagctgcggttctgctctgaaatccatcccttcccttaagccccagcctctccccagtggtccccctggcatgagttggtctcggggggccaggcttctccctcctggcctcaggtgtttctgtactgagtcagcaaccagttacccagcctctcctctgccaactgctggggccatggagagagtggtttagtctctaccctcaaggacatttccatgttcaaggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgaggtgagagcaagatcatttcccaggcaggcaggggtctctgggatggtgggcctgctagcgggcctgggactcctagagtgagaccgcagctctccccagctgcattgtggtcaccaaggatcacctcaggcaaatgattaaaatgcagactttggagagggttggatctgagttcaaaaacaggccatgctgcttatcagctgcatgagctcgacaagtcatttaacttctctgcacctcagtttcttcatctgtaaaagtgaagggcttgcagacctcacagcagggatgtgctgagctgctgcctgcagtgcccgacacagaggaagcactcagcagatctcagcttcatcttcagggaggctgggagcggacccagccttgaccaggtcccagagtcaagaatcttctgggcagaagccaaatgctttgttgctcctttaactgagagacaagatgtttacagcttctgcattttttttcttccagaattgggttttattacctgaggaggaagtgaaaggtgattgggatgctcctcgattttcaaaaaggccctgggaaccctgcagtgtgcggcccagttggttttgaatctccagtgacttttgtctgatctgtgaccacagggatgctgagccctcagcagaggtttcttggggttgcaggagggtgggaagagccccctccacctactagtcagagattcattctgccaacgccccctgggtggccctcttttcaccgggcctgggtgaggcactggaggtttacagatgaccgcgaaggtcagtccctgcccttaaaggctggcagaggaggcagacatgctgacaaaggaagcagtttgtgtcctcaacagcccaccttcagggagaaacctgtgtagatgccaccagatgggaaagggaagaaggggccttggtgccccctggctgcccactgtgtgctcacagagtcctcgcagcctccctgcaagcttgggctgttcctttttgtggatggggacgtttaaggctcagggaggggacgggacttccccaaggtcccacaagaagtgccaagactatggctgggcatggtggctcacacctgtaatcccagcaccttgagaggccagggtgggaggatcacctgaggtcagtagttcgagaccagcctgaccaacatggcgaaaccccgtctctactaaaactacaaaaattagctgggcgtgatggtgtgtgcttataatctcagctactcgggagcctgagtagtgtgtcagttcctccctgccagccagtctgcctgggcgtggtagtccttccagcccctgggcttgtgctaagtttctttctgtaattgctccatctggctggtctgagaagcaggttcaaatggcaggagaatcacttgaacccaggaggcggaggttgcagtcagcagagatcgcgccattgcactcaagcctgggcgacaaagcaagactccatctcaaaaaaaaaaaaaaagtgccgagatgaaggagggtcgagagatctggtcctggcagacaagtgggactttgcccattgagaggcaccgatgggtctttagtccaaggctggtgcatggaatgacatggaaggaccagggtgctgtgttgctggggagggggaccgctcatttaatatggctgcacgcaaggcctgggggatgttgggggcaaatgcatgagggcaggctcgtgtcaggtggtcagggaatggcttgctccggtgtgcggaccttttgctgtggagtttcaggagagattggcaggttcaggcttgtgtgttaggaaaacctttccatggtgggctggaggctgggctgcaggggagtgtggaggctgaaggtaactgtagggacccaatgagaagggacaaggccagcacagagtggaggccctggggtgagtgaagacatttggaggaagaatggttgggactggatgaagaccaggtgtgggtcctgggggagggcgaggcatccggaggctacagcagccctgtttctgggtgggcaccgtgtggcccccaatcagctggcctcctgatgctgcaggcccaccctgggggaggccccaccaccctgaggaagggggcagcggggaacctgtctgcatggccaccttccaggagtggctcatggtcctgcatccctgcaccttagagcagccaggcttccgctgtcatggagctgcagaatccgggcaggatgcttggctttgcaggtggagagctggggcgagcgtgagggaacacaggacccggccggaaaccagactccatctgtggcttgtcccctccagcttgacaggcccccatgactctggcctgagatcgggctgcttcctgtcaagtgatgaatgggcaacgtctgcttatcctgagaccagacaagaagcggggctggggctggggaagggcccagcagccagagccacagctctgggccagtattcattcagtcagtcatttattcacaccctcttccaaggcagtttggaccaaggcagacttggtttcgagtgtcagttctgcctgccgcctgctgtgtgacctggcacccgtcactcaacctgtctgaactttggtttctcttctgaacagtgtggatcatagcagggcccgtctaggggtctgtaagtgtgaacgaggtatgagcggcactgggcacctgcctggcgcatgtgtggtgcatgctctgttggcgggggctgttattctggtgctccctgccagccagtgtgcctgggcgtggcattccttacagcccctgggcttgcgctgagtttctttctgtaattgctcagtctggctggtctgagaagcaggttcaaatggcagctctctccactgtgtggactcaactttggcaagccatgtttctccatggagccttagtttcctcatcaacaaaacaagggtgatggtactttgcaggtgtcttgggagatgccgtttcacccgtggatgttggctgatgttgaagttggtccggccttgacccagccagtggccagtgcagtgagctgtccttgccgggcctccgatcttcagctccctggggcatgtgtcgggcagtggagcctctgcaggctggctgaaggccccaggcagtgggcatccatcctcggcttctgccaccaggagccagctggaccaacagacatcacccctggtgctggcactggtgctgccagtaccattcgctcggggcggagagaaagctgtgtgtgcctgagtgtgaagccacagggacggcttcctgctttagggaaaacaacctgtgaagctgtgccctcggctggaggcacagaggaggggccttgctcagggaaactggagaggggagtacagtgtctggccaaggctgacctccaaggccaggagtgggttctccctgggcttggcaacacctgtcagtctgggagccacaactgcctttgccacgtctaccctctgcttcagtggacagaacgagcctggtggacattagatgacccctgatcatgcctgtgcacgtgcacacacaggagcagaagaggcaggcaggacacacaccgttaccacctccagggttcagagcaaggagaggtgtaagatccagtatatgaatgcacttccatgcatggaccccagtacacatggacccttgcaagctcatgcccccaaacctgctccaagcagggtccttggacagagccctcctggtgtctgaggtcgtgcttcactggccgggccacgatgagccaccagtctccatgaagtgtggcatttgacaggaggcacaggaatgacttccccctaggtgaagtttccaaaaattcagaggcaagggcccaatgacagccttggtcagaaaggccacttggaacctcagagccagcccattacagcagccgatcccttccagcaggtgcctggattaaaaccaagcgctcatgtctccctagggtcacagcccacattagtgagagcctcatccatggccgggcagggtgcggcacagcagctggctttgcagaggcagccacggctcacgtagatgatgaagacgtttgctccagagcagtcctaaagaggccatgctgcgtaggacatagagcagcaatcttgggtccaacagccccagctgtgtcatttaccagctgtgttacctggggcagggatgaccctgggcaagtccctgcctcaggccccatgtctgtcacatggaggtgatcacgcctccattgtacaagtgagggttagcttcaatagctaaatagcctcatagctaaagcctcagaggtcccttcccatgtgccaggctctgtgctaaggagtttacagtgaccctaagaggaagatctgactgttagcccattttccagatgaagaaactgagacgcagcatggttagatgaaaccgggccaggacctggactcctgcagtccagctccccgccagcctcactgaaccctgaggcttctcccaatctggtccctcggtgcctggggacacacagcacacggcagcctaaagccaggaacctgagctgggaagcctcactgtgcagctatccacagtgttttgcaaatgtagggcccttgcttgaggcagaagaaaagccctctttgaggtggtgttcagtgtggcctgcagctctgggtcttgcattccatggatttttggcccctgacttgggcttggcagctactacctcattgttctgcaacttggcaggagccgcgggatcccggggacgggcagtcctcagtgttaccccgaggtgcctgcacgcatgtgctaagggtcttttccctgctccgtgtggctcgtctttccacgtcccctttgccttggcctttctgcatctgaaccccctaagaagcagtttctgacaggaatttccagagcacagggcttgggtttctgttggggtgtggaccaatagaacaaaatgccctaaaatccaatacccatggagagccccaagaggcagtagattccttggaacaaagagggagtttagagtcactgagatctggatttgaatcctttctctgcagcttatcagcctaatggcatcgagcctcttcctctgagcctcggtttccccatctataaaatgggtctaccaatagccccgagggtgaatgggaaagacctggcccacaggaaccctcatcccttcctttctcccttcctccttccccctcgcgcctccccacctccttcccctcagcagggaccctctctggctctcggtgggtaggggcttgcagagtcctccgtggctgctgctttcctagaacagggaacatcaacacctgccggctcctccctggaggctaacggtgccgcaggttccattaggttctgaacagagcagctcgtaatgactggggtttggcagcaaaggcaccactggggtagacagtggtgctgcatcagcttgctgtggtcagtggggcagagtctccgggggctcctgcccctggggaccctgtggaggaaatgggcccttgtggtccgccagccctgagatcacccctgtgcatcagcagcacaggccccattctcaagtggagagagggcccattcggggtggagccagctggagagatgatggtgttgctgtgtaagaacctgtggggagtgcagtaccgtagttttggacaaatatgcagttgttggttcaaatcctggctccttttgtctgtgatccttgggacccgggcaaatctcttaacctcttcgtgcctcagttttctcatctgtgaaatgggaccataatagaccttacctcatggagttgttgacaaaatgagatgggctaatagaggtgaagagcgtagggcagggcccagcatgatcagggccctgcaattattagctcttattcccggtcccccttgcactgctcctggagccctgcccatgtgaggccacaggtgagctcctgagagtgtgcagaccatggcatctggctgcagctgttggagaatgcggtcagcgccacgtggggagggcaggaatgacattcccaagcacccgctaggctcctccccagtgggatttgcccaaggtctcagctggtgagtgacagggtctagattccactgccacagtttccagtacatgggaggccccagggcaggtgggcgggtaagccgatgtgtgcatgggtctcgcaggggtgacctgtgggccaaggctggtgccttctgagataaagatggaaccttctcactgaagacagttctccactctttccctggaggtctccctaagggcagaggacagtgagcatgtcaccctgaggggtctaggggtgcagctggaagcagctgcagagcctgcaggaggctcagttttatcttcaaattcatgcgcattttacattctgctctctctcatattccccctaacaaagatgcctggggaaggtgctcgtgtttatctgtttatcctggggctctttataccctgggtcttcccctgtgtcaccttgggatgtcacctgcgctccagtgcaagaactcggcacaaatggtggagacaccgagggtgccattttcccatctgcatttgagggcttggcagggagagcactgagcgctgggagacccaggtggggagatgaggcctgtgctgaggcagaggcaggggtggggagggaagaggcaggtgcacccataatgcccctccgtgtgacactgatctgacagtgctctgtgtgcacagactaaaaagacaacaagagacctactgactgatctgtccacactaggatgaaccacatcaaatggccaagtctgtgggtcaaagttggttgagtttctgcagcttcccaagcaggagactgcatgagccaggcttggcaggacttgcagccagcgagggcccccctgaccctgagttgggcgtgttctgcagtccataccatccacttccctgcagtctcacatcctgtcatctattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcgggtgagttagggtttggtggacatcctttgacatgtcaaagggtgtcacagatatccctggagcctgagaggtctggtcggcccaccactgtggctggaaacagactacagtggggaggaaggaagagtgacttgcaccctgagacacagtggccggacctctaggagctggctgtgacagcccggagggtgttgatgcctttcccacctcctggaacacccccgtgttaatgggggcgtgggtctacctgggagggagtggcagggctgctggcccagcagaccgggggaagactcttggtttggaatttgactggggcataggtgaccaggtgagacagcaggaggcggggtctgtctggagagagatgacgtctttggctgggtcctccagaagccaaacttgagatggggatatgtaggcatgggatttatgaagtgcccctgggagaaccactcagggaggagggagggcaaggccaggaatgggcaggagacggaccagaggttccttctcagacaaaacccgctgaccgcgccgggggctctaggatacgagtcacatcttggagggccccgacctgagacgggactggctttcattctcgccccctcagctgttgaataagggccaccgcaggggagggggctccattcctcaggacttctggctctccaggggtacagctgagctgctccaggagcctaggccaggcctcaaggggttctgcctaggatgtggtcacatgagaggtgcccctcgggacatccagggcttgtctgggagaaggagcagcagccagaaacaggggccccatcacatgtgtgatctagtcccttccatgcacaccatgtgggagccctggcacacaggaggtgctgcagaaatgcttgtggggtgagcgcaggtctctccttctggggaggaggagggcttttcccctggcatcaggaagcatcccggtggctgggtcacacaggttctatgcacataacctcagaccctgccccagaagcacttgtttgatgggggaggccagaggctaaaatattgggggagatgcccagatggccttgagctcaggactgggcacacagtgggtgcttaaccagggacctgtggctgctgtgactacctatgaccagcatctctgactctcccagggcagcccaagccctggaggctgaggggggctgttcctttgcacagaggtctaagtaggacggcaaacaggacctcttggccctggccttccctgtgtcacacgtgtggtgcgccagggcccagccaggacaaggacgtaggttccttcccacagcagctgtctgcagcctgacccaggcctttctcttctgagcacccaggctgccagcatgggtataggtgggggtgacaatgggggataggggtacagaactgctccccaagaagcaggggcagtgctgtggaaagaacaagtctttggactccagcaaatgtggggttgaatccggtgtcttccttcctggccttgggggctgctgatggacgtttccctgcctggagcctcttccagtggggataatcctagtgacttaggacagtctaacagaaggagactgtgtcacccgggggtgtcaagttgtagccctgccacttcggagctgggtgaccgtgggcaaattactgaacggctttgcacctcagctcacgcatctgtaaaatggggtgagcgaaagtccctcctccttctgagggtctcaaagagaaagtgaacaggccgctgttttctgttgcagttcgtgccctcgtgaggctggcatgcaggatggcaggacagcccggccacatgccccatggagggagttccaacaacctctgccacaccctggggcctgtgcatcctcctgacccacaggtaagccccttacctttgtctgcagcacactgaagagttcccaaggaatacggatccctgagcctcctttgtccaaactcctactggtggaaacccttcagctccctgaaacagaacctcttgaatgcttccagtgatggggagctcgctaccaaatctagtgagctcatcgttgaattcagtaatactcagagaagcctcctctgccaagctctaggctgggaccctgcaccctgatcctgcccctggagtgttccaagtggatggaacagctttatctcagggatcagcatggttggaagggtacagagggtgctgtggaggccctgagaacagcgagggactcagaggaatgggctgactgtactgtgggtcagaaaattctttcttacagtgagccaacattgcctcccattttggtcttaactgtgtttcagcccccttcagcctcttctagaaccagcagagtttgggagaacactggcttcttaacgcctgcctctcgctctctctagataccttggagagccaggcagccttcagcagcttttctgaaggtgacttgtaggtttctgaactgccttgtgtaccccatgctgcccgggcctggcacgccctctctgacccctcttccaagtcagtgcaaatgctgctccctctggggagacctccacttccaccctgctctctgctctgggctgcccgcacacctgtgtccacacacctgggtgatgcccgtgatcacatctcactggggcactagttcctgggtctgcctcactttctagatggagagctcccctggagcagggctttgctggtgggacaatcccacaccgggcacagaggggccccgcgtgctcgctgagttaaggaactgtgcatgtgtgtgctgtgtacccacttgggacggggctgtgtggaaaacactcaggtctgctcttacggagcacacagcctcatgggagagaaagataaggagctgagcagaagaaccttgcgggcctagggagcccagcaaggcacctgatccggggccagagaggcttcctcatggaagtggcatgcaaaggcctggaggggacagagagcttgtctgggcaggttgagcagagccagatcctgtagggtcctgtggccagcttagaatgatgaaaagttctcttatatggtgttggctttttctccaaaggatgtgagacctaaattcaggggaggttcagagatagccaccctcctgagccatggagggcttgattacagcttctaactgcctaatccctcttggaagacttcagattggctgatgtttgacctcaatggcaaggttgccatgtacagttgtacaggttatgcactgcacaaagcttctgggctaaggaggcaggtaggtctgaaatccttctcctgtgcttgcattatcaccaagccatgctccctggtggacagctgcatcagcccaaggagggcggtgatgctgcagattgacacagaggcgacacgttgagcttagtggacactatgtttgtgtgtgtatctggtgggggtgtgtgtatatgcatacacacaagcatgcagagggtccatggggcatctatgctatttgtactcatgcaggggcccatttcctaggtagaatttggggaggcagatcccagaaagctgggaagccccaggacactgtgggtccagagtctaccaggacatggtgctgatggctgggggcagcagggcctcctcgggtaatgtagcaatttgtcatattaagtcattcactaacaattgaatcccccttgattaatctcccagaattagccagttgcattttgagcaattagggttaattacaacctcatttggcagaggagagggccctgtaattatttcatgagcaaggtgaagaggcggtgggctgcagtggcagcgttcacgacgtctcatcgcacatgttggagagggtaatgacatagttaagtgtaattagttacgattactcggagctgggctgctctgggcagcggctgtcgggcaacgatgcccccagtcccaccagcatctggctgggtttgcagaatgggggcgcaaggccacccatgtgccgtgccggctccaggttgggatgggaaagggggactttctcctcggctcctgaagccttggggatttaaacactgtctggggagacatcccagccgtgtctcgcctgtttcaggacatagaagcacctggaattaatgggccaggcattttccttgatagcaggaggcaccgctgcttccctgaaaccatcctcagaggaaggagccaggctaagaatgctttgatgtgggccaggctgtttccgcacccagctctccgtctctcattagccgggtgagactaggaaagcaacctctctgagcctcagtttcctcatctataaaatgggataataatgccgcttccctcatgaggcggctgtgaagactaagtgagatagttactgtaaacatccaacacagcacctcacatcgtgggtactgaggaaatggtatgtcatggatcttatattttaaaaaccatttctgttttcatagctaaaggcctccgagctggataatacccccagtgtagaaagaaagaaactacaaccacctgaactgtggtttttgttaacctgctatgcccaaggctagtggcttgttcatttcaggaagctttctagccttgagagccagcagcacatgaaaaaatatttgctgaaaccggcagaaccatatatgaaattcatatatacttaggaaagctgaacatacttgcttttatagaggtttctaatgaatgaatgaatggaattgaggaaagaagcttaaaatgcctcatgctttttaaattttaccaatgtgctgcagagagctttcattgggaatgaagtgtaagcctcacctgacacactaagaaccacgtgaatttccaagaaggggaaaggtattcttgcctgagaaagccccggctaatgtgtcttccatctggaaagtctttgcaaagccagttgggatgtgccaagttcagttatatttgggtgctcttccgagagaacttcgcaggggattgggtcagctctttctaggtgtgcattgcacaggccaaaatctttatcagaatcttcccaaagcagtgatgctagttggttaaggtttaatgaccaaatatcaatggctattaaaattcagttagtgggccgggcacggtggctcacacctgtaatcccagcacttcgggaggccaaggtggatggatcacctgagtctggagttcaagaccaacctgggcaacatggtgaaaccctgtctctactaaaaatataaaaattagctgggcgtggtggtgttcacctgtaatctcagctacttgggaggccaaggcatgagaatcgcttcaacctgggaggcagcggttgcagtgagccgagattgcaccattgcactccagcctgggcaacagagtgagaccccatctcaaaaaaaaaaaaaaaagaaaaagaaaagaaattcagtgtctgctaactgctgtcaattcagcaactgtttttttggggtttttttcctgccatgggaagtgcccagtgcctgcctttgggggctcccagtctgctgagaagctctgcatgttgcagagaggtggaagctccccgggagggatggacagatgctgggagagcccagagaatggggaggccagttctgctagatagatgatcaggaatttggggtgggacagggagaggccccagacctgaaggtgcatggccaatcaggttagagaagttgttgaaatacctatgcttagagaaggtaaaagaatgtatggtgtttatgaaggtctcaaatccatactatctcatttgaaattgaatctgtagcaaatgaggagcccattatgggttttcaggtggcaagggggtacttgggttgggttctagatagatcactggtggctcgtgctcaaggctcagggaaggtgaaaatagggaggtgaggaggccccttcttcaccaggtgagatgatgcctcatggggctacagcactgggggctggacatggggagagagggttccagagacttccaggggaaagcagcctcacttggtagtggaagggatgagggagaggggttgtcaggagtggcagctggaactctttgtggtttcgccctttatgtctctgcttgtgagtcgtcggagctggttccatatcatctttcgtatgtgtaagcttagctttttccagactctgttaatgagaattgtcctgggggaaccataatgatttagatcgttttgggttttgttattaggagtcttccatgcgatgggcattggctcactgatcccatgagccagtggcccacggagtgcggtgcagacgtcttagctgagccagtaatggtggtgtttgtaccaacagcccagtgcctgggactcatctcacttagtactcctgctgactcagaggagttgcttactcaatgctctattttgcagggaaggaagctgatgtcataatctgccatcgcaccgtcaaggggcagagttgggattgggtccaggcccatgggaccccacagtgccgctttgggcagctagatctttgaaagggaagatgggctttgggtctgaagttaggcagatcgtgaggagctgagctgggctggcctcagaagaagtctgacaatgtgaactctttgtaaattgtgcccttttgtgcaacacagatttaaaatatatcgctatatacacatctaccaaatccattagagtttccctacccacagtgtcagatgtctttaaaggtgaaattcgtttataagaaatgtcatcctgatgaagtgtgctttttaaaatcatagaaacggttgccttaaaattaatgatgcattgcaaatatcagggaaaaaagacccatccagtgtaaagatgattaaaattcaggtcagaagtctgacttagtcaggctaaattttttaatgagatttcagaaaattaattgggcgaatgcatttttattcttttagcatgtaattttatgctcctgtttaaaaaaaaaaagattcgtctatggctgaggctgattgtggttcaaacattttaaactcaaattagcgcagggtggggggtgtttgtggcctaatttgatctgacttggagaagacagcgtgggtttctcagagctttctgggtggggggtagctatagtggtctgagacatcctccctgccccccagtctcccagtcatgccctgcctcttcctgagaatgccagcgacatttcttgggaggtgggattgggatggcggtggctcggggaccttggccatctcattggctcctgctcaccagtttcctgctgctccccagggcccttgttccagcggttcctctaccctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagtccccggggaagcaggtccaccactaggcccattcgacagatagcagcacaatcaccgtcaccacgactggagaatgacatgtcccagcacctagtgccaggccctcttccaagggcttgcatttgcttatccatttaacccccagcagccccctgaagggggtactgttatgatctcctcagtttccaaagaggaaactgaggcccagaagccttgcccaaggcccacagctgggaagtggcagaattgaggtttgagccccagcctccaggccccagcattggagtctcaacatcagagccagagcagtggttacccctctgccaacttgtgccctggggtggggttgggggtgttattttccccaggagccacaacagggtttcacacaaagcagggacagtgagcaacagaaaccagttttctgggctgggtgaggtagctcacacctgtaatcccagcactttgggaggccgaggcaggtggatcacctgaggtcaggtgttcaagaccagcctggccaacatggtgaaaccccatctctactaaaaatacaaaaaatttagcccagtgtggtggcgggcacctgctactccccagctacttgggaggctgaggcaggagaatcgcttgaacccgggaggcggagattgcaatgagccgagatcgcgccacagcgctccagcctgggtgacaagagcaaaactctatctcaaaaaaaaaaaaaaaaaaaccagttttctgaaaggccatcggggtggtcggtcattagtcagcagtgatcacatttggggccaccctgggcgcactgttctggggccagccccacgcccgtcttgcagtttagagccacaccagacactaatcaccaacatcatctcccagagtcctcagagaaatcctggagccagtgttactgtgcctgtgtgtggacgaccagcccagggtcacttggctgcaggggcaaaagtggaacttgcggggagctgacccaggagcgggggaggtcttggaggtggcgacggagcagccaggccttccaggccaaggacacagttcaccctttcccttctgctgagagcccccaggtgcaccagggccaggactctgctggcccaggcagctgcccccaggagcctggtgtctcaaggtgccccacacctgagcagaggccaccctggggacagcgtcctgtggcagccctgggagtgcagtggtgccccagagcctgctggaccatgtccccagcacacgtgctccatctaggaagctgccccaccagaggagctggcctctaattgggtcggatggactgtgacaagaaatgcaaatctgggtcatccatatgcgtgtgagcagctggagccccagccacctccacccacatccaccaggagcttcggccccactgtggagctgcacggtgtagcctcccaggacgggcagtgttgggaaccccggccagactcccactagtcacagtaagaagcctggtcttccagggcaaagaccctcagggaccacttcctccaaacccttcactgtgcctgggggaaactgaggcccaagaggggagggagcccacccccatcaccagcagtgcagctggctctagatctgacagggagttctagcctgtttcctgatttgcgagatgggattcataacccttgcttcatgaagctattaggagtttggagacatagagctgtctaagcagctggaaactagcacatagtaggcgtctaacgtacaacacctcatggttatttttatgagtacgtgcgattcttctaagtgctcagaaagccgccctggctgtttatgagggtatgtgattttggctgcattcctagaggtgacggcgtctgagtcacagagtcccactgtgcgccaggtcgtgtcaggcacattccatgtgtcattccacaaacatgctccaagcagttgctctggggtcagagcctcagtgcagaggacgtggaggggactagacaggggcccccttttgaagaggccggtggcgggtcctggggcggggcctggggcagggctcaggtgactgaaagaatggaggctggagcaggaagtggcaggcctggccggtcagggggtcttgagtgaaaagccgaggagggatctgagctgagagcccacccgatacggagcaagagcttgggcaccacagtccccagtcctggggtcacaccccagctctgctgttctttgctgcctgatcagaacaggtcactgctacccctccaagcctcagattcctgaaatggggacagcagtgaggcccactcacagggttgttctgaggacccaaagagtgggcgcgtgggcggtgtctgcacagagcccagcatgcagtagacactcaggatgcctgctcttcttaggtgggtgctctgtgtacaggtgtatttacccgacagacattggcacatggtggataaaatcatcatcttcctcctccagcagccctccagatcgggtcctctggcaggacccaccatgagaggtaattaggcctcgaggcttcaaagtcaaggttggcccagccctcaccttgctgtgtgctgtgaggcctggactcccatcactcactcccgcaggagggtgttctgtagagttccctcagccaaatctggaagagacattttcttttttttgagatggagtctcaccgtcacccaggctggagtgcagtagcacgatctaggccaactgcaacctccgcctcccaggttcaagcaattctcctgcctcggcctcccaaatggctgggatttacaggcacccaccaccacacccggctaatttttgtgtttttacaaaaattttttggccaggctggtctcaaactcctgaccttaagtgatcgcccgcctcggcctcccacagtgctgggattacaggcgtgagccactgcgcctggcctagaagagacattttcactttacttttttccctgcttttccagtgagtttctattattcattaagtcatgattcagggtcccagagtagggatcaccacataaccaggttcccctcaggcactctgggagaaggacagaggagaagttgatggacccagcttagacctgcccaggagacgtgcccctgctccgcaggcatctcaggctgagacgcagctggtccggccagcagttcctggtgtttccaggtggggaagcagctgtcagaagggccagtcctgtagttctcggtttggtcttgatgccttccgccagggtgctggctcctaaagacgcctcggtacggtgcccggctcagtgtgaccctcaccaaagacccacttcatgctagaaagttgaactgcttgttctggcttcactaggggcggtggcatggagctgggtgatgtgggcatggctggcccctctgggcctcagtttcctcatcaggcaaatggagacacagccgggcccatctcaccatagggcaggccagagatgtggcatcctctccccttgtctgtctcctccttccctggcccactgttggcgccccctcctgccttttcctgagagctcactgcacaggtgtcctggggtcctcctggccactgtggtctcacctggaggctccatccctgggcaggtcctagcgcaggatcatgtgttccaatgctggcccctgcagagtctttgtggagctctggtttcttcacgacaccctaaaaaaggcagtttatctaaaggatgggctcagggtgtaaggctgcacatttttttgagagggggacagagtctccatcacccaggctggagtgcagtggcatgatctctgctcactgcaacctctgcctcctgggttcaagcgattctcatgcctcagcctcctgagtagctggaattataggcatgggccaccacacccagctaatttttatatttttagtggagacagggtttcgccatgttggccaggctggtctcgaactcctgacctctcgaactcccgcctcagctcccaaaatgctgggattacaggcgtgagccaccacacctggccaaggctatgaatattaaccttggttttcttgtctgagatggggaacggctgccccaggaagggaacttgccatttcttatgatgacctggggcattttgcatggtggccacgggctggggatacatgagctgcacccggcttaccggaccccagtttgggcatcaaggattcaggagaggatgagacgggcaacgcccgtggtcccacggagctagcccccagggatgggactcagagacagcaaacaaacaagcagtcagacaatgaaggtggtgatgagggcagtggggagcatgaacagcctcagtttttcacctgcactgggggtccttgaggggacccaggggaccctgtgcagaaagccccctgggggggtgcctgggaggctcccagagcagggttggcagcagagtccctccttcaccttagagggtgctgttggggtgctgggcctctaggggtcgtccccaggcctctgctgcagcctggctgctcacggaggccctctgtcccccgttccagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcaggtgagctgacaacccgtggggtcaaacctgcatctcgggaggtggtctctgcatctggacggggtgcccgggccagtcccttctctcccctcttctgtgaacgagggaaacagcactcaactcactgggttacagagagaaccaggtggactcctattgatgaaagttcactgtgaactgcaaaggaaaagaaaaacgagcatgcattgagcgcctgctgtgtactgggtcatgcaaggagcacatggagcctctcaacagtcccgtgggtggggattgtcatttcatctctcagatgaggaaaatctcataaccgccagggccccagcatgagtcttgggggagctgaggttcataccatgtccacccatccttgcgcctgcggttgctccacagttctgggcttcctgccttctgcgtccctcctaaatggaggaagtaggtcaagcggcaaagtcaggacaggagccatgtccatgagagccgctgggcccgtctgaacacagctttgccggaggaaatggctttaaatcctccagcaaagcttcccaagccccttgatttgcttacttgtccttaaagaacaagattgagagcctgggcagaggagggccgggagagagaatggcgttggggaaatggggagagaacacccgcagcttcagggcgctggaggagtagcagggtcctctctgtccaaaaaaggaccagtttctctcttgatcttgttttttttttgagatagagtctcagtctatcacccaggctgtagtgcagtggcgtgatcagctcactgcaacctctgcctcccgggttcaagcgattctcctgcctaggtctcttgagtagctgggactacaggcgtgcaccaccacacccagctaatttttatatttttagtagagacggggtttcaccatgttggccaggctggtctcgaactcctgacctcaagtgatccacccacctcagcctcgctgggattacaggtgtgagccactgtgcctggcccgccctctccatcttctggggaggggctcacctgggctctctgtcttggttctttagtgccacgatgggttttgtggtgggacagtgctggggggacccacagtgagcaagccctacaggggctgggagtgcaggggggggtcacagagtcccttggtgaggaggtgggagagccgggactggaaagcagaccccgtggcctcctttgggtcactggacacagattgtaaccactctatttctctttttcctcccgcccaagatctttgagatgatggacgccaaggcgaggcaggactgtgtcaaggagatcggcctcttgaaggtgagcaccctgggccgagcgggagctttgcctcctcggggaggttctggggccgcggctgggccacatcatgtccatcacagcccttgggtgccaggaatccgcagcccctgctaagttaacagacgatagctttctaggggcagcggctagtgagttttctcctggccaggcaggagcggcccgcctcatcgctctgcccagcccttggggtcgctgcctacagcctttcctccttgctgcacgcccctcctgcttgtacatggcagtacccggcatagaagtccttccccacagggcagccctgaccctgcctcgcagtggcctatggaccaggcttggctaggggaggagttcattgtggggaccacatccagactgcagcctgtctggctctgcctctgtctctatgtctgtctccctgtttttctctttctcatcctctttccatctctcctctcagcctttttctttggttttgttggtagtggtggtggtggtggtggtggtgggttttttttttattttagaggcaaactctgttgcctggactgtagtgcagtggcatgatcatagctcactgcagcctcaaactcctgggctcaagcaatcctcccgcctcagtctcccgagtagctgggaccacaggcgcatgccaccacacctgatttttattttttatttcttttgtttttttttgagacagagttttgctcttgttgcccaggctggagtgcagtggcacaatctctgctcactgcaatccccaccttctcggttcaagcagttctcctgtctcagtctcctgggattacaggcacccaccaccacacccagctaattttcatatttttagtagagacagcgtttcaccatgttgaccagcctggtctcaacctcctgacctcaggtgatccatccacctcagcctcccaaagtgctgggattacaggcgggagccaccgcacccggccccccatgaaacatactggatttgctcggcagtttccagcaaagtgggactgctggtggcagggctgcccgccgaagccacagctgcagaatttcagattagcagttttttctgccacacgctgccctgtgttctcaggccttggccctgctcttggggacttccaggctggtggggaagcaggtaggaagcagatggtgaccttccagggtgatgcagattgactggtgggccaggagccccagggaaacccgcttcctgggcaggcctcacagagggcagggcaccatcccagaatctggaaggccgaagtgagccttcttccaggcaccgcagcaccgtggattatgggaggttggggagacagaaggctggacatggcagcagagccagatacacactcagaacaaaaggggagcccctgaagtggctgcaagtcggggggccatggctgggtgtgagttgtgagtgcctgctctggtggcccccggccacagtgggtgagggagtcaaggctggaggcaggaggtgtccttaccactaactattataggtcaaaaaatatccctcgaaaacattgtttaaatgtttaagtaatggtcagcttgctgccacttacccagccctgaggaatgtttgtcctgatcacccattgccccctccccacctcatgtgcccttctccccgagtgaaggaacccacaggtgagcatgctgagcacagcctggtctggtccctggtcacacagatgtgccaccgcagcccctgccttgcaggagcctgagcctggcgtaaacccacatggctgcagaggggatttggtcccttctccagggctgccatgcagccaagggcaccaagccggggtttcagaggacacacccctcgctcactagctgtgtggctgcaggccagccatgggcctctcaggacctcagtttcctcatctgtaaagggggcatgatgacaacagggacgctggaggagtcagtgaggaagcatgtctgacgagctcagggcagcgctggtgtgtggtacgctcgccgcccaaggcagcccagttgtcatggttgccacctctgcccgccaatgccagccgccttcccgaacacgggtcccactccacaggtagcccatgggaagtcaacaggatgtgccagggcacgaggtgcttcctacaaaacaaaaggaaacgtggttttcggaggggtgactgttgacatatcacatcattcatgcaaagaacccaaacccaaaacctctcaagtgcgggggctggtggggtcggcagctgccaagcgtgggacaagaaggtgggtcctgttggaacgcaggcgtgtgttcattcattctgtgcaatttctgatcaccactgaatgctggacaccagggtgcagcccagtggagaagacagatcatagacactctgtgttacatccgggagggcctggagcttgggagcagagcccctgatggcagagattcaaaggacagggacccttactctcagctctccctcccttccctctggccaccaccacagccagacaaagcccaaccacattgcgtctttgcagcaccttccctgtccctgacccaagtgtgtccccttccagacccacctgggcccaccaagaggccacaggctgtgaagtggactccatgtggaccaggttctagactcagctcggcccctgcttgctgtggacccgtggctgatcccttcccctctctggaccttggcgatttagcccaatggacgtctggagcccctttctgcctgtgcctgtgtagactgcctgggcatttaagggagcccttccttaaccccctgccctcagacgtgcagggaaatgggggaggagtctccctcctcccctccccaggaaccagcgcctccttgatggggctttacttcctacccaacccctctcatttctcccttgttggagaaactgtgtcatgcctggactgctgatgacctgggcagtttttggggagtcctccctgagaggttgtgagatttcctggtgacataatgaggtgaagttcaagaggagggtgaaggagcagggtgttcccatttatcctcatagcagcttgcccacgccgtaggtcatgtctcagagatttgaaggcactttcaacttgccattcacttgctttgacactttttttggtaactgaaaaacatgtctatggagcatgatgtgtgctgagggcagcgatgtgatggccagtgttcgcgcaggacgtccttttcaacacaaaatctgggcaagaggattttcttttctttctttccttttttgataacagggtctcgctctgtcacccaggctggagtgccgtggtgcgatctcggctcactacaacctccgagtagctggaataacaggtgtgcaccaccacacccggctaatttttgtgtttttgtagagacggggtttcaccatgttggccaggctggtcttgaacgcctgacctcaggtgatccacccgcctcggcctcccaaagtgctggcattacagacatgagccaccacgtctggcccaccttcttttttaaatttccatttttattttagattcagagggtacacatgcaggtttgttacaagagtatattgtgtgatgctgagatttgggcttctgatcccgtcacgcagatagtgaacatcatacccaatgggaagtttttcagcccttgccccactcccgccccctcttgtagagcccagtgtgtctactgtttccatctttatgtttgtgtgtacccaggatttagctcccacttataaaagtgagaacatgcagtatagatatgtttctgtgttatttctcttaggataatggcctcctgctgcatccgtgttgctgcaaaggacatgacttttattctttgttgtggctgcataatattctattgtatacatgtaccacattttctttatccggcccaccatttctgcgcacctagattgattcggtgtctttgcttttatgaatagcgccgtgatggacatacaaacccatgtgtctttttggtagaaccatttatattcctttgggtatatacccagtaatgggattgctgggtcaaatggtagttctatttttagttctttgagaaatttccagactttgttccacggtgtctgaacaaatttacattcctaccaaaagcatagaagtgttcccttttcttcgcagcctcaccaacatctgttattttttgacttcgtaataattgccattctgactggtgtgaaatggtatctcattgtaattttttttttttgagactgggtcacaccctatcatctaagctggagtgcagtggtgtgatcatggctcactgcagcatcagcctcccagaatcaagtgatcttcccaccttaacctcccaagtagcttgggctacaggcctgcaccacgaagcccagctaatttttttttgtagtgacaaggtctcactctgttgcccaggctgttctcaaactcctgggctcaagcagccctcccacttcagcctcatgaagtgctggcattataggcatgagcccctgcacccagcctattgtggttttgatttacatttctctgatgattagtgatgttgggcatttttttcctgtttgttagttgcttgtatgtcttcttttgaagaatcactgttcatgtcctcttcctactctttattttatttttatttatttattttttattttgagacagagtcttgctcagccacccaggctggagtgcagtggcatgatcttggctcactgcaaccaccgtctcccgggttcaagcgattctcccatctcagcctcctgagtagctgggattacaggcacccaccatcatgctcggctaattgttgtattttagtagagacggagtttcaccatgttggccaggctggtcttgaactcctgacttcaggtgatccacccaccttggcctcccaaagtgctaggattacaggcgtgagccactgcgcccagcctatttacttattttttatttttatttttattatttttagaatctcactctgtcacccaaactggagtgcagtggcacaatctcagctcactgcaacctccgcctcccaggttcaagcgattctcctgccccaacctctcgagtagctgtgactacaggcacctgccaccatgcctggctaattttcgtatttttagtagaaatggggttttgccatgttggccaggctggtctcgaactcctgatctcaatgatccgcccacctcagcctcccaaagtgctgggattacaggcgtgagccaccatgtccagcctcctctgctcactttttaatgttttgtttttttttattgatttaagttccttatagattctggacattagtcctttgtcagatgcatagtttatgaatgttttctcccattctgtcaattgtctgtttactctgttgatcatttcatttgccatgcagaagctctttcatttaattatgtcccacttgtcagtttttggttttgttgcaatggtttttaaggacttggtcttaaattctttgtcaaggctaacgctgagaaaggtatttcctaggttttcttctaggatttttatagtttgaggtcttacatttaagtcttcaatcaatcttgatttaatttttacacatggtgaaaagtaggggttccgtttcattcttctgcatatagctagccagttaattgagtagggagtcctttccccattgcttatttttgtcaactttgttgaagatcaggtggttgtaggtatgctgctttatttctgagttctatattctgttccattggtctatgtatctatttttgtaccagtaccatgctgttttggttaccataggcttgtagtatagtttgaagtccagtaacgtgatgcctccaggtttgttctttttgcttaggattgctttgtgtgccgccttctgaagtctagtcaccctgtgtaaattaactacatttgttactgaccaaggttcttccacaggggagcctgctgctaagatggcaacagggctccctcccagccacccctgggaaccaggattgaatgtgctgcacctgcgtcctcagctgtgcagggtgcctggttcctcacagtggtgtctggatattcactgagccacagcgctgctggctgaggggcaggcaggggccagcacacccacctcagggccagaccttggtccagagcaggggtttgaggacttggacaggcagtgggcgccatagcagacagggatcagtctctggggggacctggtgagaggatggacgcatggggaggagctggggccagtggctgagcctgctctggcccccagggcccacacatggggggctggcttggggaatgaatgaatgaatgaataggggcttgcatggctctgtaacatctgcccaggctcccctcattttagaatccacggatgggcacagtgcatccttctcccaacgacttccgggccttttgggaaatgtgctcactatcggcctctggtggttggctggtgtctggactaggctgaccacacccacaccagggcaggatattcgagtcccctctgctttcccagatcctggagtctctttgatataaacagtcagctttgttatgaacagatgccaggggctcctcttagcctggagggcctgacttccagccaggggggcaccgttctgtccagctccatgctccactgcagcaaacatgcaggcggtggtgcgaaggacagaggcagcgtctcagcatgagcaaatcagccgggcagctctcatgcctccagggatttttttcaacatttcacaagggccaggcatggtggcatgcagccgtagtcccaactgctcaggagggtgaggtgggaggatcgcttgaacctagaagttcagtttcaatcagggcaacatagtgagatcctatctctacaaaaaaatattttaaaaaaaatgattttacaagagataggtcaggaattgagaaagagtgggaaggatgaaggcaggagatggtccttctgaggagcacctgcaggctggccgtgtctgggcacagggacagagaggtggggcccaatgccgccctcagggtcggggtggtgaggaggagggggagggtcctttccacaagtccatgctgagtctcacatagctctgtgcggctgccctgttacacatttcaagagtattgacccatgtcgtcttcacaactatgcttcaaaacattatgccagttttacagatgaggaatctgagacttggggatgcaaagtggctttcccagtgtcacccaggccttcctgactccccagcacaggcctttctttccctgggacccacttctctagcaaatgccagggcctcagtgaccgggtgccagcagggtgccggtggcaggcaggcactgggtctgtcccgtcttcacttggtgcccccttccctctttccctcctcatgcagcaactgaaccacccaaatatcatcaagtatttggactcgtttatcgaagacaacgagctgaacattgtgctggagttggctgacgcaggggacctctcgcagatgatcaaggtgagcgcctggcggggtgggggtgctgggggctgcgcagatctggagccaaaggtggcagtcttcctttagcccagtcccacaatgctctgcctttagccagaggcggccacccggggaccctgggcgcccccctgcagatgcccacaggcctcagctgcagtctggtgagggcctctcagggtccgtccccagctgctgttgctggaggcctctttctttccactggcctcagggaagctcagctcaaaagagcccatatgcaaaagcaaggcgaaggtggtgccaagacaggatggtggctgggagggggccagccatgggcagaaggaactcctctggccacccccagtgccccagcctaccacaggcacatgagccacttctcctgcctcacagaaggagcaggggcagcaccccgtttggtcagaccccagctcttgggaaagcatcttgtagatccactacctcattttaaagaaggggaaaactgagcccagagaggttaagagacttgcctgaggatacccagcattgtgggtacagagccatgcctgtggcccaggtctcttttcctggcctgggaccctttggtggacatggtcccaagatgctctccccagccctagagggggaacttcatttccatgttagggctgacacccaggcctggggtcttcaagagattgagtgactgttcgagtcacatgggcaggctcagcgccaggactggctcatgctccacgcccctacatacatcttcacctgcctcatcccaccacccagggcacagggcggagttcaccatgagtctggtgtccaggaccactgcagcttcagtgaaacagcagcacctcctgccagcctccacccagcccagtacgctcatgcgtccctcactgagtccccgccgtcctcaaatagcaaagctcagagaggtctagtctcctgcccaaggcacctcagcctctaggtggaagcccccaggcctgcctgacccccaggcccaaaccttcagcccctactccactgctccttagtggaggtcctcacgtccctactggcttggacctctgtccccagggccctgctgtggccccatcacctctctaccctggatgcagcctgcctgctcccaagtgaggctgggccccgctggagcccccaccctgctcacagccgcacttagaaacggggccggatgtgggttctctgtctttcccatcaggcactggggattgagcaattgctcagtgctcttctgaaatttgggtcctaggaatacaggcgtcactgggaagtggcattacttgagctgttatcacctgctcttacatttccgttgacatattaatgcctttgcagggatgttaatctgcacacagatccctggtgggaacagatgtgctagatcatgtcttagctcttcctctcccccgcccccgctttacttgtttctccttcacacggattcccttgctgaacatacaagcatcgtgtatccactgtgtgccagccctcatgccaagaactagggttgccgccagcatggctcctgccctcagggatcccagattctaacaggaaaacagaccctcgaatgagtagttaggagccagtgtgaacaagccatgtgcagggcctgtgggagtcagagaaggcttcctggaggaggtgacactgagctgagctgttaggggaggtgggctgtccagaagcagaaacggtcccacagggatgggaaagggaagggagctgagatggagaccaccggatcacgtagggcctgttgctccaggctcggggtccaggaccaggccctaaggtcagagaagcttcctaagattcatggcggtgaacaaacgtggtcagctctgtgttctagaagaaagactggaggccgggtggaaggagaggtgagggcagggacggaggaggagcaggagatgaaggagaggcctctccctgctgccacacgggaacgcagcccgtggagaggacgcctcaccctctcagccccagtggagcccagacactgtggcctctcagtccacggagtggggctgccgtcagacaggcagatggggggctggggctgggcaaatccctcttccctgaacctcagtttccaccctgtccccgggaacctcttggagggagcattgcaggaaacccaggccaggtgcagtctccctcagctgagagagaagaggagacatgggggcattctatccagcatcccttctctatgccaggcctgggatggggtgtctccttccctgtgcaccccttccttggcttcaccagagccaacactggctcagggttcaagtcagtcatgaacccagcaggattgagtctaggatgggtgtggcctcagtttctgagcagccacctggccccccacgcctcgggtccttcctcctcacctggcatggttccccctcccacagtccccacctctctccccccactgtccctgcctgctcccgttccctccaacccggctcaggggccctcacctgcagagctggctcggtgcagccgccagcaggggaggcctggcagtgcagagacccactcgagtaagacacgtcccctggatggcctcaggcgggtccctgtgcctcagttgcctcatctgtaacataccagcacaatgcctggggtttggtgggagctcggttcccctggttctgcctgctctcaggccacctctgggtttccagaggaacaggggataccccatggtcgccccactggcctcagaggctgtcaggcagcagggattgtgtcccgagagcctgcagcctcaagggctgagctgcgccatcacagccatggtgcccgagttatttacgaggaagagtgaagctaggagctgccgtagccccagaacccaccagagactctgcgcctccccgctaaatgtcagacagcgcttataggacatgacatttagaaaatcaccactctcggccacgcgcgtccctgcttaaatgctgtaatgaggattcactcacatcacagcgtgaataacatcccggcctggcccgccacaggcctggaggtggcctgggggtggggtctgtgctgagacctgggacggctcacctgagagggcctcccagaattgtacctcagaacagcctcgaggggatttacggcgaggtcaggggctccccactgcgactgtcccaccgtgggaagcacccagacctgggtcccagctgggtgctgggtgaccttgggcatgttcctgaacctctgagctcagtctcccatatcaatggttactggtgttattagaagtgggctaagggggccaggcgtggtggctcacgcctgtaatcccagcactttgggaggccgaggcaggcagatcacctgaggtgaggagttcgagaccagcctggctaacgtggtgaaaccccatctctactaaaaatacaaaaaatagctgggcgtggtggcgcacacctgtaatcccagctactcgggagactgaggcaggagaattgcttgaacccaggaggtggaggttgcagtgagctgagatcacgccactgcactccagcctgggcgacagagggagactccatctcaaaaaaaaaaagaagtgggctaaggacttgggctttctaggtgggaggcctggggctgagctgtgtttctgcctctttctacgtggccctcagtttcgtttccctgtctgtaagatgggcctagccctccctcttaggcccggcatggtggccacaccctgcaggtggtctgaaagtgctggcccagctcctttcctccacccatgcccctttccaggccagtgtgtcctggtcagttcccagcttcccagcaccagagcagctgccctgaccagcaggcccacagcgccgcctctgcctgctttggggaaaggtggttgctttgaagcaaaaagcccctgcacaaaaagctggtatgcaggtagctggtgaagaagtcctgccccacaggcatgggcctggcacctgagagccacccccgtctctagctgagccgtggctgtcacatgctctgggcctgccctctccaggaccttctgttacttacagctcactcagtgtggccggggacctttagtttttgttttcttcctggagcactaaatatgttttcccaggcagtgaagcagactgatgcccgttggaactggggttccttttgagtgcgtcaagcccatttcctcaaggttctcgccgcgtttgttaagaattccagtgcactgagatctgctggttccgaggagatgggggcagctgtgatttaaccaccacgtgtgtcctgggtgccaccctcctgggccaggctggggctggggacagggagagtccacacccatttcagtcttgcaaggagtgccctgtggagggggtgtccaggaggttctggaaaaatgcagttgagggccactttcagcatatttgagctgggtgtccatgcagcaaagccatccggacatgccaggcctgcctggccctcacggagcttgctgggttgggacagggtggctgcagagtgccattcaggcagaagtagaggcgtggacacagcactcttggttctgggcttattgtttgctcagtggctcaatcccccccccccgcccctgccaggcaccagttacccactggggaaaggacagaggcagtgccctgtggccacccacctccaagcccgctcacccgggcctatccctctgcttgtctcccccactgcagtactttaagaagcagaagcggctcatcccggagaggacagtatggaagtactttgtgcagctgtgcagcgccgtggagcacatgcattcacgccgggtgatgcaccgaggtacgtgccacccgccaggagccgcccggagccacctggagcccaggaagacacttcctcatggctcctccagggtcctcaggggcagccccttgaggaagttggaccgctctgtattccccaggcaagggggctgcccagcaaccgcgcacacacacgcgcccgggtcaggaacctccccgaggtggaaagtgacatgagccccagggggcaggggccccgcttggcacaccacttccagttccccacagcagcctgggagggaggtcgaggaagcctcgcacagaggggactttcatgggggctttgccgtctcagcgggctgggctgagaaggggaggcacctgagaggggtgtttccacagttgacatgattccgagttgtgagaaaggagcctgctgggtgcccggcagggcacgaggtcctttacgtaggctgcttcatggacacctccgttccttcactctacctgtatctcttggtgtctgctgtattggaggccccgccctcactggggggtacggcactgggtgctccactgagcactccgttcattcattacgcagattttccctgagggcctcctgtgtgcgaggcactgttctaggcatggaggatacagctctagagcaggaaacaggagcacagaaacccctgctgtcttaaccctcacagcagctctgtcaagttggtggagggagacccatttttcatatgaagaaactgaggctcagaaatggtcaatttcccgaggtcccacagccagagccaggacagggccttgccctgagggagcaggacctgggctaggcctcaccttcctcccccttcctctcgtcctgccccacctaccccaagcctcctaccccacaccaatctccttctcctcgccctgcagacatcaagcctgccaacgtgttcatcacagccacgggcgtcgtgaagctcggtgaccttggtctgggccgcttcttcagctctgagaccaccgcagcccactccctaggtaagggggacctgtctgtgccccagcagcccccagcggtcctggtgaccgtgcagggagacgcaaacattctccccacgtgtgtttggtcagttagtgcaggaagatgccttttttaagccccagggttttctcatctgttcagaatagtgacccagaagggaatcagctgtggccagaggagcccagctggggcttcccacaccccctgatcacctcccagcccttgcgggagaagctgactgagccggttgcttggagcagggggcgtgtctgtggcacagggcggtcatcttcccactgctgtgagtgtcccgttcacgggcagcacccttggtccatccctcctagggggtggacatttgcactgttcctagtttctggcttttaaactggcggttttgaggctgtggggaccaggtgcctgccagggaggaggtgacattgtagctggaccataaagggagaccagatgctgttgggacagggaaggggagggagcagcgttccaggaaacagtgggtgagcctcggtgtgcggctgagcttggctttgccacagaccagggtccttgcaggagtggcatgaaaagcgggcagggccttgaactctgagctcagtgggctggacaccaccctatgggtcggggggtgctgaagggctggactccggaagagacttggtcagatgtgttttggggacaggtgaagcaatggcaagcttcagtatccacacactgggtatgtaaccaaatgtgaaacttggaatgctgtacgatgggggatttttcatttagtgagaacaaaggaaccaagaaagcccccgcttccccaccagtggaacacaggagcagggtctcctgtgcgttactacaaggctgtctgggtttcaccacgcccatctgtgggaacatttcccagaggcccatggagtgggcgagggcccctgctttctcagggctatttcctggctctttgaggtgtgtttgcagtggaaggtgcccccaggcccaccccctgtgtgctgtgcccaccagcatccgcttccccaggagggggctgggccccaggagctgcccgccgcctccttgaacaccgccccattccagctcatttccaccccactccatggctcaagccaggacgtctcctatccccagacccccgagtgcctgcggcaagcggggtgtgagagacagcagcattgtctgggcggaggcactttctggaagtcacagtgtcttgtggaaagtgtcactgttcatacaggttccagagagactctcagcgcgtcacacacacttaggagaaatgtacgagcctagagaccagcgactcccagcagctgatggagccagcggggctggcggggagggggttgttttgaaactcttgtccccacctggccaggcctcaggagctcttcctttagctccaaagggaagatgtgtagggacccaccccccagggagtatgggacgttccactcatgcccttgacagccccaagcatccagccatccttccctttagcagaggaagaatcagaaatccaggcgctcgagagatttttccgaggtcacatggcagcaggcctctccttcagaacccacgctgcttccaggaaacgagggccgggggcctcggcagataccgttggagtccccctttggggacccgggccactgactctccgttgctggaaggaagcctcgtctttccttgtcccctcaaacatttacttcccttgtgaaaaaccaagtgtttcggtcagtttgggactgtttacctgtgtggttgaagggcttcgaaaagaccaggaaattcaagggaagctgtcaaagagaagagttagaaccgctgcgtcctgtcccccgtcagtcagcaccgagcctttctctgtcccactgcagaaaaaagactgtggcgctccgtcagagagggttaggatcgcatcattaggaatgggcagagatgcgtctcatccgacagtatgattttattgacttggactggtgcacttattatattaatgagaaggaattggaacttgggagaaggccgccctcataagccgggctcttcccaagccctccgagcgccgaccaggccacatgatgggtggaaggagccctcctggggcctgtccccactccgggctctgtgcccggcatccaggagagatgcccaatgagctgaggcctgcacggagctgagcaagtccctgccagcaggacaagctcccagaaccaagggcctgcacccaccaggttctagaatggtgacagtgccaagctaaagcccaggacctgtatctccaagacccaggggaaagaccccttccaccaagaggttctgcaaacagctaagtcttgcacacacgtttggttgggcaagagattgaactaattaccattgcatcgtgactcaggaggggcacaggggccagggacacttcacgccctgtgcgtggggatgaattatgcatctgccgcatctcatgtgcacctactatgtggggatgctgtggtggcagccacgttgccccagcaaccacctcatctcctaaggctgctgacccaagagctgggcttatgcaaatctggtctcctcccacttcccccctccctgggccccctccccgcctctgtatttgctaacacgaggctggcatgaaagggcattagtcagtgccatggtcgggctgacaggtgcggtacccagcggtggcagagtggctgcctcggtgtcagaaataggagccgtaattagagcgcggaacagaatgagcgtcagacgaattaccaggcagcagatcatatttgtcaggaaggattgcatacataaaaattaagtgacagtacacgccggcgtaatgcaggaaaaatgaaagatttgcctatacacagctcacaagctacaagcaagtgtctcgctccgagcaacggcagcagctgcaagacaaatcacggggctgggagagcgggcgggcaggcctggctcctcggctgtagtgacaggacagtctcggtgacaggcagccacgggtgacagggcaggaagggcggctggtcacacccaggcccatgcagggcccgtgctgcctcttgggggctgggagagcaagtctagttgggggtgaccccatcaggtactcgaggtcagggccctgctgggtctcccagggcttagcctggcgctgaggcgcaaaccccttccttcttcttccttgagcaaactgcctggccctgggctgtgtgctggggatatgcgattatgcagctttcgaggggacagacacagtccatgccaggtggcatggtgaggggacaggtgggactgcctcttggggcccactgtgggcaggcagggcaggcgtggggctctgtgattctatacagagccccagggagcccagggtggctccacccctcccagagccgccctcacttcgttactctgtagccactgaactcactgaaaagatgagttaaagacggagaaaaaagagttcaaaaaacattttgttttttcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtcagctgagatggcgccattgcacttcagcctgggcgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggctctgagcgctccatccctgaggaaaagcccacctgacctcgccagcagcaggtgttggtggacgacctggagctcatcctgggccccacagggaaggacagagcctcctctcatggtgtgtgtcagcgctgccttgccggggatcacaccgtgctgtgctgcgtctgtgcccaggcctggcatgggggcccttgtggaacatttgctgagtggatggacgaccttcatggccaggcatccctggggacacctgtccgtgcaggtgcggagggccatgcagatgcatcccaggccgcctcctgccccagccccaccctgcgtcccatcccaacagtgcaggatgcctgggaatgatcctgtcagtccctcgggcccagaatccctgcctcagcagatggatctcaggcctgagtttcagccgaggttctgagcactaacccctcggtggcagtcacaggtctgccaccttcctggcattttcaggggcacagactgttaggaagagatgagctgatgccaagaggggagggaaggagagggaagggccttaaggggccagcaagtgaggagtcaatctggacctgggatgtaaactccagctctttggttcattcattcgttcatccattcgacaaggatctatgctgggcctgggccgttccccgggaaggctggcttggcccctgcctttgtggaagatacagcctggtaggagaatccatttagtcttcaccatgaaccaaacactcctccaacaattgcttctcattttccagagagggaaaccaagtctgcagaggtcagggggggaccctctgttttcctgatggggagaccgaggctgagagagagtttctgttctcagccagggagtggaggaagcaggtgcagcccagccagctccagctccatgtcactgctgtccccacctgcccctgtctgtcccatggaggattcagtgccaaggcacagccccccagcccaatgtcccgccggctggacggatgtcagcaaggagaccgcatttctccagctgctttccaatccaccatctggggaagaggggcagcttgcagacaccagcctccccttcctgtgaaatctgcctttttcgtagctaatgaacatgtttcaaacaccgagagcatttcaaaacacggcaaagtttgttttgacaggaccggcgcatcttggggaagcggggcccctttaatcagcctccctctttcagatcccgcattctcctctgatatctgctgggtttgaaatcgggagttctaggtaaagattccgggaaggtcagggtttgtcaggctcttctttcatacacacagctccgtcccccaccaagaggagggggcggtgggagtctcagggaggggcatggaaacccaggctgcacagggctctgcctctgcgtctcggcatcgccgggagatgggccgggataaggcccgggctgcactgcacacagaggtcgtcctgggcaggacccccgctgtctgtggagacccctcctcctgccagcttccccgactcctcctcagaatcccagctctcctggcgtctggggatgcatcctccagtggcccgctgcaagctgggggtttctttgaaatctcttgttttatcttcaaaactcatgcgagttgggcattgtgctctgtagtgtctgagtggctattgtcagcgtagacaccaggctttacgtgacttattcccagacaagttgccatcacaggaagaggtgctgtatctgctcctgtagcttcccacagccctagctgcagtccaggacaccctgccccccagtgagacacagcaccctgactttaagatagaagggggagcagcccctcccctgggtcagggggttggggaacctgccgggaggcagggacctgaggaccctgtgctgccaggctcaggatgggccaagcctctctcagttaaggcttcactagttccttcactttctttacctttccgttgcacagatgctcaccgagcgtctgaaagagtgaggtgggtgagtgaggccttttggcagctccttttagacgggaactaacagtaacatctcttgtaagagatacagggtccaggttccacccctggagattgtggcccccaggtctggagttggactggagatccagatttctaaccagcctctccaggcaattcagctgcagcatggatcatttcagtccttttttttttttttttttttttgagactgaatttcgctctgttgcccaagctggaatgcagtggtgcgatctcggctcactacaaccttcacctcccgggttcaagagattctcctgtcttgccctcccaagtagctgggagtacaggcgcgtgccaccacacccggctgattttttaaatttttagtagagatggggtttcaccatgttagccaggatggtctcgatctcctgacctcgtgatccacccgccttggcctcccaaagtgctgggattacaggcgtgagccaccacgcccggcccaagtccattcttgatagacatggtctactggctgtttctgaatacttcctgggacaggcaactaactccctgcctcctgatgggcccactcctgcaaggtcccagcagggtcaaggctcagttaatcttagttggaggtgggcaggtggctggctggatggatgggtgatggacagactgatggatgaatgaatgggggttggatggatggatggatggacgatagacaattatggatggttggacagttgggtggatgatggatggatggcaatttgcaacactagcatcttagaagaaagctccaaattgcatttggatgtttgccttttctccgtacaccagtggaaatggggtaagcagagagagcagtgaggtggcagaggaatgaggtgaagagaggaggggacggagggctggtgaccccaatctctctctgcccacgtgcccaggctttcaatataaagccaggctgagacagggatctgtcggcctgccttggagctccagcagagggaggaggtggtgacagaacaaagggacaaacctaacgtttgggtcctgctgagcagccggctctccctggccaggggaggggaccttaaaggagcccgcaaggtggcaaagggaatagcacgtgcaaaggcacagaggcgagtggaaaagcgggctggggctggggctggagtagccgctgtgggaggacccgggctgagggccaggcactccaagcccttgctttccgatggtcctggccaaggcagcgccaggccacaccccggccccagtgtaggtgacctctccccacagcatccctcctgtagaggcccaggcagatccacagtgagcagaggagactcagggtgggaagagcctgtagggtcagacaggaaggggcttggccaggggtctgaagggttcagtgttagccagacagtgcacagtggtgtctctcactggggacaggactccctgcctgcatctgtcccctgccatctctgtgtgcaccccatcagccctacatcattgtccaacctgtaggcacatccatccatagcacccaggtgctggaatccacttacatttgtcctgaggttcccactgttcaccgagaactgtgtgtttcatcccatggttggctacgacaagccatccatttcacactgggctgttcctttacttttgctccctcgtgaccaaaatatacaaggtgttgctactggaagttgcgatttgctgtcctataagaaccccacacggattcatatgttgactgacagccctttctgctgagtagcggttagcccctggcttcgctcatcaagtatgcatagaggatgacacctttctcacaagcagggctttaagtgagggctgctgcgcttgtttggggattattgccatgaaaaggagcttggtatcctgatgaagcaataatcacatttcagacagttgagctccgggcagccatcagttaaataagcagtgtgttcagctgcaaggaagaattgtgggcagtggcacgtgccgccacatagctcacaggcaggcggactcattcatccagtgagcggacgcccacaaggcacccactatgagccgtcctgcgcagggtactgggatgcggcaacaaacaaagtcctgcccctgggagttcacagcccagatcagagatttccaacaccattacagcctctccaaaaactgcgaggtagttcttcatccatctccattaagataagaaaaacaaggccggatgcagtggctcaggcctataatccaaacactttaggagaccaatgtgggaggatcgcttgaggccaggagtttgagaccagcctgggcaacatagtgagaacctctctctacaaagaattttaggcggggcgtggtggctcatgcctgtaattccagcaatttgggaggccaaagcgggcagatacccaaggtcaagagtttgagaccagcctggccaacgtggtaaaacccatctttactaaaaatacaaaaattagccaggcatggtggtgtgcacctgtggtcccagctactagagaggctgaggcaggagaatcatttgaacccaggaggcagaggttgcagtgagccaagatcgcgccactgcacttcagcctgggcaacagagcgagaccctgtcttaaagaaaaaaaagaagaagaaagaaaaaacaagaatataatcaagttcaaaatgttaaacttgttcagttttgtaaagaactgtcctcagttttgagaaatgggttttctcaatcatgccaagctgtcttttctttaaaaatcatagtgactgacactaaatggtagttgggggctttgtgttttttaaatgcttccttcatgaaattaaaagttacctgtgtttttcccgaaatctcttgacccgtgaaaccctgaggcctgggcccggtgccttctgagtccagcccctgaatggtccattctcctcccagggtcctggatcccctcttcctcatgtcacaggccacatctcagccagcctttgccacgctgggactccagctcaccacagagactggttaggacagcagcagcctctgtcacatgacatggtgtctccaggccagtgaaaatgttctcagtttagcaaccttaaaaatccaggccaggctgggtgcagtggctcacacctataatcccagcactttgggaggccgaggcagacggatcacctgaggtcaggagttcaagaccagcctggccaacatggtgaaactccgtctctactaaaaatataaaaattagctgggcatgatggcacgtgcctgtaatcccagctactcaggaggctgaggcatgagattcacttcaacccggaaggcagaggtgatcgcgccactgcactccagcctgggcgacagagcgagactctgtctcaaaaaaaaaaaaaaagaattccgggcctatgcctccagaatagccatccactcaatgggctgataggagaatgtcaggttacaggaccagattcctgggctccactccagacctgctaaatcagcccctctgctgaggtgttcatgcctctggtgatggagagctcactgcttcaggaaatcctcccatctttgcacggttccagctcatccaatatgtgccctgctgcccagagataaccctacaggtgctgggaggtcagggcacagccctccacaatttcctcagtgttggcgtttcctgcggggagaagagggaccctgaggacaggccctgaagccctctggcttccctcttggcagcagagccccatcttcaccattaacacctttttcctcattcactttttaactgaggtataatatacatacagtgaagctcctggagccctttcctggtcaccactcctatagagtagcttttcctgttcttgaatttcacataaatgaaatacaataatgtgctgttttgtgcctggtttcttttacccagcattatgtccatgagctgcattcattttgtcgtgtataactgagatttgttcttttgcagtgctgtacagtatcccactgtgtgaacagaccacagtttatcaattgatccaacatttgtttccagtttttgctgttacaaacaaagccactctgcacattcttgattgtgtcttttgatggatggaagcactcatttgggcatctacctaggagcggaattgctgggctatagtgttggcagtgtttggccatggtagaaaccagccgatggtcttccaaagtagttgtaccattttaccttctcatcagcaaagcatggacattccaggtgctccacacatcatcgaccttgtttttctttaactttggtttttttgtctttaaacattcagatgggtgcgtaattgtacctcattgtgtttttttggttttgttttttgttttgagacagagtctcactcactctctcacctgggctggagtgcagtggcatgatctcggctcactgcagccttcacctcctgggttcaagggtttcttctgcctcagcctcctgagtagctgggatgacaggtgtgtaccaccatgcctggctaatttttgtgtttttagtagagacagggtttcaccatgttggccatgctggtctcaaactcctgacctcaggtaattcccacacctcggcctcccaaagtggtgggtttacaggcgtgagccaccgtgccattcattgtgttttaatttgcccttccctgatgagtagtaagaaaagtagcctcacttcatgtgcttcttggccactgggatattctcttttgtgaagtgcctgttcagggcttttgctcatttgaataagggggtagtttgtctcttatgtactgatttgcagaagctttgaaatatgttctgtgaagagtccgttgtcaggtgtatgtgttgggatgattttctcccagtctgtgacttgcctttaactctggtgtggtttgatgaactgaagttcctagttttaatgccttacacacgtttcctttttggttagtgccttttccatcctgtttaagagatttcggccaacccgagtctggaccggctaattggcgggtggccatgggcagagctaagtggtcagtttctggaacctgagggtctgggtttgaactaattcctgccactctcgtgcaaacctcttcacccatctgagcctcagtttctccatctggaaaatggagatactgcctcatagcactgttgggaacagaaatgagctgacacatggaagatcttggtcagcctccacagtgatggttttttcactgttcagagcctgatcctgactcttgcagattcagacagtccccttaaaggacatgtggtcagttgcttcccccagccgggccgaggcatccccttcccctgggcagctggcagaaacaccaacccccagctctccagccccatcctgattttttttttttttttttttttttgagcccgaatctcactctgttgcccaggctggagtgcagtggcgcaatcttggctctctgcagcctccgcctccctggtttaagtgattctcctgcctcagcctcctgagtagcttggattataggtgtctgccactatgcccagctaatttttgcatttttagtagaggcggggttttgccctgttgtccacccaccttggcctcccagagtgttgggattacaggcgtgagccatggcgcccagcctcccagcctgattcttggtctcggtgggtccagggaatctgcttcaagtccccggcaccccaggtgtttagtgccctgctagcatgggaacctctaatctgatccaactgctcatctgacagaggaaggcccaggcccagagagggagaagggctgctcagagaccgaggcacaatctctccccagctcccgtgtgccctccctccaacctcacctctgtgccctgcccctgccctacatggagcataagcagccccgccccttgctgtgttgcagtggggacgccctactacatgtcaccggagaggatccatgagaacggctacaacttcaagtccgacatctggtccttgggctgtctgctgtacgaggtgagtctctgtccgtggctcagcagcatttggtgggacatgcatggggggtgcccagttaggacagggctcaccctaccagctcagggttggaacccaggaatgtcacgtctgcctgaggcatcggtaccaccagggccctgtccttcaccctcctcagccccacgtggggcctggtctgcagggccaggctggtggaggctgttagggggtggacagcagtgggcggggtccaggaagggaagacagggagcacaggccaggcatctgatccccagctgcccctgcccccgtcgccctggtaaccacattaacacaccggcgattctgttcatcctttattatgggtcaggcccggtgcagggcacctggggtcaggagaggagtcagacttgcctcatgcccctgaatcactctccactgacaggtggccaccccctccaggcccagaaatgtgggtctccctaaagaccaccacctctccccaaagaccaccacctctcccctgagctgttaaatggagctaggggatggccacttccagacctggtggcctgcctggacaaagggacaggaacatttctgagtttcagtgagcccagacgtgagacaataagaataaatggaagccccccacccattttgtccagccacactggggccccaggtgatgagaggtgtggggagcatgagccactcttggccatgaagctcttgcagccaccggcaggagggaggcctaagttctccggtgtccaggttggcagccacacaagctccccactgtccctagaccaccaaaggctgggtggctccgggattccatccacctggctgagcccctccgcatctataagatgggaacaggaccacctgtcttgcattgtcctcagtcctgataaatgacagacaggaaagggctctggaaacccccccaggctgttagacaccaagcccggcttggttttacagttggaaccctgactgtttttctgctttccctggagctgacttgagcagatgtggggtctggcttggagctgacacactgaaagaacttcagtctcagctgctgtggccggtgacagtccacagcagtgatgctcaggacagcgtgtccagggcctgcctcgagtgctgcgcagttgtccacagagcctgattgctctgtccccttgggactgtcgactctgaggctgacctcacagcccttgtgcatgaacttgagggctaagctgcccaccgctgggccacgtgggacccgcggccgctctcgtggccagggggtcttgtggccagggtcttttggtggtgagatttcccctccccacattacagattgagaccatgagttcaaaactctgatctgtttgcagggtttaaacttcacagcatctttcttttgtttttttgagacagagtctcactcttgtcgcccgggctggagggcagtggcgcaatctcggctcactgcggcctccacctcccaggttcaagcaattatcctgccttagcctcccaagtagctgggactacagacgcccgccatcccacccggcaaattttcgtattttttggtagagacggggtttcaccatgttagccaggctggcagcatctttctttataagccagtgacctgctatatttcattttaacagactggctggaggtgtggtccttgtggaactggtgcttgggaccccttctcccggggctcagcagatgcgggtgacaagagggtgggaccccttctcccaggagctcagcagatgcaggtgacaagagggtctgtgggttagtctggccctgacagagctgggaagcaggccgggtgctctttccaggactccacagggcatcggttgcaggaggagctctttgaatgaggacctagctggagcagccatggcgagtgtgtagtggatggggaaggggcctgcaggtgaaagggggacgagccatttgtcctccctgcctccctgtctctccacagcccagctcctgggtgggttggggcggcgagtgttgagcagggtgtgtgggtgggctcgggggagggcagtggatgtaggagagaatttggagggaagtcagtgtctttagccataggagacaagacatgttaagtccaaactcttctgagacaggaggaaacctgctggtgtagggccctgtgtgcctgcacattccgaacagccccggggagggtgcgtgcctgttattttgcggagaagacgttaaatccaggtggggaaagccccgggtgtggagagttgttgagtggcgcagagccactgtgctgctggtgtgtgtcccccaggaggagtcgtgagttccagtctctccaggactcctctaaatccaggcaggtggccactctggccaccaaggtcgctgaggctagcagtagagtcacgcccatgtcacctgctaacccggctgtccctgggctcagggctccagcgtcaccgccctgcccccacttgccctaaggtctgaggaggggatgcaaacccacctgtaagtgggcatcgttcacccggtgtcagatcctgaggggcagagacaggcgttctaggtctcccaaggcccaggctaatgcccgcagcatagtggatggtcggggagcacaattttgaattagagcacgtgtctgtgtgtaggcagctcacttaccaactcactttcatccaaatcccagctccagggcccacccacggaaggatccaggcaagtcagcccctcccgggtgggcctcaggtgtcccatatgtagaatgagtggccagcccaccttgtcatagtgaggaaggaatgaggccctaggggtgaggtgcccgagtcagagaaggccctcgggcctgtccaccagctgcaggccaagcacgggcacttctgcccgcctccggcacgaggctcctgcagcttgccacatttccctttttgctttggccagcgggaagccaaagtgcagcccagcctcagtctccgaggaggctccactttgtcctcctttcctcatgtgtcttgtccctgggtcagatggcttttcgtttctttttccattctgctttgtgtttttgtaagctgcttcctgtctcccatgaaccatgggctctccacacataaacacacacacagcatatgaacacacacacaggctggccaggctgacagagctgtgcccacttccctggggctggggccgggaggccagcagctggctccctctgcctgtgccaggccctccacttgagaaccggccctgtggttcccagccccgttccctgcctcagtctttgtctcggctctgcagaggcaggcacagcccatcctgtgccaggcctcactgaattctggctcgggcagtcctcctccgagtcctcatttgtgggcacctaaatgtgcatctcacaaggcagtcccgccttcgtgactccctggcattgaggctcgggttacgccgagctgactcatttgttggagtgagtggggctgtgcggctcgcagctgggggggctggaccacagccggggggcggtgaggggacggatcgcagccggggggtggtacgggggatggatcgcagctggggaggtaccgatcgcagcgaggggtggtgtggggggacagatcacagccaggggtggataccagtcagcagtaggaagtgaatgaaacacagcagtcaagccctgaggggattagcgtcctcagggacatcaggcgctgacctaaccctagcagccccggcctcacacagcagcaggctgctgtggccacccatagccggcccatccaagggtaacggggcaggggctctgtgccaagtgaccccctccccactcctgcagtccctaaaggggaaggtgaagcaggcgtttccccagcagacagggaggagagccacatctgagcccacggccatgtaattggaaagaggcctcccgcagtcacgcccggagcctcccgccccacagcctgtggtgtcttccaggggcaccagcctgaagagctgtgacaaagccccctgccctctctggacaacagctgaggatcctgcacagggcacatacccaggtcacctgggccctggtgacagacacagccggagaaaacctgcccttccccaagccccagcacagcccggaaggctcaaaagcccctgtgctcatccctgtggctgcagtgacagatgccaccacgccgatggcttcaagcaacataagtttactctcttagatctcgaggattctggaggccagatgtccaaaatcagtctcgctgggctaagtcaaggtgtcagcgggcaggtgccttctggacgttctgggggcgaatctgtttccttatgttttccatggaaaatggagaggccacccgcggtcctcggtccccgccttgtgtcaccacagcctctggtgtgcgtcagcctggcgtcttcccctcttctgtgcccttctctctcgggctccctgtcatgagggctcttgtgggtacgttggggcccacctggataatgcccccatctcaggagccaacatttcatcacagctgcaaaatcccgtttgccctataaagtgtcatttacaagtcccaaaaattcggtgatggatgtctttggggcccaccattgagtcccccataccctctctcacacttgggcatcagctattaccgaggacctcctgtggccaccggagttgctggcgctgaccccagctagtgggagccaccacaaagccccgcacctggccctcgggtggggccccagcggagtgtcttgaagaggctggaatcaggagtgctggcccgaacatggagtgaatcatgactcgcaggccaggcggtggggagcccccggtgggagctgggagcaacaatgcccgagcttgggatatcggaaggccgggctctgttctcgttacctagatgcccatggaggtgcccagcgggctgcccgctctgcaggactgatttttatctatgtgggagctcagctgcaagtacggagctagaggaattggctcattcagtgccagtcccaggatcctcatagggggcctcctcgcagcagccttgaggtgcccagctgggactgagacccagcgagacagcggactcaaggggaagatctgcggagccttggccgggacgccgctttggaatcctgcttggacggcagagaggcctggacgcccctccgtggtggaggagcagggctgcagacctcctggcctccagtcacccttctgtctgggatgtgctcgagagacactgggtgacaagatgggtgtctgaggccctgacaggcaggagtcagattccccttgtccctctgacatctcagatcacacaccagcttctctgagccctcctggtgggggccagggcccacccacccccttttcctcggctatatgtcaccctgatgacaccagagagaagggcttggcatttgaggagcagcgctgagagccgtggcctcggcagttctaacgaggccccagacagtgagtcctctctatttcgaccagtcagagtctgggtggtcactggtagaaggagatctcgccgtccagggtaatcgttgtaatccgcgcagcccagagctttcttcacagcccattgccctgatgagggtggaaggcccatggccggcagcagagtgggggcaggctggggcggatggaggaggcctgttcctggggaaggccgagaggggtcctctggcatagctcactgctgaccccattcaaaaggcttttctgaaacgatgtggagaaagtgctggaaagagcagagacatgatgggaagtggatgccagcttgggggctcaatgctcccctcagcgttctggggcctttggagttcccagcagcgaggtttataaaattgagatcaaatgggcatgatctgaagttgaagatcggctgattcctctccggggtcagccacatgaaaaaccagggcctgcgttcacaggaccaacactcaaaatgtcccttctacgctgcacagtaacagtccaggaaaatccaccttaatcctccagctgcaactcgggggcacccagatcaccccaggtgaccgtcctggagtctcagctgctctctgttatggcaacagatgtcctttgaaaatgcccgattaaccctttgcacccgagagtctcattttaattcctggacatgcgtcacctgggtggtgcatttggcaggctcccagcccgctcctggtcaggtcagcagaccccaaaatgggcagggcctctgcatcctcacacttcccctgcctggccagaccctccctgcagccctcctccaagggtgggtttcaggctccacatgggttcccagcccttctctgaggggcccaagctcccagccagccggaagacagaggtgatgctgtccctaaacacccacctgaaggcacttggcctggcctgggctcctggtcccgagggtgctgaacctggggctgaggaaagcccacagtctccaggctgcactcagcagcttccccaaaggccatctgcaaacccaaggatggtgccaggctctgaagctcctccacgccctcctgaaggaggcaggcccttggggtcaccagacctgttcatggacgaacacagaatggggcaagaccaggaaacccaagctgacgggcaccctcaaaccctgctaccaaggactcctccccgctcagcctctggggcgcgaggacaagcgacggttccccaggtatcccagggcccctcggtaggcgcccaggagcccttggccaagaagccagagcagggtggcccctccgggggggaaccggggccagacagcaggagggcactcgcccgacggcacttcactagccggaggcattgggcctcggggggcggtccgggaggcaggcagccacagtgagctggagtgacgagaagctctttcccattatgggttcataatggggccagcaggtgccacgctgggctgctgcgccaccgcctcagggccactgtggcccctgcacacccccttgaggagtcccctgtgagtgccctgagtggtggggcagcctggcagcaccctgacagctgagaactcacaggaggccaccgccccacaggcctttcgctcccccgtggctgtggccggccttcagggcagaaccggtgccgcaggcctcacctcatcaaaggtggtcttggccctgctggtggtgcctcctccgtgtgccagcccaagcctcgccacaggcctgtgggtggggacattttacaaatgaggaaactgaagtccagagacacagcgagtgcagagctggggtcgggacagagctagggctggctgtggagccaggcgcttccctcccaccctgaaggttccctccaacatgctgctgcgcacctctatccaggggcaggaggctgcctccctccctcctgaaccccctgctccccctgccctgataccggcagctggcttccacaggcagcagctctgcgaggggctggcaagaacagccacagtgaaatgcctcacccttctccggcccaccccaccccaaaatgtcagtccataggtaaggaaagctctctgaacatgtggggcacagagacctgcccctgcaggcatcttggaaaaatcgcgttttatggaaataagaccatgcactcggcaacctgccacatggagcctgggtcccccgggctgaggtgggagcaaggtgggaattagcttgcagcgtccagctgcccttctttattgccttgaaagttttgtcaccgaaaccctcgtgcccacttaatccagtgacagaatcagggtagtgttgcgcctgctcctctgttgaaccccagcatgctcggtgattcgggggagaagtcctgctggactcgccgcggtcgggaccagagagaacccatgccccaacaatctggagcagcctcctcctctctagtccttctgagccttgaggccgaaagcttatcttcgttgttcccgtcccttgcagatggcagccctccagagccccttctatggagataagatgaatctcttctccctgtgccagaagatcgagcagtgtgactaccccccactccccggggagcactactccgagaaggtgagtttgcaggagccggaggcctcgccagccccaggaggccaccgaggcttatgagggccgctccaaaacaccacagctgtggggctgaggttaggctcactttacacggtgcagaaagggagctttctggaaaagtgacttggagaggggaaagtaggtgattgcactgaagaaggggtttcaccacgcagctccagtgtgggacccccaggtaggaaccagtggcacgtggcccttggcacatctccacctgttcagctcccaacttggtgctccagtgggaggccctctgctgcaggtccccaggacagggtctgtgccgtgccagacatgggaactgatacaggggcaggatgtggcaggcctggcgtccccataccaccagtggtggccactctgctcccatgacaggaaactacggcaggaggaccggtcagtttcctccttatataacagacttaacaccctgggcttctactgtcaacattttacactggctgcgggagccgtggacacagctcccatgggtctggcatggggctgtaccagttactaggaatgtgtgaatatcttattcctcggctccgtcaccttgaagatgggactaataatctccttggtggataatggtgaggaagaaaggacaggtttcctggcacagcagggtcaaaagtgtagatacatgttcacacactctctgcactgttcctaggtgagtcacctaacctccctgagtctcagtttcctcacctatacaatggggataatattaaatcttccacacaggatcagcataaggattaaggtaaggcaccaggctaacactgccaccaccatccaaagtggccaatggatggggcctggctcagtcagtgttcactaaatatcatgtgacccttatttctgttcaaggtcaacgctagtgggtgagtctggggcctccgtgggcccaccccataggaccacaggccgtcacctcacgataataacagctcatgttcagacttcctgagttgaatcttcccctcacccatttaccaataaggaacagacagacacaggcaagttaaaaagaccggtgaggcaggatctgaacccacatgcgcagccacggagccatcgtgcttcttgatggcatgtctttggtggcccatcaattagctggggtgaggctctggaaggagtgcccttgccccggccaaactgcacagggcaggtcctgggtgctgcgcttgtgtccaggccggaggctcctcgcagggcacctgtgctgagcctgtgcttgctggcgttgcagactccagggctagaggagctcgagtgtcgggcgctgcacagtgcccttcctctcctggctcccaagttctgacctgcacttttggaggaagtatttctcctccccagtgggaggaaaaacaagttgcatctctttacaaagttaatagttgccatttgcttttttcctttctcatcttctgaattcggacttgtgtatgattcagaagcttgaagctgtgcaactggagctggtgacaactctgtgctttggctgtcagtctagaaatgggagtcgccctctctacttcagtgatgaggctgaaatgaacattgaagcccctgtcccaagtcagccctttcctggccacgagcccccactccccggagcactggctctcgccgggccccatgcttaggagtgagaggtggtgctcaggagcccccagcacaccctattttaaagttatatcgctgcttagaaatgaaaataagacacttttattatttttctcttgaattctgaaaacttcaaacatgcacttattgacaactgtgcgtttacttcataaattagttcgggtcacagacacttcacctgaatctggttttcttgggtattttaacctgtcagaggccaaccacaggtaccttcccccgaatattgtaaggttcagaaaacagctgtcttgtccacaggcgacttcagactccgggagtggcctagcaggctgcaggccctgtgtcacctgggcttctcggttgtaaggcatgcacgcaggtgcgaggggataccctaaggctctgtggcccagggagaaaatgccccatcagctgagaggagccctagtctacaggaagcccaggccccatccctcagcctaacgggcctgcgcagcagtagcccccgggcctccagaacgtcccgtgggcccttcccagtccctgagtgagtgtggccactgagaccaccagagccccctctggttcaggaccacccagcttcctgctgctgctgctgcttcggctgctgtggcctgcggggctgaccacccctccagcagcaggtatttaaatggaaaccaatggctgtgagcccgtgatgcagggtaagatgtaggcattttaaggtcattattttaattaccattaaaataattggcactccggctatcagaagaatggaggcgatcagaggcgcaaggcgcccctcccccacctcggggcgggagcagccttcagtgtctgtataattaaaagctccgtctttcatgagcacaataaaggggccgggggtgggcagactgcagccctgctgcatgttaatgcgtttattatgatcaataagcccttgccttgagttttgtcctctggtttgggcatctgcgtgactgacagcagacacacacacacacacacacacacacaatttgcccaatggtgtggacagctacaagttcaaaataatttggaggttaaccattcttagggtctcaaagcacagcctttgggactagacaggcctgggaggggtactggctagcccttgggagccatgcggctgcgcaccccttacttgccccagctaaacaccgttcttcagctctaacggggacaacgggaccatctagttgctctgaggatgaagtgccttcatgcagacagactgtggagtgcggagcctcagtaagactgctttcttgagaataacacaccattctctcccctgcagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctcctacgctctcctctgagcctaggccagtgctcaaggaggatcagcaccctgaagggccaggccaatggccttagcagccccctactgcccccaaaaacaccacacagtgcc

SEQ ID NO: 15577 - DNA, 36023 bp, Human
  misc_feature (1)...(36023): n = A,T,C or G
gataattgcttgaacctaggaggcggaggttgcagtgaaccgagattgaaccactgcactccagcctgggtgacagagcaagactccctttcaaaaaaaaaaaaaaaaaatcagtatccctgggctgaaatgaaagtgtttgcagagccacactcctttcagaagctctaggggagaatcggttccttgcctcttccaacttctggtgactgccgtcattccttggttggtggccagtttctgcctctgtcttcgtatcaccttctcttttgcatgtgatgtgtttcttcttctctactatctttatcagatcttcctctgcctctgtcttacgaagacacttgtgattgtatttcgggcccacccatataattcagaataaccccctaccgcaagattcttaattcaatcacatctacaaataccctttttcctttataaggtagcattttacaggttccaaggattaggacctgatatctatgggtcgcagttattctgcttactatagatggcaatcataaagactcatctcaaagttggcatatattaagggctccagaaatgcaagccacctcctttctctgcatccctcctgtatatactaccatgaccctctgctaacattgccttcgaaagcttttcctttcaggaatgtcattatcacattaaatgtgtacctgctggggtaataataatgaaaataatagctgacagttatcaaatgtctattatagcccacacactgcaatgagaactttatccatgggatataggtattattataatcaccatttaacagatgagagaaattagaaaagtaaagaaggtcaatttttccctagttcacccagctagtttcagagctagggttcaaattagaatctctctaattataagcggtctctaattcatggtataatgatgtgcctttgtttttgtttatttgttttttaagagatatggtcttgccgtcgctcaggctggaatgcagtggtgcaatcatagctcactgcagcctcaaactcctaggctcaagcagtcctcctgcttcagcctcctcagtagatgagactacaggtgtgtgccatcacgcctggctctataacgatgttcttgattattataccttccctcttactcaggagtgaggttgaaatatctgatttcttgtcttggcctctgatcggaaccttccctggtgatttcttgtacctgctggcatagcttcacatcacagttcacagggtgcttttttgtcgtgtgcctgctctttagcagttgcttggtcctgagtaaatgcagtttaaaggaagaggaagtgaagagctatattctatcctgaatttcctccttgagtaacttgtttattgctcgtcagtgagttccatgactctggggatcatgatgatttatttatgtcctagcacagggcctggacacagaatagatactctgctagagtgtaagcttcaccaggggcttctgttcactgctgtatttgtgccttacagcagttcccaggatagaagagttgcacagtaaatatttattggctggatgtctggctgaccggcttagctcggtatggttagaactcaattacagctgtcatttattggctgtatatcatgtgttaggcccttacatatatggtaagtaatccttaccgtgctcctacagggtagaattgatgggttatagatgagcagggtaagggtgatagaggagtcaaagattctttctaggtttcagtcttagatactgatccaagtgttgatgaaacccaggaggaagagtttaggtagactgtgttgtggtatctgcaaccacagatacagggactactcttgggacaaggatccgaagatgggccccctgtttgccctttagcctggagatagtggtggtcttaatctacccagagcagagttgctcactttaggaactgtaggcttaaagccattatttccactgtgttctaacttgaacatgatcagtttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaagggtgagtggtgctgatggctctgatggcccatccttcattcaaaactttacctttagtgtcagctgtttagttacttattcctcaagcttgcactacatatcaggccttatagtttgtactcataaccaaaaatgaaccattcttgcctataagaccttcctaaactaggtggggggaagaaaactagtgagatgttaaggtgggaatgagtgcacaggccctgtgtgaccaagaacccacttaacaatcaggtcttaactgggattaatatacttcactagttatttcaggaatgatgacagaagtagaaatttttggatgaaaaggcatgaggtaggagattgctgaatgcggtatcattttgtttgctagaaccacggtgtactcagaggctaggcatgctcagaagtctgtgtctaggttggtgaggagtttggaatttattgggaagctttccaagagccattagcctgagataatatgaacaaactgacgttctagtaggatgaatatgaagggctgttttggagggtgaattggggcaggggaaacagaaaaccacctagaaagtttttagtagagtctagaaggaaatctgaaggatctgaaggaacgggggaaataatggcacacagagatgttgaagaaactcatctgataggagttggtgacatactgaatattgagcagcaccagaagttgaaatcgaggatgtggattaagagtaatgaccttaccagggagaaaaaaacgaaaaaaaaaaaaaaaaaaaaaaaaagtcaagctaaaaagcagggtgatttctctataggaccctctgaaaagaaaagaaaaagggtggggcaaaatgttggccttggcaatactgagtttgagatacctgagaaggatgcataaagatgtccaccaaggaagttggttatataggattggaactgagatgaaaagtcctgcctgcaaacaggcttcatggagctgttggcacagaggtggtagtaaaagtctagtccataggtgaaatcacccacagagagagcttagatacagaagagagaagggccggtgtcagaagcctagagtggtattcccatggagagtggagagtagaatagagcagtgtcattcagcagaaagaagagaggctctagaggcaaacagactagcttttagctctgtgaccttaggaagtttgctttatatctccaatattcaattatcttacctttaagatggtatgttacttacccttcagagttctctacgggattaagtatgataacatataaaatacccagcaaggtattaggggttcatagcagcagtgttcagggatgggggtgttagtcagatatagtgaactattcaaactggttttatagcattatgaatgcagacatccagatatactcagactggttttattgtgtatgagataagaaggaccttttaaaaacttgcccatcatgaagaaaggtaagagagatgtggaagtgcatttagataaatttaggtggtttataatttattataaatactaatattgagcacttatttatgtaccctccatatatatattctaccactgaatacatacaacaaccctgttattaactattatccccagtttacagatacagcttagggaggtaaaatgagttagcaatagtttaggggtggttatgttgacagttaacagttaactaaattataatttgttattaagcagagcttgtacctgcttaatacggacacggacaatgtactgcttcacatgtctaccatgtggcatagctgtttacatgttggaatgccctgtgtttactggatgatgaatgccatagtaggacatttgaagtgttaccaagtttgtcccctgcctgtctttctaactcatttctgaacactgtgcctcagggatgccttacactgctgtgcctgtactcaggttttttcctctacttggagatcttttcccttccccactgtcagtttcctcttattgaaatcttttccagccaccaataccaaacatgtactgtctgaagagtctgtcaacttcctgccctcaccctgttttggttttggcctccacttctctcatctccctttgttgccctcactgtgagtatcttatgaaagcttagttattatgggttgccttcttgactgctgtctctgatgaatcatcctgcttgttcagctggagtgtgagattctgaggcttccagcaaaactcacctgttttagggaagaagaaacttaaccttataacccctctgaccatagtcagaagacacacggagtatgagggacagggagctagctgtctccttaggactgtttgcatgcagagcaggcagacccagttgcctggtgaagtctgcgtcagggagagaaaccctgccacctcctggttggtgctgcgaaagcaggattaaaattgcagttgccgtgggagtattttgggggtaaggaatgttctgtatggacctgtggtggttgacacataattctgtgcatttgtcaaaacccatagaactttacaccacaaaaaaataaatgttactatatgtgaaaatttgtttaatcagctaggatgttttgggggttaaagggcagagagaaagaatgcacactatgacaaatgaatctagctggtgttacaaattagtcacataaccacacttaaggggttggagaaaaaaggagctaacctttgaaaagtattttgactgtatactgtaaggctaaaaacaaaaagaattacatacaaacaaagcactctagtttgtaaaatttgtttctctcaaggttatgtgttaggaattttttcactacttcatttgtataatagagtagaatcagcaagtaaatatattgtggacaatgagagtcaggtttctcacatcagagaaagaaagaagttataaatcagcaaaggagaaggccagaatgaatcccctcgtgctagattggaatcagtgtatcaatatgtattcgtgtttcagatagatttaaaaatacatagataccttgtgtgggtaggtgagttagtgtacatatgtatatttccaagctctagccactgagaggggctagaagcagataccccaggagcaatgagtacacccagcacccagatcttggcttccaaatatcaatgaaaggaatgaggactcattggaaaactggttgattccaaggctggggtaggggaaatataaaatgatcctggagcatcttaaggggccagcaagctaggaagtgctttctaaaaaaagaaaggaagcatatcaaagggcacagaagccaacctgaaagaacttctgatggccaacggtggaacaacttgaggaacaataactgtaggattaatttataacccaaaggataaaaatatccatgagttcataccgaaaggaataagtgaataaataaagagaagtgatcatttttcctttaagtgaattctgattaacaaatgtagaaggaggccaggcttagtggctcacacctgtaatcccagcactttgggaggccaaggcaagaggatcacttgagccctggagttcaagaccagcctgggcagcatagtgagactccatctctaaaaatataaatataaatataaatgtagaaggaatgagggaaatagaaaaatcaccattagggctgggcacagtggttcatgcctgtaatcccaatactttgggaggccggagcaggtggattgcttaagctcaggagttcaagaccagccttggtatcatgctgaaaccccgtctatacaaaaaaaaaatacaaaaattagctggcgcggtggcatgtgcctacagtcccggctactctggaggctaaggtaaacctgggagacggaggttgcagtaagccaagatcatgccattgtactccaccctgggcaacaaaccaaaaaaaaaaaaaaaaaaaaaaattcaccattagaacatcacagtaataattgcgacaagcaaaacctactaatggatgctaaataagtggcatcagtgtcaacagaaacagaatatttgcatagtctgcaaatatatagtaattacaaagggaaaaatagtaagtttatttagagaattctgacagacataactttagccaagtgatcaagattaacagtaccaataaaacacaccaacattgtatataccccctgatatgaaacactgagaaggtcacacatatacacacacagagaggtaagttcactcaatctaatcctgagaaaacaaacaagcccatattgagggacattcttcagaataactgacatttgacaaaatacccatttgaaaagtgtcaaagtcacaaaaaaacaaggaaagactgagctgtcacagattggagaagactatgaaggcatgacagctaaatgcaatgtgggcccctggattgtgttctggaacaaaagatatcagtgaaacaactggagaaatcaaaataaagtatgtactttggttaatagtattgtaccaaggttaatttcctagttttgatgactagacatgattatgtccattgttaaaaggaggagggtgtatgggaactctccatactatttttgcaactcttgtataaagtctaaacttacctcaaaatttaaaaaattaactattaaaaaaatgcagctgccatttgtggctggggctttttcacctatgtgcaagacagctctctgttgttctccatctttggatatggaactgagtatcttttcagacctgaaagttggctggtcagaaaactccttagcaaagcaatgaggaagatctaaagaagggtggtgaatggagactgggccctgtctgtccatccccactactgcactagtatcccccatgtatgttccttacccatcttgcagtcttcgggataaagtcaggctccttaaggtgattttcaaggcccctctgacactggcatcagccacctgatccctttccttctccatttggtgttccccactcacaatctgcattccatcctagttcttcaaaaacccagtgatgtttcctgttttgcacatgtggtttcatctgcctggaagaagagggggtttaaacatccaccccttcttctactcctgacttcaaggttcagcgtttatttgtaacatcctctaagaagccttctctgacaccatcccccaccagataaccctcctgtgcttccacagcttttttgcatgccttctgccataaccctggtcatcttgtgttatctttctctgttcactcatctgtttccctcattattagacaatgagcccctcaagggccatgatcaagtcctacttttctgttggtccttcagcaaataactcagtagtgataggatgctccctggttagatggattgactgtgatggagggccatggcaggaagtgggatggggaaaatattgtcagaggagaaatgaggatacagtcagcttcgtggcgggtggtgggggtgggtgtcatgttagttaagtaactgtgaaaaaataaaaaatttccttaactctgtggtctcataacttgctaactagttcaaaagtataaaggtcaaggaaagcttcttggaggaggtgatgtttgcagaatggcattgtgaggcagtgatcctgtggcatcgccatatcactttaccagggtaaaaagtgccccaggacacaacacagaggtctgcatgaagcactgagaaatctcaaggagggataacatttgagcagaatcttaaagaaatcaaagttcgtgttccttacaaacattttttttacatttcttacattttccttatgaacttttttttttacattttattataccaaaaaaatttgtagagacaagttttcagcatgttgcccaggcagctcttgaactgaggatcaagttcagctgagctaaactgagctcaagcaatcctcccgcctcagtctcccaaagtgctgggattataggcatgagcatatgcctgccaaaagattgtttgtttttaaattaagactttaaaattttgttctgttttatttttaaataatttcaagcttacagaaaagttgcaacagtagtaataattcccatatgccctttacctaaattcaccaattgttaacattttgccacatttgctttatcatgctatttgttttattattttccctcccccctcccccttgctcttctttctgtctctctcttccaccttccccacttcccacaggtaagtaagtgtgtgtgtgcctgcatgtacgcaccttcttagccatttgagagtgaggcataggcagtgttccttttatttctagcaatcacagtactgttatcaaaatcaggaaatttaacctgacacagtactatcttattagcagatcttattcaatttttgccagtcatctcagtgtcctttatagcaattttattttctctgatctagaagccacttcaggaaatcacattacatttagtttttatgtcttttcagtctcttttaatctgaaatagttcgtcagtctttctttgtctttattaacattgtcgattttgaagcaaataggtcatgtattttgtagaatatcccttaatttgggcttgtcagtttcctcacgaatacatgcaggttatgcatttttcgcaagaatgccatagaaatgatgttgtgtccttcttagaccataatatcaagagcacatgatgtaagtgtatacccattattggtgatattaacttgaatcacttggttatgatgatgtcacttagggaaggtgatgttgccagatttttccactttaagtttctttctgagtacaggcaacatatgcagagacagaactatgtaaaacagaatagcatgtttaaagactaacaaatagttatctacatgtagggtatagcatttatggcaagagatgaggatgaggggtcccaccagaaccagatgatagatggtcttgaatgccatgctaaggagcttagatttggcccatgaaccaaaggcaccaccgacaggttttgagtggagctttgatgtagttagctttgttatttatggtttctgggttttgttgactgcctaagcccaagcaaatgaagaatggtaggcatatgagttccaaagcagaaaaagtgtttgtggtgccttctgagaagatagaagagccatggctagggccattctctttcttagacttagataagagttacagcagaaccattcctgtaatactgcacacaggagccatttgttctttttaatcaaatcactgccaaatagattttagccctgctgaaaaacttgttagttcagtatggcatcaaggaacaagtacagctttagaatcagaagatctaaatggaaactccagctctgtcagttcttccctgagcaaatctctttacctctctgagctctgtttcctcatctcaaaaatgcgtgggagaataatacaccttccaaggtggttgtgaggatcacatgagataacatacatatgtgcaagaacattataagtttgaaaatatggtccaagtttttgtttttaacagaggcagtgtggcacattgtattgatttccacacttcaggtggtttcatggcatcttgaccgattttatcatctctaaatgggtactgctgtttatattagtctttcaataacttttaaaaatcaaagttaatttttaaaggcaattctttaccacctcattaaaactttgttctgttttattttgaagtaatttcaagcttacagaaaatttgcaacagtagtaagaattctcatctgccctttacccaaattcaccaattgttaacattttgccatgtgagttgcacatcagaataaatgtataatttaagaataattaataattaagaatgtataattaagagtttatgcaccacctaaaagtatcttatgtttctccactaggatgcatacatagtagtagtagaaagaagtctggtcttacagtctgatagtgtgggttccaaccctgattctgctctttagtttctgtctcttccagcaaaatacttcatttctgtgagccttagatccatctgttcaatgggagtgatactaatactttactcatgagtgattttacctcagagaacagtatgtaacacatagtagatttctatcatatacgtattttgttactctgggtggggtcgaggaagaagatgaacatttttttgagatggagttttgctcttgttgcccaggctggagtgcaatagcaccatctcagttcaccgcaacctccacctcccgggttcaagcaattctcctgcctcagcctcccgagtagctgggattacaggcatgtgccaccacgcccggctaattttgaatttttagtagagacatggtttctccatgttggtcaggctggtcttgaactcccaatctcaggtgatctgccctcctcagccttccaaagtgctgggattacaagtgtgagccactgtgcttggccgatgagcttttgaatttcagaacaagagattggcaagatgtaaatctttaagacatgtggccctttaaatgaaaagtaaagtatgttgctttcttttcacacctccaggacagtgaaaatgaggtaacagccgaactattaatacatttggtgttgtattccagtgacagatctttgttctctacctatgagctgaaataaagacatgtgagatgttattattggaaatagaaatacccaaagactgtcattgaccatggaacagcagagaagcgattgtaaagattttagaacttgaaattagattgaaagagacctcccagccaacaagcagcatacatctagctctaacataggctatgtatgtttcttactccaaattcacaacagctttttataaagcagaccgaccctgttgcctccatttagcagatgaaaatattaagattctagcaaagttgagaatagaaccttggatttttaactcaaagaggctagggagagggaaggattagttactaagtgcttactttacatgcaaggccctaaggttggtgttttatccataccattttatgtaatgtaacataaaacaagtaccagtattttctcttttcatttcagtaaactgaagtccagagaggcagagaaacttgttcataattatacagaccaggaagaaacaggatttggaccctaacttacttaattctgaatttcctgtcagccttttagttacctcagaaacagggttatatacttggagctcccaccttttgaggcaatcagtccctgcctggggaacttcctagattccttatgttaatttttttaagtggcaggtatatcctagcaaggcctgctattacataatgtcattagcttatcttctgtcattgttaacattaaccccttccaagctaccctccacagtggctgtcagaaagattttttaaaaatcccaatatgaccacagtgcccccctacattccttcttgtcctcaagctccttagctaaagttataccctagtctggcattcaaggctctttataatctaggcccaattggcctttccacccttatctcatgctactcttcccccacataggccacccttcccctatgctttagccagattaagccgcttggaaattcccagaaagaagagcttattcttaccttcagcttgctttttttgtacactgttcgctcaacctggagcactcttttcctggctgcctaaatcctacttaacctttaagactcagttcagaagttttcttttccagaaaggattgcctaataccgtggtcctactataattgcaaatcaggggttcttctctatgccccccgtattaagtgttccataaagagtgatgataatattagtagtagttgttattcttagtcaggagatactacttaaaggatgctttttatacttagtaaatgctaggtaagttccttcgactacacaggtgctctactgactgcctttgcagggagaaaccattgaggtcaaaattctgattaatgaaaaaaaccaaaaaacctgttctgattctacaaatcaaatctaaacttaggctgggaatacaaactattttatttaaaaatggaaatactctgtccctcccctagaatttgtcaaaaccttaagatgcatcatcctggcaggatgtttgtaactgaaggactagtgagcagtgctatcacctttttcgaacatattgaatgtatacagtgtgtgtagtatgtacgcaatgccttgggggccccaaaatattgctgcctatgaaggagcctggaataatagaaagaattgtgtgctttggatccagaaggacctgtgttttaatgttggattcactaattactgtcttatgcttttggccaagtaaactctctttttgtgctaagacttatatgagtgtgcttctgactgcctttcttgacttatctttccttccagctatcagagaagatggcatgcctggaggccggaataagagcattgggccagtccaggtgagttctagacctcagtctctgtggtccgtcctggaagcccagggctccagctgttcctgaaactgctcaccttgactctttcatctgctgctgaggagagccatctttgctttcatttctgtaaaagtgcttttacatcctggatgtgaaagtgctttgaaaatcttaaatatgtaagttaatgattaaagctcttcctgtgatccctcagcctttcctaaggatttcacagacagtgaacccagttatggttctgaaccatccagaggactttttgatcagtccttaaggttatagataactaagcctggcagaaatgagcaagactactttgctttgttcatttcatctaaaaaatatatcagcagaatattattgtcttattgtagagtaggaatgataatacccccattcaatcccacaaacatttactgagttcctactcttccaggccctatactgtgaactcagtctaatgggagaaacagataggtaaacagacatcatagtaaggtgagaggtaacagaggatgcccagggactacagagggaggggcatctattctgcttgggctagagccgtggttggggactagagacactcaagaaaatagactgtgaagagacccaacgatgaatctttatgacaaggagtttgttcaattaggctgcaacattgggcacatgtagtagagtggcagaagataaggcagaatccttgaatttggaatcagttcattagggagtggccttcaagtctttgactacagctccttaggaaaagtctttgttgggccagcctgcaccacttgttcttacccgttgttcttacttgccagcagaagagcttcatgagggtagaaaattggatatatctctgcccatcaggtgaatcccttggcacattagtaggcagagagcatgccttaggaattactagtggccaggagcagtggcacacgcctgtaatcccagcactttgggtggctgaggcaggaagatcgcttgaggccaggagttcaagacgagcctgggcgacatagcaagacagaccctgtctctaccaaaaaatcaaataaaattttaaaaaactattattgttactggtatgagccaagaggcaaccactaaaaggttttatttagatttgcattttaggaagatcattctagcaggtagaaatggtttgtgaggagtgaggtgagggtgagtaaaactgagggagagagaaagcagttagaaggttttcacagaagtacaggcaagagatacagataatagtttgaagcagagcaatggcagtgcagatagaggggagagaatagactcaagagatatttactgggtaaatttataggatttagccagttaaatgtgagggaatgaaagaaaggtgttcggagttgtcttaagacatacactgatgatgtttgggggatttcttatcatatgagcacagcgtacattcaatcaggctgtgtgattcccaactctgctgtgtttattctttttttctaaaacatttttattctcgttattcaagtcatatatatgtcttacaaattctttttgtttcttggtctggactaatagctgctcttttttattatggcagaagtaaaaaccatataacatgaaatctaccttttgaacaaaattttaattatacagtacagtgttgttaactatatacacactctgatacagcaaatctttagaacttttccatcttacatgactgaaacactatactcattagacagcagttcctcattttcctctccctttgcccatggcagccaccattccactttctgcttataagagtttgactactttagatacctcataaagtggaatcatgcagtatttgtgcttctgtgactggtttattgcacttggtgtaatgtcatcatgattcccccttggtatagcttataacaggactttcctcttttttaaggtgttttatgtatatatcacattttctttatgcatttctctgtcatcagacacttaaattgttttcacttcttgactattttgaataatgctgcagtgaacgtgggagtgcagatatctcttcacaatcctgatttcagttcttttggattaatacccatagatgggattgctggatcatatggtgtttctatttttaacttttagaggaacctccatgctgttttccatagtggttgcaccgttttacattcccactaacagtgcacaagggtttccatttcttcacatccttaccagcacttgttattttctggactggttttttgtttgtttgtttgtttgttttggggtttttttgttgttgttgtgttcttttacatacaacagacataacaggtgtgaggtaatatcttcaagttttgatttgtattttcctgatgataagtgatattgagcatctttttatatacctattggtcatttgtcttctttggagaaatgtctgttcaagtttcttgttcatttttcagtgggttttgttttgttttttttctgttcctgagttatgggagttccttgtatgttgtggatgttgaccccttatcaaatgtatgataatatattctcccatttcataggttatctttttaccctgttgattgtttcctttgttgcacagaagctttttagtttaatgtagtcacacttggctgtttttgttctgttgtctgtacttttggtgttgtatccaagaaatcactggcaagaccagttttatgaagattttcccctgtgttttctccaaggagttttatagttttaggtcttacatttaaatatttaatctattttgaggttgacttctgtgaacggtataaggggtcgatgtcttttgggggctgggggcggggcatgtggatgtagttttcccagcactatttgttgaagagagtatccaaaatgtggtggtagaaagcctcacaaaggacatgacatttggggttttttgtttggttttgttttgtcttcttttaagacagggtcttgctctgtcacccaggctggggtgggttagtgcaatcatggctcactacagcctcaatcttctgagcttaggccagaatctcctgcctcagtctccagagtaggtaggactacaggcatgcaccaccaggcccaactaatttttctattttttgtagagacgggtttcaccgtgttgtccaggctggtcttgaactcctggaactcccaaagttttgggattacaggcatgagccaccatgcctggcaagaggtgacatttgaattgaatcttaaagggcaagtaggagattgtcattgaggagtggtgtttcagggttaggaaagaatagcctcaaggacaaaaaggagttgaaagaaccttgaggcttcacggcttgagagtagtgtaaatgagcaggaggaaggccacgaagggccatggtgccagtaggaaggaagccacgccgtcctaagattagtgagaggcccggaatatggggatggaggagagggaacctaggtttctgggaaatcctatgagatttaaataagctctcagtcctgaagaaagagcaagtgtcctgagcacccatctaacatgtctcaattccttgtcaaagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtgagctttaaggcaaacccatggtcatcatctagggatcccccaccaaagggagagctacagaaaacctctggctgagtatccctgccaggctgtctcagccattgtactgttgctccctcagactcttggagtaggggtcaggaagattaaaaacagtgtttcccagccccttttatgctaaagaccttgaaaatgtcagtggtctcttctgcagactgataaagtgctatagcttctatccatgcccgtgcattcttcacctaacagaataacattttaaatgttgccattttccctcatttattttatcactgaaataaacctttttgacagttttgaattaaactgtaatttctctgcctcacaagagtcaatgtttttcactttataaattttaagaaacattgaaggctttttaagccagtcaaatttgctgctatcagagaatacaaacttagaaactcttggttcaagcatatctttagttagttgtcgagtgtgaaatagatccttcagctattagggaagctttcctttccccagaaacctttcttataggatatggattgacaaactttttctgcaaaggccagatagtaaatattttcagctttccgggcctaatggtttggatctcagcttctccattctgcctttgtagtgtgaaaacagctatggccatggacattatgtgaaccagtgagcatggctgtgttccaaaataggcagtgggctggatttagcttgcaagccaaagtttgccaaccccagttataggagatacatttaggcaaaagctggaagatttttttttttcttaagagatgccaggcatggtggctcacatctgtattcccagcactttgggaggtcaaggtgggtagattgcttaagtccaggagttcaagaccagcctaggcaacatggcaagactctgtctttttttgttgttgtcgttgttaattaaatacttttttttttaaaaaaagagatggagtcttgctatgttgcccaggcttgtctcaaattcctagccttaagtgatccttccacctcagcctcccaagtagctgaaactgtaggtgcacaccactgtggctggcttaggtttttttttttttttaattagttgacagagtggttagctttctccaagaaaggaaaggaaggcaaaaatctacctttgtcttcatatttaattaaagcttttatcccattcaggtgccccttcgtttgttctttccttggactatttagggggttgttgccacatgccgggttccttgctagatgctggatttgttttgtggcctagccaggacttagcctgtctgtgccttagttttcctagcagtattataatataaatacctactttgtcatcatagtctacaagtatctgttaaaaaactgtccagacatggcacctatacaaagaattcattcaaccaatatttattcattacctactctgccatgcactgagtgtccagtggcgaccccaacattcatatacccatagagtctttgtcttacagatgggaatctagtaggagagacatgaatttaactattaattatgccccctggcttgatgaagacacatacctcatgttcaaagaatacctaaagtcaccttctggctcacttcctttgagtaattactagacttgccatggctctgtttgacgcaagacttttctctccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatgggtgagtgagctccgcccttcttggccccttgcagtctcaaagtgtccctaccccacacccactcgcgtccctggctcctatacccgtggcttcagaatgagttggggggataatgactcaagtgtcaggggacaaatctgtgcttatctttgaaaccagtgatcccttattttttccttaagcatcctttctcatagagttgaggttactttccagttcctatggaattgagatagaagggcctttgattctgcttgggcctaggtaagccaggtgctgggatgggtcagagcacttccatgctagagatgagcagtaattctgggaatagttatatatcggatataggctccttcacaaagccctggctggttgtagcctgtctgcacccctcaccagcatccccatggctagcctggtggcatgtgaccactttaagtgcaggcttgagtgggtagaaggagtattctttcagtctttagtcacttctacctgaggagataacagttcagccttcgggcctacccattgctgcatccattactcctttggcctagagcataaacgatttgagtgttatcaagcttagacctcccaggaaggtatcctgagatttcttaagctagtctccagtttcagaagaggagattaaaatatctacccacaaggaggtcacacaaaccctttgtaaatctagatgtaggaagccgggcgtggtggctcatgcctgtaatcccagcactttggaaggcctaggtgggcggatcaccaggtcacgagttccagacgagctggccaacatggtgaaaccccgtgtgtactaaaaatacaaaaattagctgggtgtggtggcacacgcctgtaatcgcagctactcagtaagctgaggcaggagaattgcttgaacccagaaggtggaggttgcagcgagctgaggttgcggtgagccgagattgcgccactgcactccagctctgggtgacagagtgagactccgtctcaaaaaaaaaaaaaaaaaaaatttagatgtgggagtgtgaggaaaagtcttggcaaggggccttgagaggaagaaagctgaaactcttgggtctgtgagtctgtggtctcaaagccggcttttattccagttttagcttaaaggaaaggctgagcaatgctggttcctgaactcaccaccagggggtggagtgagagcagaaaaatcttctgaacttgttctctttccttcagtggtctggacgcgaggcttatttttgtgccagttcctttgttaggtgggcatcagatccaccccattagagttccattgccagaacttgaacaggagtgacttggattttctctaagacatggaacattagagaacaccaacaataaaagtcatattccctgacaattggacacatttcttttttttttttttttagacagagtcttgctctgtcacccaggctgaagtgcattagcgcaatctcagctcactgcaatctccgcctctcaggttcaagtgattcttctgcctctgcctcagcctcccgagtagctgggattacaggcatgtgctaccacgcccggctaatttttgtatttttagtagagatggggtttcaccatgttggccaggctggtctcgaactcctgaactcaagtggcctccaagtgctgggattacagtcatgagccattgcacccagccaattgcacacatttctaagtctcctttccccttagcagcctttcctcaccagacccgcctctccagccctgaacttgctgctggcctcagccttccccctttatcagaaaatcacactgaatggaactggagacccgtgggcatggagcaaggagcccattgccagggtccctttgtgcccttgggactaccttctctctgtacccttatcctcaccctctgaccaatggaagtgactttcccctgtccctgcccctcagatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacaggtgaggcctcctggctggggaggaaataccaaacaaccaaacaattgtcatccctgtaaggcagagttgcctggcccttcagaggataggcactacacctcataggcctggatttgaatcctcactctgccactgactagatttgtgaccttggccaagtctctgatcctcaggttctgaactggtaaaatggggtgataacacaatttccccagtaagatggttgttaggaatacattttatgcattcaagcttagcagaatgctaagctgtaattttttttaaattaatttattttttgagacagagtctcattctgtcgcccaggctggaatgtagtggcgcagtcttggctcactgcaactcttgcctcccgggttcaagtgattctcctgcctcagcctcccaagtagttgggattacaggtgcctgccaccacacctggctaatttttgtatttttagtagagacgaggtttcaccatgttggcgagactggtctcaaactgttgacctcaagtgatctacccgtctcagcctctcaaagtgctgggattacaggtgtgagccactgcacccagctgatctttattatacttggattactgagataacgcatccaggaaaaataaaaatataaattctgcctacaaggcaagagaggctctgaactggagtttacaatccaagaaagagacctaggggtcattttggtgcctatagtgtgccaggcattaggctagatttttttttttgagacggtgtctggctctgtcacccaggctggagtgcagtggtgcaatcttggctcactgcaagctccgcctcccggtttcatgccattcccctgcctcagccacccaagtagctgggactataggggcccgccaccacgcccggctaattttttgtatatttagtagagatggggtttcaccgtgttagccaggatagtctcggcctcccgacctcatgatccgcctgccttccaaagtgctgggattacaggcgtgagccactgcgcccggtctagactagatatttttaattgtcttctttctttctcgcagcctccagccttataggtggtgttgtgcctattttatagatgagaaaactgaaattcagagagactttcccataagggtttgggatttgaatccagagccttagatttgagcatatgcctgcctgcctgaaaagcttaggttctttgactccgtctgagatgtggtgagatgttgaaaggataggactaaaagactgagctattctctttgtcattttctggcataaaattttatcccagctgtccagtatccttaaaacctccctgtccagagtgggttgtctccctgctgttctggggcctgtccaagcacactttttactcatttactctgcagacctggagcacagggtgaccatattttctgacccctaaaatcaagacagatgatctgctgagatgactttctgccttgttaatccatatgaaaagtcttatagccaggcacgtggctcatgcctgtaatcccagcactttgagaggccgaggcagggtggatcacctgaggttggggagttcgagaccagcctgactgacatggagaacccctgtctctactaaaaatacaaaaattagccaggtgtggtggcgcatgcctgtaatcccaggtacttgggaggctgaggcaggagaatcgcttgaacctggtaggtggaagttgcagtgagctgagattgtgccattgcactccagcctgggcgacaagagcgaaactccgtctcaaaaaaaaaaaaaaaaagtcttataatgcttagtttgtatttaaatagacatttcaataaatgacctttattggccaattcaaaatactggaagtcatgggattccagggcaccaagaaggagaaaagaaaaggtgcccctggccgggtgcggtggctcacccctgtaatcccatcactttgagaggctgaggcaggcagatcacgaggtcaggagattgagaccatcctggctaacatggtgaaaccccgtctctactaaaaatacaaaaattagccgggcatggtggcgggcgcctgtagtcccagctgcttgggaggctgagacaggagaatggcgtgaacccagggaggtggagcttgcagtgagccaagtttgcaccactgcattccagcctgggcgacagagcgagactccgtctcaaaaaaaaaaaaggtgcccctatccatgaaagttggagaggggaaagtagcagcccttacactttcttcacagaactgggatccatctccccctcccacccagttgtggcataaagacaagccaagactcaggaagagcacagtgctccaagacctgcaagggccctttgcacagctaggggagggaggagtcagcttgctgactctctctacttgttttctaatatttccttattaatgatgcttactggcttcagggtgatctgtaaatgacagagttttgaacccagctgacactctgtctggtaaatagagctatctgattttgcagttgacctaaccccttgtccagagactctaattcattgtttccatcaaattcctgtctcctgctccataactctgctccataggggtgtttggatagcagtcagcctgctctgatgctgtcagggtttgcagagctggcccaaggatcccagcctctctgggtgcctggaatctaccagttcggcctgggactacaggatcagcctttggactccacttccaagtaatgggtttgcccaggccctctgcaggcaggcaggggtcactggcagtacagggttctctggctttgagcttcataatgcatcccatctcactgtagccagtcccttaagccccaagaccaaggcagaagtcagtaacagcagaagtagtgaggaaacttttccttccttggtaggaatttttctcatcaaggaggatctaaagctgtaccgtccactacagtagccactagcctcatttggcttttaaaatgtaaatttattaaaattagaaatttagttctcatttgcaccagccacatttcaagtgctcagtagccacgtggcgagtggctactagtacaaataaagatcatttttatcatcacataaagttttattgagcgttgctgtctttagaacatgtgttgctgctgagctgtcaagtggcttctgagaataggaatggatttgttgttaggactctactgtggaatccatcgatgcaaaaataacagttaaacttcaacatgttagttctgattccatggccatttactgagtatcatgtgttttgtggggaggaagctgggatcacaggtgatgcagacatggtttctgactcagagtccctatccttgatttagtggactgggaggcaaaaagaagcagatacagcttacagtgcagggttgtgttggtggagatggcggggcatccgaagagaactgtacaagcatagaccaaggagtgagtacgtctgttcacagggtcagggaagacttaccagaggaacagacatttgagctgcaccttgaagtgggaatttctaggaacgttgtagagaacaggaaggaaggaaggcaggagataacacaaagtcctagaagttagagatcctggatggttgctatgtgcagggaatcaaaagcaattttgtggatttagggtataaagagaatgtatctaagacagagaaatgaggggagaattgactagagagaaagatacaggcaagacaggtcatgaaggtgctcaaatgtcaatctaaataatttggggtttgttgtgtaactagtattaagtcttgggaagtttttaagtggaggaattacagagtcaggttgcattttagaaagatctctatggcagtaaagttcaggatggattggcgtggacaagaccggagcatggtggctgggtaggaaggaggctgttccatagcccacgtaaaagggaacaaggcctggacaaagcagcagtgactgtggagacagagagtggagcacaaagccaagagatgtcaaggagataaagtcagtgggacttcagcgagtggaaaatgttggtgatgactgctgattttttggactagccaggcaggtgggcaccaattttcttagccaggatgaaggagcagggaagatcaggatgggagatgagtaactctgagtttggtttaggtgtctgtggagtctgaggtgcatgtaggactgcctaggaggtcataggaagtggaagaacctctagagtcaggttaaccactggaaagcagtaaccgctctgctagaaacccaggctgtggagtctgtaattggccatagcactctcctaccttgcctgctactgccttgctcccactcccccagatggcctttacttcttcacaactcttgagtgcaagtgagttcctgctgtcatggaaaggcttttcccagatgatacatgatcacctccttttctcttctcaaatattgaatcaaatttatggtgcccatattccttaatcacaccgttatcagacagtgaaccgggtgaatttgatttaaagcagattgtagcaccagccagtgactgctcctggccctaatcaagactcctctcaggagaagatgccttgagctagatgggctttaatgggtacctctatctcatgagcaccagctccatttctgctagatctctggaaagttgcctcccagcttccctgcctaactataaggctcaggaaacaggcttttatttttgctacaataatgggagagagatgatgatgctatttgtaatgataacagctaacaattatgccaaattctatcttaagtgccttacatacattatttgttgaattcttactgctaccttgtgtgactggcactaatattatccctgttctagagatgaggagcatgaggttgagaggtgaaaattaaaggctacaaagatagagatggagctaagtttatcacctgtatctgttgtgctccaatgcccagcctctttaacattgccttatactaaattcttattttcccagagcattttcaaaaggtttgactttctggaatttgtcctgaaactagtcttagttttcgtcttggagtctttacatgggtgctgagatggcagtttctctaaggttgtggctgatggccactcctgggggtaggtgcatttagatcaatgaaaaagagacaactgagtttctcagcccccttaatgggacataacttacatagtgtcagtttcaattgctgactgaatggtccagtggtttgggggatcctggcaggaatgttttccttgtcccagcatgcttgtgtaatgggaacctagaagaagaatgggtgtgtttgtccaactttctggctttgaatgctgataatttgtagacagtgaatacaggggcattaaaactggagtgggcagatgtggaggaggcacggctgcaggcaaaggcaggcccgtggaacagagaacaactttgtttatcaaggggtgggatgcggggtgtggaggaaagctttgcagtcaggctgtggagactgagtgggggctgctaggctggctgccagcccccatcactgctgggggtccacggtggctgcctgttggaggaattttggaaaagaaggatgtgctgtccgcaagagaaagggcagatctagggtgtatggacaggccaggcacttgggaactcctttgtgtccctcaggtcaagagtcagccaggaacaggtttggcactcctggctaggggtctggctgatagccacacacctgcagggtctggagtgccagagtgaacacttggggcaaggggttgctgattaaaggacagagcattatctttgcttgctacatactaggccaccagacagatgctgacactgcctctcccgttgtgtcctccttttttgtgccctaccccatttcatccccacccctccagtcagatactgaaagaaattggcagtaaagaactttttttcccactcccaagaacataaatatccaacacagtgctatgatgaggagtggtcttcactcccaggcacaccgcctcctgcaagtcttagcatcctggaggcacttgcagtggcagttctgtgcactgtagcagacctgacatcctcccaaggttgggccctgctctgagttgctgtggggacacaactcctgaggtcccctgtggtagtatgtggttagccttttccaggtagcagctaagaacaagacaggatcaagggtaggcagtgtagtgctgagaaaagtccatatgcttggaattagaaaacctaggtttgaacattggcctcaccaccactaccatttacttcccgtgcaaccttggggtagccatctctttttctgcttcctcatccctaacatggaagtgatacttactatgtatccttccaggttatcaggaaggtaaagtgtaagaatgcatatgaaaaggcctaatacataatagagactcagtaaataactccctgagccttcatttccacatgtaaacaaagggggttatgatttgtatccattctgtgaatttattgggaatatcaataagattaaatgtagaatacttaatgtgcctcgcaggtagcagacactcaacaaatggtagagtggtagaaacggtattatagattggtggttattgtggttattcaatatgaatgtatcggccaggctgggaatgtatcagtaaagttgtaaaagccattgggccaggtagagagaaactgagtcagccatagtagctcaaatcagctaaaagaatccccagctcatactaggagccatgccaaggccgaaggtcaacgttccagattgcatgtgcagtcatctccagtatccgtggaggattgcttccaggacccccatggatgccaaaatctacagatgttcaagtccttcatataaaatggtgtagtatttgtgtataatctacgcatatcttcctatatattttaaatcagctctagaatccttataatactggatgcgatataagtgatgtaaatgccatgtaaatagttattacactggttttttgttgggggaggttgttttttttcttttttaggttttttggttggttggttggttggtttggtttttggttttttgttttattttttttttctgagacagggtctcactctattgcccaggccagtgcagtgataacagtcacagctcactgcagcctcaacctcccacgctcaggtgatcctcccacctcagcctcccgagtagctgggtccacaggcacgcactaccatgcccagctgatttttgtattttttgtaaagatggagttttgctatgttgcccaggctggtcgtgaactcctgggctcaagcagtctgcctacctcagcctcccaaggtgctaggactacaggtgtgagccaccacacccagccattatattgtgttttaaaaatttgtctttttttattgttgtattgttttgtaaaaaaaatatttttgatggagttggtggaacccagagatatagaacccatggatacagagaactagttctacctgctgctgaggctccccttggtacttaaaaagggcaggagcctctggccccaaccagagccaggctttccccaagcaagagaaaagtgtccctgcttgtccaggaagcttaagcctgcaaagccttcaaagttaacacagaaagcagtagattccagaaagcaatagttcatccccaggtgttctggaccctacccagatagggccttcttggcttggcacaggcctgtagtgcgcagatctgaagatctcaccaggaagcatgcctgaagctaagctgcttctctttgtgactgagctgtatctaaggcctattctgggacccactgcccactagccaggccactcctagaatgactcaggccagacttgacctcgtcttttataaactcctgcttcctgattaagtgtttgcctccttggttttatggtatctccatctctggtatgaagtatacccaaaacattaatcccctggggtggcctagcctggggctccgttgcctaaaacttggtctttcctcagagagctcactcctagacccaaagaaaagagcatgggggctttgagccacttctgctagggtacaccaccttagatactggaaaaaccaaggctttgggttcaggttccaaattcctactctgtcaccaattaactgtatttgtggaccagaccctcccttctttgaacttcagttgctcatttgtacagtgctgatgattatctcacctagctcatagggttgagagaattaaatgtgataatgctcacaaagtgcccagcacagaggatggcgtggtatggaaactcagttaacgttttcctccctcctgccaaagtcagggatgccaataaaaattttcactatgcataacctcagctctgctggaaacagttaacacaagcaaatacaatcagcagctttttttgcagtgtggcagaggctcacatagagtcaccatggcagctgccattgataccagaggctgaatctctacaatagctgtatcttaataatgttgtacttctccacatttatatcccagaccttcttgggcccttgttagcccaagaatgcaagcattatcattttgcagaggaggacctcaaagcatagaggggtcagatgaccttgccaagatctcatagcttgtgtgtgatggagctggatttgaacctaggttgactctacctgaccttggaaaaagcagcttgcatgagctacgttggcctgtagacaaagcatggatctgcctgtacttcccaagtggctttggatcccatttcccccaagctcagcctgtttaaggagctgtaggagctctctggctgccctttcctggcccctactggtgtcacagccaactgttaacacctgtgtctgttcctcagatttagtgatgaagggatggaggtgatcgagcggctcatctacctctatcacaagttccatcagctaaaggtcagcaacgaggagtatgcttgcatgaaagcaattaacttcctaaatcaaggtgagtggctggggtgggaaaagggacgtttgcagtgcgggaggcaggcagtgagcatttgccctcctgtttcacccctccttaccctcaggactatcacacagaatccatcacaccatctgggtttcaatccaggaagacttgtgcacccccttgtcatcaccctgacccttatagtacagggaatgcgagaatgctttggatttttttttttcttcaaactgaaatgccacaatctctataactcatagaggaaggaagaggattcgctttgtttagtcagttttaatgcatttgcacacagacaccaaggacagtacatgcgtcattttaaatatgtaccaagtttaccagtgactgaagaagagcagagtgactgatgaaactgttggagataaggcctctgtgacaggctggcagtggttctgacagccccttcagggcagagcaggggtgcacaaacacacacacacacacacacacacacacatacacacatacacacaatcaagcatggcttttaattaaaagaatgccagatgtgatttatgtggtatcttacctgcaaaggggcacttggcagctgctggtaaaaccagtatagggaggagggttgtattctcttttttccaaaatagctaatgtgtactctgctcctatagtggcactgggctgttctgctgcctgtggcattgcaagtgccctcgtcctgtgtcccatttccagtccagagctcctctcctcttggcctactcacccctacattggccaaacctcttcctgcttttacaccattcatgcatttatctggtgttctgcatgcttccctttggccaagccctgtgctgagcattaaagacattgagaaaacttagactcaggtctctggtctcaagaagtatacattctgatggcacttgacgtattacttgtgcctcagattgggggagaacagtagcaacttcttgaagaaggagaaatctgagctgagcctcaaagggccggtaagatttatatatagaatatttatgttcatattctatatataaaaaaggtgtgtgtgtgtgtatatatatatagagagagagagagagagagagatctatttagaaaaaatggaggggccaggcacagtggctcatgcctgtaatcccaactcttggagaggccaaggcaggaggatcacttgagcccaggagtttgagaccaacccaagcaacgtagtgagaccccatctctacagaaaatttaaaaaattagttgagcatggtggcacacaccctgtagtcctagcttctcaggaggctgaggtgggagaatctattgagccagctgcagtgagctgttgatcacaccactgcactccagcctaggtgacagagtgagaccctatctaaaaaaaatggagggacagcccaggaagaagattaagaacagaagcgcataggagggtgctgtgtgtgtgtgtgtgtgtgtgtgtgtgtgtgtgtgtgtgtgtgttttacaagcatgaatgtgtaggtattggcaaggtttctgattggttccagcgaagggcaaatttaaagatattgtgaaggattaatttggaaaggtaggttattcagtcatttgtttagtgtttactggtattctctggttgttttgggagtttggtatgaagttgagagaagccttaaccctcgaggggctctgtctgcttactgtcctctgtatttttttcctctctctcttcatttctcttcccttaggtagaacttagttcctccctatcagaggagatctcctgttgtgacaatgtttagtaacttagttgaaaaatgaacatatttaaggagctggtgtttcttccacattagaatgcccatcccattccctgtatgtgtgtgtgtgttttttttttttccacagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggtaacattctgggtcttgggctcccaacccttccttgcttctcttagcttgtgaagggaatgaggcaagcagtgttttcagggtgctctttccagcccatcaccaactgcatgaaagagttctcacccttgccctcaaaaaaggtctgttataatgagaagcttgcattctccatagagaagagaagttaatttcctgagctcttatgatatgcagggtactttgtggccttatatcatttaatctcataccagtctccgctggtggttggcaatattatagccattttatggatgaggaaacagagactcagagtatctcaaattaacttaatttcttgaattgtgtactttaaaagagtgaattttatgatacatgaattatatctcaatttttaaaattatcttaatttcacagaatttcccatgagctttgagggatcatttatttaaagtgatatctttagctgggcacagtggctcctgcctgtaatcccagctactcaggaggctggggcgagaggatcagttgaggctaggagttaagaccagcctgggcaacatagtgagacctcatctctaaaaaatttaaaataagaataggaaaaataaagtttaaaatcctgtatttgcagaggaattttatgtattggggtgtgtgtgtatgtatgtatgtttctatgtggtcttgaccccttctgagctttctgacatttaaataggtctatttcaatataaaatcctggcttttttggttgttgccttgcttcatgtggtaaagattcttgttctggctgtccagcagatactgaggggcagctcagaaatgtgacctatagaccgggattcttcctgtaaaattcagcaatacagttttttaattcaacataaaaattctggagaaagcaatacgattttaaaggaaaattatttcaatctgacaagggaatttttttttctatttcttgggccacaaagcagtctagcaaatgtgagctgggcctaaactattggaattttagggatattttgacagtttgtctcagtattttctaagctagagtttaccacatgagatattaagcaggcactctgtgaaataaaaggaagtcaacaattacatgccactctcctccatagaactgggtcctcagccttggcggcacttccaatcacctggaaaacttaaaaaaaaaaaaaaaatcaatgtttgagttgcacctggagaattctggtttaattggaatggggtagagcctggagataatcagtgttttcgaacggctccccaggtcactcagaggtactgtttgccagaagaaacacagccttaggtatttataaattatattagcacactgaatgctctgagaagtccttcaatcaagaaatctgtaaagctcttttaaccctgagtttctcaaatgtatttgcctctttacccctgcttctttttcccctagtacttttattaacctattaaaccattctgaagtgcaatattttatagaatattacttagaaaatctaccgggggttgagggggtgaagaaaacaggacagaagttttttggactacctgtcagtttcagcttccttatctataaaatgagggtaaaaagtagtacacagaaatagtgtgagaattcaacgaggtaatgcatttaaccacctagaacagagttaagtattccctgagtagtagaatgatgatgagttggcaccattactaggctccctgggcacccaaaggggtctggatgttaggatgttagcccagtgtgtccaacctttgtgatactcctggcacttctcttgccccagtcactcagcaaggtgatactctgcctccaccagcccaaggaggctgacttgcctgtccactagagtgaccactgctaactcttcttctccccccttgttcccaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttgcacattttctcagcagactcatacatttgtctgtcagacagcaaattgccttttttagcctcagaattgccagataaaaccgcacactgtcagggggcacagcgttgttaggagattcactaagcaagctaggagagacggctacagggtaggcacgcgaaggattgagccacgatcgtttacttggaaagcgagataattaagagattatggcacagagaccatgttttacgcaaggacgacttttcacccacgagccctaatggcagaaggatttcttgatataaaaccttgcttgccccccttgacgcatggccccccataattgggcaccacgggcgaactttgcctttttggcaagtccatggaattccctggaaccaaaggactcggctccaagattcctaggggccccccaaccccccatgtttccttccccggatcccaaaagcccacccttctgatttcccccccctgaacatttgnnnnnnnnnnnnnnnnnnnnttttgatttgaggaaaggtggaatgggctaaaatactattccatattgtgacaaagatgactactcaatggaatggggggtgtggccatccctactttttccacattttctcagcagactcatacatttgtctgtcagagagcaaattgccttttttagccacagaattgccagataaaacggcacactataagggggcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatct

SEQ ID NO: 15578 - DNA, 162914 bp, Human
  misc_feature (1)...(162914): n = A,T,C or G
cggggcccctgcaacccggggccgggcgcgctagccgctccgcggtccccgggaacttccgaaaatggctcgagccccaagcaggggaagaacagcccgggccgcgtgctgctgcggctgcagcgatcggtgcccggcctgggctcggcgctaggagggtgaacccagctgagctgtaaaatgtgtcatttctaacgagcttcgagtttaacgagaagcgtccacttcggttgcttcaaaggaagcaggctggatgagtgggggtattttgaggaggtagtcaagtttcccctccccaccccgatcaagctcagctctgcaaggagggcaggtgggggaccggtgggttggagtagatggtaaatcttgatgcagacctcgtctctttgtgtgttcctagaaatctgggggagttaccttccgagtccctgggtttgcctgtcctggaaatagagtctccaaagattcaatgactgtcgagcctgtggggccccaggctttattagcctgcagcaccttgcagggcaaatgcgaattcttgggtctaaggtgaagtgggcgggtgctcctgggctcctgtactgggagcatgccctgtggtcataacccaggtagcaggttagcttggcggctgaatgagggaaagcagatttttagggagctgcaaaggaggtctgtggctttgattgtggaagttgcttatgtttcctgggttgaatctgggatacttctgtggggtgcacccctgcagcggacccacaaggcaatatgacttttgcaggctgtggttgaagcacagaaggacatttttgtaggctttattgagggtttactatatatctaactcttagcacctaaaatgcattgcttcttaaatttttgaagctagtctgtgggaaagaatatggtcccagttttacaggctcagagaggttcagtgagttccggctgtccagccagcaagagggcggcaggcccctagtatattcattcctggccctctgaccagaagccagggtgcttttctcaggggcagggcgcttgggttcaggtgccatttcttgagtatttttctcactgaatttgagcccccacagccttgccgagtgaccatgagtcgccatcctgtacacctgctgctccagaaataacttgggttcatctgtgcagcatttctcaggaacttcttgtatagtgtcttgtcagaacggtactgttgggaaacttggataatttattttaaaaagaacattcactgagttcttttataagaactttataatatataagattatattatatctttttatatctaatataagattatattatgttttatatctttataatataagaatattctatgttcattgtcaaaacttggaaatcacagaaaagtaaaatgaaccggattggaaatcatctgtcagccaggtacagtggctcacgcctgtaatccctgcattttggaaggccaaggcaggaggatcacttgagcccaggagtttgaaacaagcctgggcaaaatggcgagacctcattgctactttaaaaaaaattttttttttttttttgagacagagtcttgctctgttgcccaggctggagtgcagtggtgcgatctcggctcactgcaagctccgcctcctgggttcacgccattctcctgcctcagcctcccgagtagctgggactgcaggcgcctgccaccacgcctggcaaatttttttgtatttttagtagagacagggtttcaccgtgttagccaatatggtctcgatctcctgacctcgtgatccgcccacctcggcctcccaaagtgttgggattacatgcgtgagccaccgcgctgggcctctttttttaaaaaaaggaaaaagttgcctgtcatcccatgagctgcccaaaccgctgggaatgaaatgactcttcatttgagttctctgctatttgggagaaatacctgaggccagttcatttcagcatagtttgtccttgggccttttctgggcaccgccttctgctagggggttgtagatgaaagtgcctgctcccagagaagcttgtctaacctagcacagtttctaagctacccaggctgccagaccgagcgaccgtgctgccatggacacaggtgagagaggggtgtcatgagtgcgggaatgaggaagacactggaggggacagtgtttgtgctaggctctgaagagagggctgagatatatacctggtggagacagggagaaagaggagagaggggaaggggctgaccaggagctgcggaaagtgtgggaggaagatgcattttgtgagaagcagaaaaagtaagagttctgagattggcaagaccagggtcaggacctcgcctgcagattggggattgcagatgtggagctggctggaagtccagcctccttgcagaaggtcttttgctgcagttcataggaatcatagtgaaagattacaactgccaaggaagactggggcgcgcctggagtgaggatgacctttcctggtggtctctgctggctattctcagtgaacttccctttgcatttagacgacattttgttagatttctgttggagtttttttaatggacttcccactattcagtctccagaggagtatttgattcagaggagaggcccttaggtgaagtggtggcagagcctgacaccaggcaaacaattgttgtgattggagttttgctgttttgttatctcaaagcaacagaaacgttgcttaaatatgttcataatctcctctcccggaaagtagaagaaccagcgtttttagttctcagtgcttaaggcatccagggttttttgggtaaacaggaaaccccttcacatcccgcatagtgtgcagctctggcctgttcctcatcccgcccccttgcattgcctgatacctccttggtgtgcaggactctccttaacccctgggggagatcttttgagtcattgctgttctttgggacattttctttctcatgcagcagtgcctggctggggcagggccttgaggggttcatccatacctatgtatatcctcagagaatacacaaggtcataggcctcacatttgtgggtcccaagtgccatggggaatcaagacagtctgggccagagggtggcacagggacaacttgctgggctggtgggggcctgtcaagtgaggcctggtggagaaaggttgaatttggagggccaggaacaagctgggatgcaggggaggctttctaaactctacagtgcttctagagatgacgaggaggtagggagtagaagagagccggacagattagggagctcccagggtgagcttgtgggcaggcctgcagaggagaagaggctcttccctaggagctcagagggacttgttctggaagactgatgggagatgtatgcagctgtttagaggctgctttggagaacaaatgaacatggttctggttgtgcaagcagttactgtggttctttttgctcatatatcttccaataaagacattgagcgaggagagttgataccgtcatgtttttggagcttaagcacagactggcagctgcgggctggattcagtccacagatatgttgggttggatccgcacgtgttcttgaggaaaaaaacaaaagaattgatggtcaatattgaaaaatcaggaagtcactcaaaaatctcaaaagcctggttcctgatttccttgaaaaatgagaatctctggtaactctgagcgcttgttcctgcctacaaggcagctatgggcaggagtcaggtggcggacactcccacagagcccctcaccactcccacagccagccacacctccgacggcccacttggacttttgacatttgcgtttgcatcccctcctcggagaaatgattcatgtttgtttgtttttgtctggactttgaaacctttgccccatcccttcattgactcattactccatccctcattcatcagggattgagcaccggctccatcaggctccgtacaaggctctggggactcagtggtgaactcagcagatgtcgtgctgcctgccctgaatacaggcatcctctgtgtgtcacagggtgagcaggaaggtggcaagagatcagacttgcagtggggagggatggtcaggaaactcctgtgctcctgtgacaaaatgggacttaaggtgagaggcggaggatgggtccacttagctgggcacaggcagtggggtaggggaccagtctcctggggtgggagcagaccaaggcctcctcagctgaagggaagaaggtccttggactgcatgtgtcagtttcagtcactcattcctttcttccctccttcagtggcttcactcatcgcctgcctcacggagcaacctcctgagggcctggagttgttcttgttcttgggacacagcaaagatcccggcctcctgggccataccttctaactgggctggccataagttaagcagttttgtatgtatgtttttaaagtccctttccttcctctctgtgctcccagcgaaccacaggctggctgggagtttcatcatttaccagaccctcctgccagcgctgtagctcctgtcaccttggagcagttcactgggcctgctaaagtggccacaggcttgcccagcacgctgcctgaagatggaataaataggtgtctcacgctcagtgtgctacggtttcaaatgtgtgaagatgcttttattgtaaatcgaaaagaaatttataatgactgcatttcatggtcacatttttgtcatgatatattttctcagaacagatactaagagtacaggccctatgatgtagggctactcatttttgtggcctgagaaagaggtcctcttagattggcagtcattgtatttcgatcaattttaaactcgtcaaatttgtacttcctttttcctccatagttaggaatttttgtcgtcaaagtatactcagtcaagcaatgagacattttgatggcacctgctctgcctcctttcactcacccgttttaacacttactgagtgcctccttgttggcaaacaccaagtgatgcctcgtggcagggagccagcaggaacctgtccctggaggccacagtccaggggtagaatcagaacgatcttgaacatctctgcaatttcctgtggttttcagaatgcatttatagactacctcatttcatttcatcctcacaacagcccagggggtgagggcagggcggagtatccctcttttgcccctcagggcagctaaggcccagggaaatttggttgtttgcccaaggtcatgccctggagaagtggaatggggaaccggccccctttcttgcctttatagagcactggttagagcctccctggttgctggggacacagctttccatcttaattcttcaggcttctcaatctcttttctgatctttgaaaaaaaagatctaccaatgaaattaagggaggctcactacagtctttagactgcgtctgatactcgtaatactaatcacattaacagtgctgtagagagataagaaatagcactaatgccagctaagtgtgtttttagaaaaatcaaccacagcaaccccaaatgtttcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatgtttcactcattcaaaatcaaagccccagtttcctttctgcaagttaaaaaatcaacaagtgaaatgttaaacagatgattagctccgtgagggagtgtgtctaccactgcggtgccattacggtgccttgaacgcaataggtgctcagtaaatacttactaaaagaatgagtgaatttagttaatattatcatagaatgaattttagtttctggttccaagtctcaaattatctttagatgtagcttattgtggtttcaaattgccaattaggatgtttcttggtacattagtaggaccaatatctgatcagtggtgtgcagttagttgggggttctgtgttttcctgtagtcctctgaacactaatgatgaggttaggatcaaattcccagaacaccattgggagaacgccaggacaccgtgaaggctgagccgccactcggttctgatgccgcatccattggtcagtgcacgttctttgagcttccacttgagtgcacgttctttgagcttccacttgagtgcatgttctttgagcttccacttgtagtgactgcctggttctttgggatgtgcaggagcaaagcgctcttaggcaatgctcgttctgccctgtgtttacaaaccaaggcctgtgccagctctactcagcctgacacccataatgagcaccatcccaggaatccctgtccctacttgttatttttttttttttcagttggcctttgaatgtgatttaggactggcttcctgcagcattactctcttttcccaggatgactgtgcagcgtgtgctgtctagggctggggtgcaggctgttggtgtgcctctggcacccccttccttctttgtcaagaggcatgggcagtattttcttgctacttccccctcctctgtgagctaaggtacagggggggaggttcatctgaatttattagaaatctgctgtctgctggtcacaattcctttctcccactttcttctcccaggctgtagtttgaaagacaggtgacaattctctgaacccaagtcccaccctgcagtctggactgctgcttcccggaacaccacgactcctgtaacagcttagacttctgtccccacagtcccttagcagcagctttctctttgcttttcactggcttgcccaaaccacacagtgactttactgcatattaagttttgtgatcaggcgattctgcagtgcttttaaagcgtagaaatggagcactgagcacaggatgctgtgtggtttgcccagggctgggttcagaggggcggatttcaggcatttgctctatagcttttaaaatttgtgccactgatgtggacctgacagatgcgattcccagccacacactgtattgttaaaaacggagcaggagtgtgacactgacagtaactgagagaaggaaggacatggaatgagaacagaggacagctgacatccagtggaatgtgaccgtgttaaatagccacttagctgaccccaaacgagcaaacaaacaaaacccctggttggaaacagtggttgtatttatttgctggttatcacatgcgcccatcctccttcaagtgatggttctgaataaatagatggatgattgttcatgagtcatggaattggctactctcaacccctcctttcaataataaatacaaataatagtagtagctgatgttcattaggcacttaccacgtgctgtaccaggctcgcttctgtatattttacacttgtggttgcatttaatccttacaataggagaaaggtactgttaactgttctcatcctacagaggaggagactaagacacagagcttttctttgagacctgaaagagttaacatttgcacatagtcatatactgagttggggcaaagttaggactaaagcccatctgactattccccatgcatctatatttttattgattctgatattattctcttggctgtgtgacttgggtgaaaatgagccttcatgtttccagggacccctctgccacagaggcagctgctgcactaacaggacaccccatcatcctgagggttccttcagaagacagctctcctcctgactgtcctgctggagctcacagggggctgcggaagccttgcttctggctgggtgaccgtgggcaaattgcttaatctcctgagcctcaggtgcctttgttgtaatttggtagggtggataaacccaccccggagccctttctaatgctggttcttcttctttttttttttttttttttttttttttttgagatggagtctcactctgctgttgcccaggctggagtgcaatggggtgatctcggctcactgcaacctccccctcccaggttcaagcaattcttctgcctcagcctcccaagtagctgggatgacaggcgcccgccaccacgcccggctaatttttgtatttttagtagagatggggtttcaccatgttgaccaggctggtctctttggccaggctggtcttgaactcctgaccttgtgatccgccgcctcagcctcccaaagtgctgggattacaggtgtgagccacctcccagcctaaggctggttctttgggagtctagactgcagtatgtggggtggacttattgaggcttgttttgttgatgatttttaatggcagtaaatgttggatagcacttaactaatcatcaaaatagcttttgaaacatttttgtacacattagtttctttgttgttttgggctttgttaatttgtttctttttttttttttttttttttttgagagggagtctcgctctgttgcccaggctggggtgcagtgatgcagtctcggctcactgcaagctccacctcccgggttcacgccattctcctgcctcagcctcctgagtagctgggactacaggtgcccaccacttcgcctggctaattttttgtatttttagtagaaacggggtttcaccatgttagccaggatggtctcgatctcctgacctcgtgatctgcccgcctcggcctcccaaagtgctgggattacaggcgtgagccactgcgcccagccaatttgtttcttatcataagtatggagttgcccaagatttttcccagatgaggatgatggcagctcacatttattatttcctgtgtgccgggaacgatgctaggagctttaccttcagacgtgtgtgtgtgatttaattaattctgttcttataaagagtcagcaatggcaggtattgtgcccatttgacagttgaggaaagggaggcagcaagagggaagtgactcgccaggggtgggttgtgtattgctgagaactggagtttcacttctctccccttcctggggtctagggctgacttgccggcaccaccactgccttgggttggaatgtactctggggttcccccggggctttccagcctctctgtaggactgttaaggtggcaccacatctgcctacagatttatgaagaagcccctggtttctccattattgaagtggcttaaaaagtacatttgctgaaaatattgcatgagaatctgctttggagaaacctttcacagatggcacaacggtaggaagtggcccttacgagttaaagtagttccacccacccacccacccaacactggctgtcactgagtgtcaagcagcctgccaggggaggagagggtactgagagggctgaggcgtcagtgcccttggggaactgacagtcagccaccacctgcgttgtgtacaggagacttttgatcttggctctcacaccctcatccgtgttagaggcagcatgagcctgagctgagagttgggagacctgcctcatggcccctgggcctgcactgatgcactggatcagtgcccctccccaaccctgtctttccatctgtgcagtgagccagtacagaacagtgtctgagagcatgtgcttcaggtcctctagctgtggctttagataccagccctcctgtgtcattgttgtgggatcttgggcatgtcactctgtcttgtctaactctcagtttttccttatctgtaaaatggggaaaatcctaacagtacctaccttatggtattgagggagaattaaacgagatgatgtacataagcatttaatcagagtctggacacataagaagtgctcgataaatcttagcttttgttcttacttcaggtcgccttctactctaaagtgaccatttctttaaaaatggtaatctggtaactaaaattcaaacctcagcactcacagagaaggggaggtccctgactattgaggtatttccttttaggctggtttgttctttctctttctctctctaagaaagctgaagtccagggagtaggtttttacaattaagtaataaacttttgaagtgatcactcgtaggaagagtagagggcaattcatttcagctacacatatcccagtgcatgcaggcagaccaggaggccctgattttaatttgagtctgtctggaaggaatgggcctgtgcttgcaggctgtggtatatgtcagagccacagcagggctgatacaccaacaggtatattttttgccctgtctcaagggacacctccccagtttctccttgcggggtgactttcggggattaattaaatcatcttcgttcagctctggaggtgaaatgatcacagagtgttgcatttgtgacagttaaaaaccacaagacattcaaggtcctcgtgtacaaagtaacttacaagttgcattgagcactgcaagaagggggatttcataccctttatttttctttcttgattaactttcacagtaaagataaattcagaaatgctgttttggtgttctgagtcttccttaacccctgctccactgggaatttcgggtatgtgaaagtaaatgtgtgtagtctccttgcaaatttgtcagtgcagctagcatgaagcacagtgctatttgcagagagaccaaagcccagtcaacccttttcactttctgtaatcatttggtcctggagctacagaacctctcaattagcataaccacactaatttgtgcttctgcctcagcttgtcaagagtgccttgcaaatattaattctctgagctcatcagaagaccaaaggcatagatcaaaagcatgcttttctgcatgatctgtccttgtttttttctgttcatgaggagctttctctattaattaccctaaatatgcaaggttgtagaatgaagcttttatatttgacaagtaagaattgggctagggacctggattacagggactcgggctagggactgcctgtgctgcaggggtgcggagttccctggcctcagcttggcaggagaaatgcacgtactgctgaggaaattctgtaggctaaagtcatggggagcgtgtgagtcatgatcaccagaaatgcctggacctgtggcatctttgggcgatgaagagggaaccagcttagcactgccacagacacaccatgtcctctggggcaagccaggattccttcctgggcctctgaaccccactctataattggagggccttgaactggaacagaggttcctgagctttttaagatcataggtctcccaggagtctgatggaaactctgtggaccttgtccccagggagaaagattcattatgtgtggacatgtttctgccaagccgtaaattcccactactatatgataagtgagaattcgcaaatacccggggtcttggaaagatcaaatagaatttttgttgtctgaaacaatcaggacttagttcagtcaggtctgagccctagtaacagtaattatgcattcccagaatttggtaaggattttgtgaaatggggcttgtaagctgctgggtggaatacctgcatggataaaagggggaaccttccccttatgggtgaggtttaaaaaaaaattatgtatagtaaaattgatgttttggggatatacagttgtattttttgtttttcatttgtgatggggtcacactgtcacccaggctagagtgcagtggtaccatcgtggctcacagcagcctcgacctcctgagctcaaggagtctttcaatttcagcctcttgagtagctgggactacaggtgcgtaccaccacacccttttcatttaaaaaaattttttttgtagagacaggtttccctatgtttgccaggctagtggggtataaagttttgtgcgttttaacacgtgtagatttgcataaccactaccacattcagaatacaggccaattccatcaccctgagtgaaaaagccttcttgccgcccctttgcagtcatacccttctcccaccctggcagcatggatctgcttcctttcttttttttttttcttgagacagagtctcgctctgtcccccaggctggagtgcagcagtgccgtctcagctcactgcaacctctgcctcctgggctcaggtgattctcctgcttcagcctcccaagtagctgggattataggcatccaccaccgcgtccggctaatttttgtatttttagtagagacgggtttcaccacattggccaggatggtctcgaatgcatggcctcaagtgatctgcccgcctcagcctcccaaagtggtgagattacaggtgtgagccactgtgcccggccagcattgatctgttttttatctatacctatagatttgcattttccagaataccgtgtaagtacaaccataaagtgtgtaatcggccttttactctgtactgactttgagactcgtcaagttgtcctttttatcactggttcattcctttttattgctgagtagtattctattgcattgacataataactgcttatctgcgtgagaatttgaccttggctgactatctgtctgtttgctagaaatagacaaagatggcacaggaccaacaaaaaacaacccaattttggccgggtgcagtggctcacacctgtaatcccagcactttgggaggctgaggcgggtgaatcacgaggtcaggagattgagaccatcctggctaacatggtgaaaccccgtctctactaaaaaatacaaaaaattagctgggcatggtggcacgcgcctgtagtcccagctactcgggaggctgaggcaggagaatggcatgaacctgggaggtggagcttgcagtgagccgagatcacgccactgcactccagcctgggtgacagagcaagactccgtctcaaaaaaaaaaaaaaaacacaacccaatttttaaatgggcaaagggcttgaataggcatttctccaaaggagatatacaaatggctaataaacacatcaaaatgtgctcaacatcactgatcattagggaagtgcaaatcaaaactacaaacagagctgggtgcagtggtgcgtgcctgtagtcccagctactcagaaggctgaagtgggaggattgctttagcccgcaaggtcaagactgcagtgagctctgatagcgctgctgcgctctggcctgggtgacagagtgagaccccgaaaaagaaaattagctgagcatggtggtgtgcgcctgtagtcccagctactcagggactaaggaggggactgaagcagggggattgcttgagcccaggagttctgggctgtagtgcaccatgcctacctggtgtctgtactaagttcagcatcaatatgttaacctctgggactaccacgttgcttaacaaggggtgaactggcacagagtagaagtggagcaggtcaaaactcctgtgctgatcagccctgggatcacacctgtgaacagccactgcactacagcctgggcaaaatagtgagacccccatctcattcattcatacatacatatatatacgtacatacatacatacctaagtacatacctacctaccacagggagataccagctcacacccatgaggatggctgttttcaaaaactcagaaaatagagcttgcagatagctgaacaggtagcacagctggggaggatgtggaggctccgtgccccttctcacaggccctgcccagtgcagctcttcatctgtgtcctttgtaatatcctttatgataaatgggtaagcacaaggcagatggaattaacagactgtggctgctgtttttaaacagggtttgccaatatctgtgtgtctcttgggaggatgaggccatctttctgcaacaagggagaacagaatcacaagatctttagggggggaccttgacatttcctgtggcagatttcagtattgctggtcagaactcatttcatccatcagagttgctgtaggctttctttctaagttccttaatcatctttagccttccttggatttaccaggccgtggatgctgaaaataacaatcctggtgttttaggacaggagtggacttttttttttctgagccggaatctcgctcagtcgcccaggctggagtgcagtggcgtgatctcggctcactgcaagctccgcctcccgggttcacgccattcttctgcctcagcctcccgagtagctgggactacaggcgcccgccaccacgcccagctaattttttgtatttttggtagacacagggtttcaccgtgttagccaggatggtctcaatctcctggcctcgtgatccacctgcctcggcctcccaaagtgctgggattacaggcgtgagccaccgtgcccggccgagtggacttttttcccatgaaccctatgggcagtctgctacttcgtatgtgtatatggccttcctgaaagcatgtctgaaaattgaatatcaaacctgtatcttaacaatacactgtcagccggacactcacacagtccgatgagttacctgagtgaggatgaagatctacagctttggcatggccactcacctctgtcttctctcggcagtagtattttatgaaacctgtgtttttcactggtatcaactattccattttctcattttcactactttttataaaatattaatggcaaaatataataaagcagtcaaactctttccacagcaacaatcactgccaccacaacaaaaacaccccacagaaaataagtgttgtggagaatgtgggggaatctgaacacttgtgcgctgttggcaggactgtaaaatggtgcagccactgtggaaaacagtatggcagctcgccaaaaaactaaaaatagaactaccacatgatccagcaaagtatatacctatgggtgtgtacgcaaaagaagggaaagcagggactcgaggagacctttgtgtaccatctctgtagcagcatcattcacaacagccaaaagatggaagtgacccaggtgtccactgatgggtgaatggataaagaaaacgtgggctgttcatacatggaatattattcagccttaaaaaggaaggacattctgacatgttccagtgtggatgaaccttgaggacattatgctaagtaaaataagctagtcacaaaaagacaagtaccatatgattccactagaccgtgaggtgcctatgctagacaaaattatagcaaccgaaaggcgctgaggtggctgccaggggctggaaggagggaggaatggggactatttcagttttgcaaggtagaaaagttatggagatggctgctggtgatgatggcacattatgaatgttacttattaccactgaagtggtaataagtggtaatcactttaaaatgattaagatggcaaatgttatgtgtactttaccacagttttttcaatgtttatataattacataatttaatcttaaatatctttttaaaatttttatttatttatttatttatttgagacggagtctcgctctgtcacccaggctgaagtgcaatggtgtgatctcggctcactgcagcctccgtctgctgggttcaagtgattctcctgcctcagcatcctgagtagctggggctacaggcatgtaccaccacacctggctaattgttatatttttagtagagacagggtttcactatgttggctaggctggtctcaaactcctgatgtcaagtgatctgccagcctcagcctcccaaagtgctgggattacaggcgtgagccaccatgcctgccccccgccccgttgtttttgtttgtttgtttgttttgttttttaaatagagatagggttttgctctgttatccaggctggagtgcagtggtgtgatcatggctcactgcagcctcaaactcctgggctcaaggaatcctcccgcctcagcctcccaaagtgttgggattacaggtgggagccaccatgcccagcccatgaagcttttaatccagggcagatcctgcacctctggatggggacccagtcatcttggacctgggcctttcagctgtactgggcccctgctgtcccctggcaagctcccattcccatcaggggccgatggaagtccctgggagcctaaatgtctagttgagctctagcccctggtggtgatatagcttggcgcgtagttagtgcttggctcatgtcggctgttagtaaagactctcaagctctgcattggcttccctccgagggctctgcctggatccatcagcagcacttactctctctgagttgacaacacagatggcacttactccagagctgtttggcaggattccaggctatcgccacgttcttgagaaggtatcactggcttgggggaggggaaaagagaggacgatctaggcaaaagcaagatcaaggccctctccaagaattttccagcctggcaggccctgttaggtggcatggtaccgctgtgtgagtgggagcgccacctggagatggccacgatagggtctctgttcccacgagtatcattaacacgtctctctatgaatctgggtgataaccaattaccttggggtttttttttgacactaagacaccaacacatataagacatgtaaggcgttatcgatttaatgtttctcaggaaacaaaggagaaaatacattagcaggtggattataaaacgcaccttgatttcaaaagtgaagctgtgaaaaactacagtatccaagggagattgatttttgggacccccagtggataccaaaatccacagatgctcaagtccctgatgcaaaatggcatagtacttgcagataacctatgcatcctcccatatgctttaaattatctctagattacttacaatacctaatacagtggaaatgctatataaataggtgctataccatcttacttagggaatattgacaagaaaaaagtctacgtgtttcagttacagacacaaccatccattttttttttttgcctgaggttggttgaatccacagatgcagaacccatggctacagagggccaaatgtctgtgacttagaatcagggagatacagtataagccactgacccgtcttcgagctgaattcttcggcgactattccatacagttggtggcaatagatgcctggaacactggtaaagaagtcaggtctcctgccctcatggagcttgctgtgactgggtccaagtacacccctccaaacgagacttcgccttagactgaagggttggactctggatttttgcttgtcaatgcacctctcttctagcctcttagttagatatccggacaccagaggaaaattaccctgaggatcaccgtgctgacagagcgcgtgacagatggagggatgagcacacttcccggcttctgcctgctgtcctggcgtcattattaacagagtcctccctacccccttcgaaatgtcctgatttggatgagaaaacactgagggagtaatcattaacatctatcgcgttccacaaattcgcactggagagggtctgggtttgcagtgagagaactgcttcaggtccacagcctgttctaatgcaggtcaagtccatggagtctgcgggagggtcggtgggattgtctggggctccgttctcccatgggcatctgctacttggcatgttccagtcactcctagaagcatcaaaatctgggatggtttggttcaagaaacataaacatgtacatataacaaccagatcacattatcttaaggtaaaaatcacatcaaatctcaaattgttattctttggaatggataaaagggatattagtatttttgtcaatttaagttttatagagaaagttggaaaaataattatatagggacacttgtcttggttaacttggacagagatttttttttctgttgctgtggaaaagatacaggcataggatttttctaagaagtttcattttttatgcaagtgatatactgtgggaggaggttaaaggaaacagccagaaagacaggtaagaagcttgatgtttgtgacaaattgataacttgcagcctgtgatgttggcaggtgttgctgacagggtcatctggggccaggtggtcgctgtcctgaggacctgccgggtacccagaatgctgcctgcctgttcggtggctctcaaacgtcagcacctggaggtttctgggctctggcgcctggtttctgattcagtaggtctgtggttgggctgagaatgagcatctctagcgagttccctgggtgacactgctggtagaggtggggggtatctttggaaccaccactcaaagtctggagaggaattggaagggtcatagggacttacctgtaagataaaaggttgcccttataataataatgatgatgatgatgacgtaacaaagaatttctgtgcagtaatgccaggagctgtgctatgtgtatttaatcctctcaaaagcactggaaggaggtgacagtggcctcattttacagatgagaaaactgaggcccaaggctgggcacggtggctcacgcctgtaatcccagcactttgggaggccaaggtgggcggatcacctgaggtcaggagtttgagaccagcctggccaacatgatgaaaccctgtctctactaaaaatacaaaaattagctgggtgtggtggcccatgcctgtagtcccagctaatcgggaggctcaggcaggagaatcgcttgaacccagaagggggaggttgcagtgagctgagatcgtgccactgtacttcagcctgggtgacagagtgagactcttgtctcaaaaaaaaaaaaaaaagaaagaaagaaaagaagaaaatatagctgtgtgggcaatagtcagatgaactattcccctaactttgccccaattcggtgtatgactatgtacaaatcttaactctttcagatctcaaagaaaagctctgtgtcttagtttcctcctctgtagaatgagaacagtaacagtatccttctcttatcgtgaggatctaatgcaaccacgagagtaaaatacacagaaaggagcctggtactgcatgggctaagtgcctaatgaacatcagcttactactatctctccgggtgacagagtgagactgtctcaaaaaaaaaaaaaaaaaaaaaaaaagccctgaagggtttatgtgacttgtccagctgggttgaagagctaggttgaagccgctgcccagtattgaaacaaacccttataaaatagagaagtagcttaataatagccccaaaaagacatcacagactgaagacttttctagtagtataagtacacgtgaacaagaaaatggtgacacttctgcttccagttcatgcttcttgtcagcagtattgcgagggaaaaacaacagtgatctaatgagccctgacaagagatggccagaagctgagcagttgggaagaaaactctttggtgaatctcactctgaatgtatattgtgccttgggatattagctgattaatttggatgacatattagtcatgataagcaagacatttacaaactaagcatccagaacgtgaaaactaaaattttgccaagcaccgtggcatgtgcctgtagttccagctactctggtggctgaggtgggaggatcacttgaacccaggagttcaagtccagcctaggcaacatggtgagaccctgtctcacacacacacacaaaaagccacaacctctaaaatttaaattatatctgaagtcacgcagtactcccatgagtaattttacagcatcaagtgtacgtgctctgtaaagggtttcatctcagccttctgttttgggctcttctgtctcctgaattgccatttgggaacaggcagcctagtcccgtggcactaagccagctagctaaacactggtccttctcaaatgcatgtttccagcccctctttaggacattatgcacctgaaccagaactcttggttctccccttcactctctgcctggtaactcaccttgggttcccctatcacagtaaataatgccatttttgatccgattgttcaggcttagaaatcttggtttggatgagaaaacaatgagggtgtccttgcctcctctctcccagcgcacatccagtccctcggtaaacccctgcgatttactccaataaatcctgactggtccttcttagtacctcctctgctgaccccttactccaggccaccgccgtttctccctggactgccccatgccttcctaaccggcttcttggtttcttctcccaactcacagccattcattctgcatttcacagccagagtgtgaactggatcacatggatcctctttatgattgcctggggcttccccacacatgtgaagcgatccgaggtcctcgacgtggcctgtgtgcgccctggactctggcccttaactcactccctgacacccctctccccgtcactgtgtcccagccacactggcttttgtgctcttcttccaggtgttcctttccctcagagccttggcacttgccgttctcttactggaacattcattccccagatattgtagggcacctgctgagaagccatggacaagagccacggtttaaaggctgctggtgccaccgtttgctgatcatgtgatcttgggaaaagttgctcacccatctccttttaaaaatcagtttctcattgataagatggatcctgcggtagggttttggtgagttcatgctggggagtactcgattggaagaactgggcaaacatgagttcctcttcctgtgtcctttgctccctatccctagctgcctcacatctttgttcagatgccacccagagaggtcagccctaaccactgggcccagaataacagatagggtgcgcatcactttctgtccctcatcccccgctctttttccccctttaaatgtagccttttttttttttttttgagacagtctcactctgttgcacaggctggagtgcagtggtgcagtcttggctcactgcaacctcttgggttcaagcgattctcctgcctcagcctccccggtagctgggattacaggcatgcaccaccatgcctcgctaatatcttgtgtttttaatagagacagggaccatgttgccaagactgatcttgaactcctgagctcaggcaatctgcctgccttggcctcccagagtgctaggattacaggtgtgagccaccgcgcctggcctatttgcttcttttttatgatattttccctcattgggaggtaagctccctgtcggctgctatttcaccagagcccagaatggtgcctggcacatagctgacgctcactaatttttgttcagtggatagtgagtacccattgtgtatggactccacacctcttaagggagacaggtgcatttttacaagcttgaggagcacagccagagtgcaggctgtgaccgtgttcatcctcatgcagctcagtgcagagggccatcagcagtgagtggctctgtcaagtttatctggaggcggggagttgtaaagggcagaggcatcacagcctggaggctgaggtcagcgggctggccaggagaggggctggagtcttccccagtgcgggcattaccccttccaatactgccatggtccaagtgaagcagaggctgtgggacccgaggctgtgggaccctcaacactgatctttgagagtccactggatgttggctgtgaggtttcctttgactcgctggagaggagggacaggagctacagtgcaggcaggcaggtgcacggctatgcacagtgtccagtcgccgtgtgaggaagtgggagatgaaggtgggaaaggtaatttggggccagactccaaaaggccttgaatgccaatccacgtacttaggacttctacctttagtattacaggaagcatcgaggggtttttattattttatttttttgagacagggtctgcctctgtcacccgggctggagtgcaatggcgcgatcttggctcactgcaacctctgcctcgcaggctcaagccattctctcacctcagccccccgagtagctgtgactacagacacacataacacaatgcttagctaattatgtttttcctttttttgtagagacagggttttgccatgttgcccaggcaggtctcaaacgcctgggctcaagtaatcaacctacctctgcctcccaaagtgctgggattacaggcatgagccatagtgcctggccacatcaggggtttaagaagcattctccttacatatttagactttccaccaagtcttccaaatttctccctttcccatactgagggctacgtttagttcctggccaagtcctgactttgtaaagaacaacaagtaaacagcttcttcagaaggctggatgctgagccctgattgcccttcagtgaaccagcctcatccatgaagcttcttgaaaagccagaaactgtctcattgggggggtccttgaaatctgaagcaagggacaggttctgagcccctgtgttttgcagattaggttgcacaagaaagatgggctggtgactttgcagttcatttccgtagattgtccttctaggcctgcctggatagaagcagcctcgtgtgggatccagcagcagtggccagtgggatgggagccagcatatgtagttgttgacacatcccctgcagacgtgggtcggcgggctagctgtgggagagcactgcaatgggagtcagtgacttggggcctctagcctcctgtgaaaggtcttttttctctggacctcagtttctccattttattgtaatgagttgggctagatcagtagttcttaacctcttttttttttttttttttttgagagggagtctcgctctgtcaccaggctggagtgcagtggtgcaatctccactcactgcaacctccacctcccgggttcaagtgattcttctgcctcagcctcccgagtagcttgggagtacaggtgctcaccaccatgctcaggtaatttttgtattttcagtagagatggggtttcaccatcttggccaggatggtctctatctcctgaccttgtgatctgcccaccttggcctcccaaagtgctgggatcctaagtacagacgtgagccaccgtgcccggccattcttaacctcttgaaactccttaagactttggtgaaagccatagacctctcttcccagaagaatgaacacgtggtttgccggcaccttaggaacccccaaagcccatgagacaaagccctggatctataaggccctgtcccatctgacccccggccttcccctgggcacatacctccagctacacagggctttcatacacactgcccctttgcctggtccagctctgctcatccttcaagtctcacccttccctgacttccagcttagattaggtcgccctgctagacatgcgtcccccaccctgaatttagcactgatcaccgggataactaagtgattcttcgtgcatgttatccgaccctccccaagctccgtgttggtatttgttgagtaaatctctgaggcccctccagctatgacattctgagactgatctataagtttgcagatgtgtcataagagagtccctgagcttgtatttcctatgacattcgacacgtggtggcctttgccttcgatgatttcctccaggcctggacaggaaagttacttcaaagcagtctcggccagactcggtggctcatgcctataattccagcactttgggaggctgaggctcgaggatcacctgaggccatgagtttgagaccagcctggcaaccaagcaagatgctatctctacaaaaaataattttactaattaaccaggcatggtggcaagtgcgtatagtcccagctagtcaggaggctgagacaggaggattgcttgagcccagcagttggaggctgcagtgagctgtgattgcaccactgcactccaacctggacaacagagggagactgtctcaaaaaaaaaaaaaaaaaaaaggcagagtctagaggaccccagaagacagaagagtgcctcccagactttctgcctcagtgctttgctaggcctgacctccaggctggtcatcgcttttgtttatattctgggctgagctggaactcacacttggaacattcccacagtgcttggcgcttcctcgtattgttgtatttttctccaggagggaagtgaccaacatcagactttcctcccagcagacaaattccatacacaaagctttgtgtgagctaccgggtacccgcctgagagcccagcctctgtttctttggttctgggtgggtgagtgtgcacattacagggatccacgagcccttcccttctgagccatttctatctaaaaaaaaaaaaaaatctccttcaagaagtgagcaccgccttgcaggatcctgactcagagttcgtctggagccaacagcgtcttgcgtgtagggacaggcactccttaaaatgtttcctacttcagtggccacaatattacccctctggcttatgtcatgttccacaatcaaaatatcattcctcctggagtccagctactcgggaggctgaggcaggaggatcacttgagcctaggagtttgaggccacctgggcaatatagggagaccctgtctcttaaaaaaaaaaattattcctgaggtacagatgtttgtaagataaattttattttaattatactaagagaatgattatttactagaatattgcagtggatcttactctgatatgggggagaaaatccctagtgagggtaaataatttttttcaatgtattgtatctaaagcttggagatttataggtaataataataaaaacagtgacagctattctcattgagtatctgctgtgtaccaacaaattttaaacatctttattttagtttagttttttagagatgggttctcgctctgtggcccagactggagtgcagtggtgtgatcacaaatcactgcagtcttgacctcctgggctcaaatgattctcctgcctcaacctcccacctcagcctcccaagtctgaattcttatttaacctttaaactacccatgaagtagacagcataatggtacacatgaatgtatgtgaaaatacaaggtgtggaaaggtttagtttctatcccaaagttgttcagctaggaagtgcccccatagattcaaaccaggccagctggccttcaaagccaattccttcacactgccctcctgcctcctctggtcatgaggaaatgggtagcagaggttttcctagccaaggataaagatttgggggctggatccagccctccaactaaatgcctagcgttgatccctgcccctctctgaggaatctgtgaaatggggaagggagtcgctggagcagatgatcttgtggatctccttgggttttacagagatttgaggcttggagtagtcatacctgaaggagtgaccttgataacacatggccaggtcgggtctgattgaaggcagttcgtacagccacagcgttctcggcgtatttgtgcaaggcttggaaactcatcacagtggctgtgcagtcagccttctgcttctggtaacagttcacttttgattcttcccatttgtgaagaatcagaaaaattttctgttgtctccctgaaatgtggactggagatgggtcgcttgcccatcttggattgcaagcatattggtctttggggatggctctatgtttttttgtttgtttgcttagtctgggacactgcagaggggatgactgtaaaagacgctttctgagctggggattagagaggaattcttaagattaggttattctgttgctctccccctccccctacccctgaacagttcacattggagttattttgggggagccatgattgagaagggttggaccacagggtcctcatttcaaagctgttctctcaaggaaaaatgtccagttcattctaaaggttcatcagtatattagttgtttggaacctaggatgcgttttttcatggaaacacagttacaaatgtgttggcccccagctgagaaacgagagagggcacacctgagcccaggttctgtaactgtgacccattgttgtctgtgtgcacaggcgccaggaggagctgccccagacacggctcctgacttcaggggcttcgcactcctgatagggaagaaattccagggcccggagtggcctgagctaaggagtggggaagtggaggaaacagcgccccagccgcccataccctctgactcttgctaggagaggagaggttgtttatggattagaaactctggttaatgcattccagggggtggggacaatcagtgtgtgtatgttggggataattctcattggtttattctgtcacctatccactcatttattcaacagagagttattaagcacctactgtgtgccaggtattctgctgtgcaactgttagttttcactggacccctctcgcgtggtgggggttccctgtgctttattccagtttgtggctgcagtttaatctggggaggagcttgcgggctctgtgagggaaacagggagcctctgcacccatgctctttcctgccacctcattggagacggtgcgacagacacatgccatttgctttgccaagtttggactctcaggccgtgattttgcaaaaatgatctctgtattggtagatcaattatgaggccttaagatcttgtagagatttggattttggtttttgtctgttttgcataaattggaaagattatttccccttccttcagaaaggaagggcctggtttaacacagtggcccactgcgcccagaaacttaacagagcattaagtgcctcttaaacttggtctctctggttctgtgggtcttttttggaatgttgtcccaaatattactccggttctatacttgctcccattttgtaccatccaactctgtaaaataaatttactttggtgcttttgactaaattgaccgaagccagatatctgccacctaagctaatgtattttccgtctacaattataaaagtgatgaagggctgggcgtggtggctcacgcctgtaatcccagcactttgggaggccgaggcgggcggatcacttgaggtgaggagtttgagaccagcctggccaacgtggcagatcccccatctcgactaaaaatacacaaattagctgggtgtggtggcgcacacctgtaatccagctattcaggaggctgaggcaagagaatcacttgagcttaggaagcagaggttgcagtgagctgagattgcaccactgcactcctgcctgggtgacagagtgagactctgtctcaaaaaaaaaaaaaaggtgataataggcacagtgcagtggctcacacctgtaatcccaggactttgggaggctgaggcaggaggttcacttgagaccaggagtttgagaccagcctgagcaacatagggagaccctgtctctacaaaaaaatttaaaaattggccaggcgaggtggcatgcacctgtagtcctagcttctttggaggctgagggaggaggattgcttgggccagggaggttgaggttgcagtgagccatgattgcaccactgcacgccagcctgggtgacacagcaagaccctgactccaaaaaaaaaaaaaaagttaaatattcannnnnnnnnnnnnnnnnnnnaaaaaaaaaaaaaagttaaatattcaccagggaacctcctgagtgtcaggcagcatgctacgtacttcacaaatgttctcttttgtttgattcttattacagctgaggaggtgagactggaattatgcccagttaacagataaggaaactgaggctgctgtgctcaactggcaaagccaaggggaagagctagtatttgcacccaggctggagtgcagtggtgtgatctcggcttactgcagcctccacctcccaggttcaagtgattctcctgcctcagcctcccaagtagctgggattacagcttcgtcccaccacgcccggctaatttttgtattgttagtagcgacagggtttcaccatgttggccagtctggttttgaactcctggcctgaagtgatccacacacctcagcctcccagagtgctgggattacaggcgtgagccacctcgcccggctcagagcctgcattcttacccatattatgctgtggggattctttaggggcttttataacctcaaactctgggactgaaataaatgaaatcttttcatccacctcgacattgtcttcctttttaccaagaatatgtgattgatttcattcccttcttttcttctagaaaaccctttgttcagaatttaggtagcgtagcactttctccagcaaaattgttcccaaagtgcagtgggagtttggagcttggggttataaattcttagctgtatttgtccccaaggtgttttcttctttggagactgaggtgtagcagtgttttgatgttttgtttcgttttgtgtttcccttggaaacacagcattagtgaaatcagcttgttttctctgacagtacttgttacgtggtgcacactggtctgagcgtgggactctgaaatagaaggcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaaggtaagaaagccctgggcttcctttccaggaagaagcaaggaggcagttttctctgagagactggcccagcagcagagctgaagtgcctggggaatcaccttccagagcagaaagcacaggtagtccaacatgatttcaagaaaattcacaattctcctgaggaataagatgattcctctctcaatatgatggcttggtttggctgagagtttagttcagctcgagatgtttcatttggtgcagtatgtgtctgttgaaaatttttattttttttgaaatggagtctcgttctgtcgcccaggctggaatgcagtggcatgatctcagctcgctgcaacctccgcctcccaggttcaagcaattctctgcctcagcctcctgagttgctaggattacaggcacccgccaccacgcccagctgatttttgtatttttagtacagatggagtttcaccatcttggccaggctggtcttgaactcctgacctcatgacccacctgtctcagcttcccaaagtgctgggattataggtgtgagccaccgcgcctggctgaacatttttacttttttagaaatgttccaagtcagccaggcacaggggctcacgcctgtaatcccagcactttgggaggccaaggtaggcggatcacttgaggtcaagagttcgagtccagcctggccaacctggcgaaaccccatctctactaataatacaaaaattagccaggcctggtggtgggcacctgtatttccagctacaggcataaggctgagacaggagaatcgcttaaacccagaatgtggaggttacagtagccgagattgcgccactgcactccagcctgggtgacagagtgaaactgtctcaaaaaaaaaagaaagaaagaaagaaaaagaaatatcccaggtcaaagctttgatatctaggagtttgaggcttttgtgatattttttgatttagataatgttattaacagcttttaaatatatagcacttccaaaagttccaaagtactttcaaggtactttctgtaaaatctttcatttatccatcctggacacccaggaagtgggacaacagcctctcttaacacctactctgtctctctagggcttggggtcatgtcagcttgaggaggaggaagttggcagggccacagagcagtgcagtggtacatttggagctcaaggacctttaatagtgtctcagtgcaggacagtctgttgacgcactcagcggccttttatcacagttattgacccaggagaccggccggctggcaggcatgccagagatgacatatgcgagacttcaccaggtctttgcctcctcttgccagaagaagttgcggtagcatttgatcagtagcaagacagttttttcacaactgcatatatgggtgtgtttatgaaaagaaaacaaataactggaagaaaatgcatggaaatattaagagcagttgctgtttgtcaaatgatagatcattttctcttaaaaagaaagtaggtgggatgctaatttactgtcaggttccagcccttctgactttctgtgagtcattcttttgtctaacatgttactttggaaagggtactccttagcaatccttgattggatccaagtttgaacaaaacggctattaaagacattgggggacagttcgggaaatttgaatatgaactccatggtggattataatgaggaactgttgctcatgtgattatgtgtgaaacggtgctgagtcatgtaggagtgtgtgcttttttgaatagtcatgctgaagtatttaagggtgaagagttatgctatctataatttactctctaaaatcataatcactctgtgattttccctgtatacacgttaataaatttgtatgccttttctccaattaaaaacaatactgtaatcccagcactttggaaggccgaggcaggcagatcacatgaggccaggagttcaagaccagcctggccaacatgataaaaccccatctctactaaaaatacaaaaattagccaggcgtgctggtgcacatctgtaatcccagctactcgggaggctgaggcacaagaactgcttgagcccaggaggcggaggttgtagtgagctgaggtcatgccactgcactccagcctgggcaacagagagagcctctgtttcaaaaaagaaaaaatcaaaataaaaaaacaggttcagcaaaatatactgtataaataaatggggacctaagataagcaaaatgggataagtttaacaagtgttagagtccaggtcatcgatatatgaggtttgttatactttctttcatgtatttttacacattaaaataaagaaccagttctgactgtgtcatacatagtacagtgtcttcagaatgggccttagcagacaccggtatttactgaagcagaccaagatgcggtactcttctgaattcagcaccgtgtgggctggtgtctccagccagccaggagaaaatcagcattgatccaactacttaaaagcaccacttttagaatagaaatttaatatgtttacttacgtttggattgtctctggttctccttagaaaaccatgagttaaaatgtctgaagattttcattggaagcagctgggtatacagacagacaggtttgatgttttattttgtggttttgtttagttgtgttcagtaatttaaatgagaagagtggtaggaccactgttggtagtagggatttcaagatccacagtgaattggagattaaagaagagaacagagcagttctggtttttaagccttcacaggccccactgaccaggagcacatctttggcgcatagggttttatttgtttgggctgatagacccggggactgcggtccaaagtccatctcagaaggaaaagccgtttttcatagcgcatggtgtcctgctgaagagccgaaataacagggatagggagtggtccttcacagtttatttgtctttttcttgaaaggttgcttacattttggaaatgggattatagaacagtgtttacaaactggaattaaagattcccaggcacactggatgcagtggctcacacctgtaatcccagcactttgggaggccgaggcaggcggatcacttgagttcaggagttcgaaaccaagaccaacctgggcagcatggcgaaaccccatctctaccaaaaatacaaaaaattaaccaggcatggtggcgcgcgcaagtagtcccagctactcaggaggctgaggtgggaggattgcttgaacctaggaggcggaggttgcagtgagtcaagattgcaccattgcactccagcctgggtgacagagcaaaacccctgtttcaaaaaaaaaaagaagaagaatgtcagggcaccaccatgaccctgatctgcagcccacattcaacgtggttgtgaaatcttggtgggtggatgatggccccaggttccagggcaaagtagcatggtctgtgtctagtttaggaacaagtgaatgggaatcctgggcatatcgttatgtggatttgctacagacagttgggacagaccaggcggcccctgatttctgcccggattcccctgtgttaggagctctggagaataagactttaaccagagccaaagatgatcatgattaggaagggcaggcccagagtgcattccaaaggcaaatttaaaggaaactgttatctgccatttagatcatttacgtgtgtttccatgtcctacacctggggagttgaaaagccgcagaggcagaacactagtgtgaaaaacatgagtcttacagcctccacctgctgtcaccctacagagcatttgatgcctgctagagaagcttctctagtgatttgagacagtgtgggacacatacccgatgaggggaccattatactgtctgacttatggttctggtttttattttttgatagctctcaggaccaaccccaaacaagaaaatgttttttacattaatggatgcttctcgtggtcgagaaatctgactcatttgtattaccgcagtgagttccagcaggccccaaacagaaaaaaataagatggggagtgggacgaagcagtggctcaagtgtgaccctgagagttccagccagagctgtggcccagcctgctctctgaccttgaacagatgcattttctaaggccaaatgccctcgctttcctcgtctacagtggcctgttccaaatgactgcatcttattgtgttatttaatttacatccatggttttttttttttaattgatctgtttaccacttgattgtaaaccacctgagggcgggcagtcgcagggttcattgttttgtccccagcacttgcacggtgcctggcacatgtgccctctgtgagtgctccctggctgcagtttccctgctggtataaagaagggtaggcttatgcagggcatggtggttcctggtgcacagtgcacagtggacgtgcaataaatagtagttaccagtgccagcaggtgtctttgggacttggaaggtggcaggtggttatttgggacctggaaatgttcattcttagcctttaactgcccaaagtagtaacactggagaatgaaaataggtacaccttcctctatcccacagcaattctgagtttacaaacagtaaatgtgttgatgattgttcagttgcaaatattacttcacaaaagcccctcctaaagaatcaacatttagttgttgattcatacagctggaggaaactttgaaatttagagctaaattgaacttctctgaaataggcttataatcctgccctcccagaggtaggcaggcaggcaggcaccctgcctgactggctcctttccttctttcctttcctttcattccttcctttcctctctttttttccctctctttcgaaatgatttgaagagttgcttacagtgttcattttggctctcgggagtacagcactgacagaagtttccttgggaattaaaaattgcagcagtaattgcaaattgaattgttatctccttcaaaaatcccagcagctccaggccataccagcctggtaaatggaaatgttaatgatttgcatgtttgtacacagtgtgggtgtgagcgaatgaaattaacacccttagtagaagagctgagtataaaaagcttcagcccacagaccttggcagattgtgggatttgctgtgctggaagcagattggcaggcccaggtggggctgggggtggcagggggtgagttaaggatttgcctcagttttgaatgccagtggttgctctgccataggggcaaatttagaaatgtttggattccagccagcaaaggtgtttagacttgcctctgcacactagatagcaaagtagcatctggggcagctggatgcccgtgtgccagctaattaatattgatccagaatgcacaagggctgggtgctgcaataaccaccggctcagtgccttctagctaataagtaagacaagacaaattacttcacatttccaggcctgtgtcttgatctctaaatgagattaataataatgcgtactttgaaggactaccgtgagcactaaatgagataattcacataaaggggttatagcccttagcatacagtgagcatttaatgaatattagtgattcttgttatgcattgcatagtaaagagaaccctggatttaccagatccatggacatggattatctgcctggcttcatcccaatcccaatggctgtgtgagtttgggtaattctccacctgtttctgtctctcagcttaaggtatcgcatgcctgatggtcttgaaggaccctttgcaggctgtgcatcaatgaccatcagcagtggtcactgcctttcatatgtgctagctcctggagcattcagtacctgcttagacagcatcggtttggctgagctgagggatcataggagtgctttttatggtgttgaatttctttgaaaatttctttagaactctggagcccaggtgccagggtggagtctttgttctcccactttctagttggctgtccttcagcaagttacttaatttctgggcctcaatttcctcatctgcaaatagggcccacttcataggatgttgtgaggatgaaggagtctgtccatgcaaagtgcttaggacagtgcctggcgtgcagtcagtatccagtcagtttattattgttattgcttttaggccacatacagagaagttacatttaattttggttgaaatgatgttacattattaaagaaaaacattggaacaaacggacaaaatgcaaacaagaaaatgcatgttgagtggctaagcctaaaagacataaatgaccgggcatgatggctcacacctataatccctgcactttggaaggctgaggtaggaggatcacttgagctcaggagttcaagaccagcctggaccacacagtgagaccctgtctacaaaaaattttaaaaaataaaattaactgggcgtggtggcacgcatgcagtggcatggtgatgactcactgcagcctctgcctcctgggctcaggtgatcctccccgcacttcagcctgggtgaactgagaccctgtcttaaaatgaatgaatgagtgaatgacctaaaacatagtgaggcggcaaaagtgttagtcagtgccattattctttttcagagcggctgcacgatgcatatttttcatagaattgtcatcgtatgcaaataattttgcttttttttcttttaattttatgcttctatgtggtcttaataactgctatgactatgacattccatcatgttactgttccataacttatgaaatcattcacctgctgttgaatatcgaaattatttccactttttacaggtcaggcagcagtaagtagcttcattaatatagttttgtgattctgttggatgatgtccttaggataagttcccagtgtaaagttcccaagccaggaacatagaaatagctttaaggatcttgccttgttgttttccaaaagtgatgcattttcatgagtgatgtataaatttaccagttactctcaagcacatcagcactgaatattattttgaaatcgttcctcttgtaaaacttaaactacacttacaaacaccattttgatgaattatctgatggcacgggactcagagaaagggtatgggaagttcaaaagccattatcggtgttaagaatccattttgttataaaatttaatttcccacagtcatttgctttgggcttgactcaatctcattcaagtgctgagtttcatagaaaggagacatgaggctttatttaagcgtacccaattaccatcacaactttttgtcttctgccttccagagagcaatgattattaaatacttgagtttcttcacatgaaagagacagagtgagcccagaagtgttgttaacattgttaatgtaatgcttactgttaggcagcgtgactaatgacccagcaatccctcttcgctgcttctgtagagagctaaccatttccctaactgcatatggatgacaagagcatcaattcaattgttaggaaaatagatacattaaacagtttgctgggagggtagtttgaatcaactagtgtagaacgtcagggcgttggagtgaatagaacggacaaggccattggttcatcagtgaggttagaggccatattgggatgtagtcataaactggttcagggtaggagagaaaggtaaacaaaagattatttaacatgactttggaatcacagacatcttgagctagaagagaagagtaaaaatctcaaattattccctaattttgccaatgaagaaattgaggcttctagaagtgaagtaacttgtctgaagccctgcagctagagtgtggctttgtgtctcctaagttaggatagcaatataacagtgatataataacgcatgtaataatataaaaccatacaacatactgtatatgttatgattttatatttacatgttacagaatattcaatacattgtatatgcaatccattatgtattgtatcatatataacatatgatgcaataatatatgtaacaatgatacaataataacatattgggatacagtattacaataatgccagtggcttcctatttgccaggcatggcactgaaaggtctgtgtatattaggagcttccatttgggagcagttgacatgtaactaaagtgtcctggaaatcggttttttcttaagtgaaagatcagatgttggaaagggaaaccctaagtgtgacagaatttttctcatgagaagtatgggtgtagttttgggtgtgggtaagaaaagggaaggaaacttcattctgtcatcagatacctccaaatttagaacaatatctatccgtagccattggttttcggatatgctttaccctgggaacgtgcgtaaaatacatttccgtgtttggctatttctttcccagctgcatagagggtgtcaccattattttagataatagccatggccagtgcccactttaatcacttttccaatcacttttcactgattgcttctaaggcacttgatttcagatgtcactttttgctgaaatacctggataactgtttcagggggccttgtggactaccgagaagtttgcctccaggggttggtaaacttctaaaagtgccaagtcatgaatattttatgctttgcaggcccaagaagcaaaagtaagactattatgtagatacccataaaacgatttaaagtgaaatcatttaaaaatatgaaaaccattcttcacttgcaggctacgaacaagcagcctcctgtttgactggggttgctcagcgagccttctggcttctccggcacacacacattcaggtctccatctatgcaaatggagacctccttcttcttctcaccactgtaataaggagaaaacagacagtggaaggtttgtagaacctcatgattgactatagaggctttcagcatttttcctttactattaaatgggacactgtactaaaaaaaattctattgtttctatatttgttcatttattgattggatgttcattcatccaacaaatgtttattgaacaggtcctgtgtctccactgttccaggcacgggggatacctaatgaggaaaataagacatctctgccctctggagtttttagtttacatatgaacaagtataatatgtaggcttttggatgacaggtatcatatagaggagccagggaaggggacaggatggacaggggaagagggttgttagttttacatgtgatggaaagggagagtgatcagaaataaggagcagaatcctgtgtgttgcagatgtctgggcaggcgcgctccggaaaaggaagaggtggcgcagaggccctgacctgggaatgtgtgactagggcggaggctggagacccatggcagatgaagccaggccttgagatgactgtaaggacttggaagggagagccagtgggatttactgaggggttgagtatggggtgaaagagagaaagagtagtctaggacgaccccagtggttttctcctgagcatcggaaggttgactttcgaagcaggagagcttcagtggcacagattgtgggggatgattggggctgtgtgggtacagagtgagtttgaggtgcctgtcagagatctacaaggaggtggccattaggccattaaaatctggagtataaaaatctggagttcagaaaagaagtgtaggcttttttgagagttgttgacataaagatggtgtttaaagctatgagactgggtgagataccagcaagtaagtcagagaagagcaggggccaaagcctgagccccagagcactccagcattaggaggtggaggagatgagggagcaccagcagaaacctcgaaagaccttccaggaaggtagggggaaagcaggagactggtgttcagaagccaactgcagaaagtgttcctgaggaggaggcagagagggggcttcggtgacacatgatgctgactgggtcaaatcccttgaggaccaagacttggccttggcattcagtaacatagtggtcactggagaccttgacaagaggtgtcagtggggccaggcgcagtgcctcatgcctgtaatcccagcactttgggaggccgaggcgggcggatcacctaaggtcgggagtttgagaccagcttgaccaacatggagaaaccctgtctttagtaaaaatacaaaattagccaggcatggtggcacatgcctgtaatccctgctattcaggaggctgaggcaggagaatcacttgaacctgggaagcagaggttgcagtgagccaagatcacgccattgcactccagcctgggcaacaagagcaaaactgcacctcagaaaaaaaaaaaaaaaaaaagtgtcagtggagtgttgggtgtgaaagtgtcaaagaatgagcagaggagaattggccacagggagcatgggcgttcttggagttttgctgaaagcgggagtgaagacacaaggtggtagttgttaagggtattgcggtcaagggaaagttttttcataaagggtgaaataatggcaaggttgaatgctgatgggaatgacctggtagagatggaaacatcgctcaagaccaggagaattgccggacgagagagaagtcctgattatcagctgtggtgcattgagtatttacagtccttgctgacaaatcaccccgctatttagggagcttaaataacaactgggcacctagtttacacttctgcagctggcagttcaggctgggctgctgggctcctggtcttgcctagggttcctcaagtgtctacaatcagctgctgggagggcttatccctgggcctccagcaggctagcccagggtccctcccgtagtggggttgctcacctggtcggggaaggggggcagccctgaggccccaggtcagaagccgcacagttacctctactttatttcattggctaaagcaggccacaggccagcccagattcaaggggaagggagagagagacctgccccctccttctacccgcccttctaacaggagagtgcaaagtcatcttgccaagctgtgggtatgaggagcagggaatcgtttggccattactgcaaacaatttgtcacagctgtctgtgagctaagcatgttgctttcaatcatcacaagagttctttggggtaggtagtatgattgtgattttacagatgagaaaaccaggtcactgagcatccagtaacttgctcaagatcatgcagctagtaagtggcagaattgggacctaaactggtctctgacgtcaaagcccctttcttccctattttcccttcctgcaagtgtctgtttacaagggcagactagagggcccctcctccctttgcttgttaggcatgggaataatatttttgtggatgatgattatctcataatcagggtggactgagggaggtgatcatcttgttgtggcttgcatgtttactgtgcggggattggacagctgtatttatgagaatccctttgaggtcacagtggtgtgttattgacacagattcatgtctctgctctcagctggtccctcagtgccctttgacagtctttgcccttgtccttggtcagctgactctcctgtccagatagtcacacatgttccccttcacgccccactttgttccaggcctctgacttcctctgtctgcctttatcctggcccctctctttctggccctgacacaggtacactcagcctctagtccaggttccctctgcccaggtcctcttccctccagaacttgtcatcatcaactgtcttttcaaccaactggacttcaagctttccaagagcagaatccaaaatgtgggaaaatttgaattagcatcagtgaactttgtctctgacactggctgtatagtcttgagcaagtcctgtaccctcaggtgcaagaatctgggaagagtggacactttgagccatctccaaggccattcagggagagtgagatctctttatgtccgcctaggaaacccgtggcctagagctcagttctgttctgttgcagtggctgcagtgtgtcctgggtgtatacctgacagccctgcattttgctgcaagagctgcagccttctctctgccctctcctaattcaagcgtcaaaaccttgttggccccagagctagagccgctgcaagccacttcgctcatttaggaaagcaggaggcaggtcctgtgctgagtctgcaatctcagcaaagacctcagtgaaaatgttttcaagctctctttggatagagggagcagagcagtgagtaattaggttcaatcacccatttcaagtctctgtgaccttgcttacatagggagcccggagctgggcccttcttggagtccctgggttgggatcccagccagctgagtgtgaggaagggagggagcgagaagggatggaggagaagcctgggccagcagagggctgctgtctctgctgcgctttcagcaagctcatctcaggcatgacattcaggatgcagagttgctctttatttttttatgtagtttgctaagagaaaatagccccgctacttatgtatcagtgtaatccaggggaaattacttaatttccgtcagcctcaatttgctcatctgtaaaatgaaggcaactaattacacctgccttagcatatgaggcgtgaatacgagaatgcttgacaatacttggcatagagttagccctcgataaatttcagctgttaatgttattatagcaccttcacatgttgttgtgtttatattgtaaatcgttggttaaagatatttttattgtcatgatagctccatactttcaagatgcgtctttgtagtatttcgtatccatttagtcattcattcactgagtttgtatttatcagacacctacttatggacaaggaactgttgattattatctttctgttcaggttatgatgagctgttcatttcttagtgcttgccactataatattcagagctacagttcgctgagcacctgtttcaatagagttgctcacttgggagatagattctaaagtccgagcataaagagaacatggcacagaggaagaattagccttgaaagatcccttaaatcatctgtaaagtacagtgtacatcggaggtcatcagactttttctataaagaccatatagtaaatattttaagctttgcaggccacctgtggtctctgtcacatatgctgctttattttcctttttaaggaaagccctttaagatgtaaaaaccttttgttagctctgggcccttaaaaaataggtctttgtctacatgagcagactgtggtatgtcttctccaggatggtccggggatccccgcctcctggtattcacactcaggtgtcatcccctccctctctggatcagggctggtcctatgaccagtagaatacagcagaagtcatacaagatgttgtagcttccgccagcctgtctctcttggatcccctgctctggggggagaccagctgtcctgtggtgaggcgaggtcacaggtgagggtctgtggctctggccagcagcccacagggaagggaagcagctcttccagccccagtcaggcctcaggtgactgcagcttcatgagacatcttcctgagccagaactatccagcttgtgtcagccactctgcctttcaggtcattataaaatctgcagcagggaacggggtgcggtgaggagttctaaagaatgcctgcttgcctgcagagttacattgatttttttattaaatgtttgctggttacacttgtcaacaaatctgtttatggagaggatgagatgggaacatgtcattcatgggtgttcttattatcatgcatttcttggagtttccatcattccaaccagagagagaacatttaccattcagcagatggctgcatatggacagttaagtttcctgagggagtgatgcacctcttctgggtgagccagacattgaggtacaccactcagtcctggcagcagcccccactaaggttaggattggcagctaaacgtctagcttgatccaactcgctcctgatgcccctgcttccactgatacccagtgtggcctctgctgtaacacagcagtgcgcttgcaatctggggagagcttttgcttccacactgaatagcttcagatggctttgctctttttcggttgtgccaagaggcccttctacactaaatggctcatccatgggtagctaccattgacctctatcgtgtggcctgctttgggaagacaagccgggtcaattggttctgcctcaggaatttgaaaccggacacagggaagcattctaatcattggcggggatttgagctaaagaatctacagaattggaaccaggcagtccctgtgtgcttccgaattatgagagagtggtaactcagaagaagcacgttcatgcatttatctaatgaacattgattagacatgtgctgcatgccaggcattgttttagccacttgggttacagatatcctcatgaaacctatattgctagtaggtgaaaatacacaatagacagtcaacattatccgttagtgagttgcatgtaaagaaagtgcgtgaacaatgagaacacatggacacaggaaggggaacatcacacacgggggcctgttgtgggtggggggagggggaagggatagcattaggagatatacctaatgttaaatgacgagttaatgggtgcagcacaccaacatggcacatgtatacaaatgtaactaacctgcacgttgtgcacatgtaccctaaaacttaaagtataaaaaaaaaaaaaaaagaaagtgtgaaggtgatgagtgctgtaggaaggaggataagggggcatcaggaattccagggatcatggggtcaggttgcagagctaaagagagtgtccggggtggcctcattgaaaggtgatatctgcgtccagtcttgagaaggtgaagcagttggccaagcagataaacctggggcacaggcatgccaggcagggggacctggtaggtattgaaggaacagcacgaatctagtgtgactgcagcagagtgagcgagagcgtgccagccttgggttcattgcaagattacatttctgtttcattttaacaaacctttgagcacctactctgtgtcaagtagtatttggcacaaagcttttcaaacctgggttccccatctgaaccatacaacacagaactctgtgactatttgttcagctcttcagctcttccaggagtgtgacacagctgatgctttctggatgcttgggagagaagttcattcagtacatctaatgcatgccctagggtattaggcctcattctctgctggaaccctgactgaaaaaggcagaattcctctgcccccagcccttgccctgtaattacagactagtaaatactatgaaagatcagagctaggatctgaagggtaagtcagagtaaagtaggtgaaatgtgaggtgggcccttggggagggagaggatactgtctaggtgagaaaacagtgggcagagacctgaggcagaggtgggagagggggtgagatggattttgtagggcctgtcacagccttgagtttaagaacacttaaactcagtctcaagctaaatagccattaagtgtttggagagagagagagagagagaaactgattgagaggatacgagatttgtgctttgaaaaattgatgagattgccctggctgcagtgggagaaagccttggaatggcaagaatggaattcttaagctgccttgtatttgcaggcagataagggtggtggcagtgggacagattccctggatataatggaaactccaagaggacttgggaatggatgggatctggggtttggaaaggtattgtcaaaagacaacattacaacaatgtaaagacctgaattggcttttacttgtgattccagaattgagaaacacttgaatagaattgagtgttctgatgggccaagcagaggaggttggttttatagaaagaaaaggactgaggaaagcagaaacagaaaataaaaagcagattggttgtttcagagttacttttcttataaaggttaaagcagaggggactttcttatcatgccagctacaactggcctgtttggggatttggctattctctctctctcctgatttctcggaaggtcagataaaaatcttattttggcttagtggtatggaacttgagcgtgagtgacaccattttggtttggtctattgggcatattgcaggagctcagttcaaaccaatgacctcctataaatttaatttaacaatttctccctttttgtcatgctctcacctaggagacagtgtgaccaaaacttagggcatcagcactactccgtcatcattattttggggtttaaatcttaacacgtcattcatgggtgtcctcattatcatgcatttcttggagtttccattattccagccagagagagaacatttaccattcagcagatggctgcatatgcacatttaagacttttttgagaggatacagtgcaccagggagactactgttgtggctaatgactatgaggatgataataccaagagtttggagtatgccccttagccagggtccccatgaaccaaaccaactgaaatcatttagatcaaataatgagccagatggggaatctacctgttttagccaagcagcctgtttgttcggtttatccatgtgcaacaagaagcattagcaactgtgcagattatttcctgttcggctagaaggtggcatttctgttacctaccatcccatgactaggtttggcatgacagatccgttttttcatcaagtctctgtagaagctactgattgtgcaattccggcaatgtagcattatcctgccaagtgaaaaaggtaggcataagcaaggaaaaatcaagaggagtcagagcctcattatgataaagaatcttgttctgatgtcttgggaaaagctgtccacagcatgaagttgtcagcttgtcctggtttgcagtttgactgcctgtgattataacgtccggtgtttgggtgaactctctgtggcccacatatcaggtatgagacctgtccctcataatatacatggagttgtcaagctccagcttgtagggcttctgggacagagcagttcttgtgtgtatttggagagttgtagccagatgtttccaaataggaaagtagaagaattctggatccgttccagcctacaaatagtaaaaactcaaaaacaacgaacagggctacaatctaataacaggtgtactatagtttttcttctgaaacatagtttttctctctacagtcaccctcatttctactaaagataaagcgaggtgaatttttttgcaaaatgagcttagtctcgtcaaacttggcctgattatttacacaactgcagtaatgctagtgattgatcacaaagtttgctttgctggaactttggataagaaatctcagattggacttttaaaggactctcaaagctaggaagccaaactgatatttccaactatattctgttatgagagcagactcatattgaacttaatggaaataactatattagcacaaagataagaagagtcacaaataatttccgaattctggagatattaggtagggagaaaacataaatatttcgtttttgttcataagagtataactttaccaaattactgaaagctaatataaggaaaaaggtgttttttttaatctgagaaataaaacaccagcaatatgtcaaattaaaaaccataaaacccacaattgttatttatcattttattctgtctcatgtaattaatttttgttctgcttgatcttggtcagtagtttcacaagcccatcagtttctttattagagttctggaaatgtttagccagtccaatggtatgatcttaaagttattagagacctcttcttgtcaaagtcctttccatcctttccatgaatctccttgaaaacacaacattttaggattatagttgcttgcaaaaagcattgagaaaagcatcagaataaagcaaattaactgtggataacaggacttaaagcgaccatgattagagatctgatgagggttcattataataatgattcagttgacaaggaaatttggctgtttctgtggcatacaacaagttaacatgataaccaaaattatgactgacagcatatcagatgatcagataagcctaattggagtaatgtttctctttttcacggtgagagactcatcctttgatgttttctgggggcccaactgagaaacctcaaagtgaatttgaggtcagagagacttgatctaaaattgattttgagaagtttgtcaaaaatatcaacaggtttaaaacaattaaaatagtatcacatgtcattgtggaaataatagttgttcatttaaccagtgataagaaaaagacttcagaaggcaaatacagtaagttacatagttgtcagcaaaaatttagctcttttaatattgagaagactcacatttcttaagtaatcaaaggcctaataaaagaaaatgcaaagcgcaagaaattgtcttgataaaacacaaaatctttatttcctaggccaattatctagaaagaaagaaaaacctttcactatttctcattaagagtaaatcaatactccaagaaagcattgagacaagcatcagaacaaagcaattaactgtagataacaagacttaaaatgaccttgataacctcgtgttgagagaaccaaattctattttgcattagcatctttttattttatttatttatttttttgagacagggtctcactttgtcacctacactggagtgcagtggcacaatctcggctcactgtaccttccacctcccagggtcccacctctgccttctgagtagctgggacagcaggtgtatgccaccatgcctgactaattttgtatcctttttttggtagagatgaggttttgccatgttgcccaggctgttctccacatcctaggctatatgcgatctgccctccttggcctcccaaagtgctggggttacagacattagccaccatgcctgacccatcagtgtacttttgatattaatgctcaatttttagaaaaaaaaggtttagaaaaaaattggacattataaataatttccttttaattttagctcgatcaaacataaaattcctttcacaagattcatcttccacaaaccttttaccattttctgatcgattctgttttgtcctctaatgtttctctttctcgttttggaagaaccgtcactctactgtagaaagaaaaaattactttctttttcccttaacaaagtctcattctttataacttcctatttagaaagtatcttatttccctcacatacagagttatttccttctagttttaatggtcatccattaattagactttttaactcttggtaaccttaatttctagtgaaaactagggagtgagcaaatttaaactgttttatatcagcactttgtacatgagcaccatttcttaatttttaggaacatgtgccctaatacagtttttttcatgtttattaacagactcacaaggcccgcatgtatttaatttatgccatataaaaacaagatgccagaatacatatactttacatttatattcagatattaatgtttcagtattttaacttatttagaaacaactcagacatttcataactattacttaacataacttgactttaagatttcaagttactggccaagcgcggtggctcgcgcctgtaatcctagcactttgggaggccgaggcggtcggattgcctgagctcaggagttggagaccagcctggacaacacagtgaaaccccgtctctactaaaatacaaaaattagctgggcatggcagtgggcacctgtagtcccagctactcgggaggctgaggcaagagaagcgcttgaacccaggaggcagaggttgcagtgggccgaggtcacagcactgcacttcagcctgggcaacagagcaagactccgtctctggaaaaaaaaaaaaaattcaagttactgaaaaggatttttgaaactatgatttaatccgtctataaacctttatcccctttacattcacctaatttagtcatgcttaatatttatgcttgaaatgcttcttaaaactaatcagtgaaggagttcaggaaatgccattccagaatatgtcgcattagtatattgatcacttccagctgcatgtacttgaaatacaacaaatgcagggagaggcattctctgaactcgtacctgcccaaagacagattctcagaagaactcagctgtcatcagtccctcctctgccccatcatcttacattattttatttttgttgacaaacaagacaggtataaaaaaaatcacagaatcaaagaaacagaagttaaatatgattctttatatttcaaaccattaatctttccattttctgttccatcaccctaagcagttgttagccagacaaccctaaatctgtccttccaaaaagatgactcttggatgaaacgagtttaaaaattgacatctcaaaggcataaaattaaacaccattatttgtcaagacaaagaaaggggtgaagtgggaattccagttaagacacagtggtccaaggtgaagcttattgtttccttgttttttatttttattttgagacgaagtttcgttctatggcccaggctggagtgcagtggcacgatcttggctcactgcaacctccacctcccgggttcgagtgattctcctgcctcagccttccgagtagctgggattacaccacacccagctaattttttgtatttttggtagagacagaatttcgccatgttgcccaggctggtcacgaactcctggcctcccaaagtgttgggattacaggggtgagccaccacacccagccacaggcttgttatttagatttgagtcttgccttcttcattgtaatagtttctagtgattcagggtgcagagaggcagatcccttacaaaatggagatttcctttatagatgtaaatttcttacagagtttcaaagtagccagctgagtgccagaaatgtaggcccttgtacgttttatttagcagtataaagtgagtcaaggatgccaccaggttcctggcttatgttaatgggtagttaacatccactgagataagaaatacaggacacttgttgctgtttatttggtttatgtataaacagtgaattgtggttcttttattcaacaccagagtgtaaaccattgactggaggtgttcacagactcggaataattgacttcagttcttcctgaagttcttaacttgtgggatttgggggcttttaaagggagtgacttggagggacaattctccaccttgagagaggtctccctttcatctggcacggcatctccagcatatctcctctaagcacctctgcccaggcaggtaactgtgcacgaactaaccttggaaaggtcaagagacctggctgtggctcattttcctttcttttcttgggtacttgggctcctaatgaaaatgcttctcattcagaggttccgggaagcctccatccatgagcaactcacatgatttacagaagaattgctatgctgtgtatcttcacgtgggtaacacacttgttcctcacagcccatagggttttgttattaaactattgagacccatgtgatggtggagtatcaagattgacaggttaatttcccatttatatagaacattatatgaaaattgatttttttaaggcatgggggtggaggatcctgggatgtgtggcgtggtgagagagaagattaagcatttagtgttttcagctacatttaaacttgtcctccttggcaccaacctaggggctgctctgagttctaaaggaatcacaggaggctggttgtacaagtggctgcattgcctccatgcgtttcctttgcttcttcccattaaaagccaaggaccaccttactcttgaggcattttaaacaatgaaatctaaggaaaacatgctcagttgagaacagacttttggggaggagtgaatgggaattctatgcaaggccgggtgcgatggctcacgcctgtaatctcagtactgtgggaggctgaggcaggcggatcacttgaggccaggagtttgagaccagcctggccaagatggtgaaaccccgtctctactaaaaatacaaaaaaaaattatccaggggtggtggtgcacgcttgtagtcccagctacttgggaggctgaggcaggagatttgcttgaacctggaaagtggaggttacagtgagctgagatcgtgccgctgcattcaagcggggaggacagggcaagactctgtttttaaaaataaaacaaaagaacaaaaaaactgtatgcaagttatttgattggccactcagaaagattactgattgattatgaattgaatctgttgtccaggcttgcattctcaaattttccagtattgtcaagaagccagaggctggtgttgatttgatttaacataacatttgacttaacataacggatcctattggtaattttatttcattatcttcgcgtggttttgaacctcaacacctcagcagtcaacttattttagatcttccatttcatcagaacgctatcatagttcaactaaataattatagtatgacgatgtagttacatttaagtactgtgaatgtaaaacatttggggctgagaaaaacatacactgaaacccggtttcttacttcatcagcagatgttaatgaggactgtctaagtctctggcactgtgctgggcactgagcaatatagaggctttgcctgccttttccaggaggcatcctctcactgccaggtggaaaacaaaggcagtggatgtaacctacaacacagagaggtgaatgctatgcagagagctctggcctcattaccccgtctaggaggtcaaggaagtctgtgggagaaaaaaattattcaaacagagagggaacccagcatcttgtggacagcctggatggtgactttgtgttgatttcaggccaattgggcagctccttgtgtggctgcccagttgtgtagtggagctgcattccatacaggtggggggttgggtctgaaaagtccacacagcaccaattacccatagtcaaaatcacacagagaatccttgtcggagacccacagagccagttgtcttcagcattggaacagaatgctgtttcttaaaagcagggatggcaaatgggccaaatccagttggcggtctgtttttataaataaagttttgttggaacacagccatacccatttagttacatattgttggtgctgctttcttaccaaagtggcagagttgaatatttgcaacagattgtatggcccacgaagtccattgtttcgtatgttgcccttcaaggaaagtttgctgccctctgctttggagcaaatgaaggaattcgttttatattcaggtactacgttgtaaaaagaaaattgttacctttaaacaccagaatcgtatcagtgaggtgagatattcacaccccagaacgcatgaaggaactgaagaagcagtcacctcgcctctccatctgaccctcacctggcatcatatgctctgactaaattggagagtgatttgcctaaaatgtgtctccttcctccttgccctgccctgcctctctgtttgtccaaatgcacgtagctgaattcgcctgagttttctccatactccactatatgcccctctgccaagaccagctaggtcggggagaccctaacccagcggcgctagaggaattaaagacacacacacagaaatatagaggtgtgaagtgggaaatcaggggtctcacagccttcagagctgagagccctgaacagagatttacccacgtgtttattaacagcaagccagtcattagcattgtttccgtagatattaaattaactaaaagtatcccttatgggaaacgaagggatgggccaaattaaaggaataggttgggctagttaactgcagcaggagcatgtccttatggcacagatcgctcatgttattgtttgtggcttaagaatgcctttaagctgttttccgccctgggtgggccccgtgttccttgccctcattcccgtgaacccacaaccttccagcgtgggcattatggccatcatgaaaatgtcccagtgctgcagagattgtttatggccagttttggggccagtttatggccagattttggggggcctgctcccaacatgtccgccttctttgatttgcaaatccataaaagcaagggcagctttgtcgcggtgagctacttctcgcaggagtcaggatccacatctgcagactgtacaaagacaacacagattaaaagcacaatcatcattgaaatcacagagcttccaagtgtttttatccattttaatgggttactagataaatatgtccagtaagtataattgttctctgtgtcagcccttgttgaaggaatactcacggcagtggtgataacctctatcatagctaccattaaattacttgttgtgactggttgtcccgctttcctcaggttttcttccaccatctgtgacagcttcttgatctgtccccaggtgggtggctgtgttcgacgggtgttgctcatgacagttggggtcctcctcagcatcagtctcgacatggctgcaactgaggggtccttgggatcctcccggaatctcttcctcggcatctggctcatgataaggtttcaggtgtcttgatggtatccaaatcggctgttgattttgggctggagaaatacaagcataacctctactccaagttattattttacctatttcccaactttttgttatcggatctctccactaaatcagttgttctgcttctgtctttgcagctgttctgtagatgctgttcagctgctgataacatctggcctttgggcaggctcaaaaaatttaaagttaataatgctagattcagttgtatctgcggtgttccataatctctatttccccctttctgcttttgcaactgctgttttagggaaagattcattctttccactatggcttgtccttgagaattgtatgggatactagtaatatctttaatattccacatagagaaaaatgtagctagagcttggctaggatagcctggggcattattgttttaatagaagctggaatgcccatcaccgcaaaacactgcaaaaggtgacgtttaacacaggcagaagactctcctgattggcatgtagcccagacaaagtgagaaaaggtgtccacacatacatgtacataagctagtctcccaaacaagggaacatgtgtgacatccatttgccaaagacagttaggttccagtcctcgagggttaactcctcctgtaaaagatgaagaatgtaccatttggcaagttgggcatcactggacaatagctttagcttctttccaggtaatgctgtatctgcgtttgagaccagaggcactaacatgggttaaattgtgaaagtgtctagcattagatatttcattagcaactaggcgatcggccatttgattcccttcagtcaaaggtcctggaagaagtgtacgagccctaatgtgagtgatgtaaaaagggtgccttctacttctaactgctgtttgcagttgggtagataaagtcatcagttgttcatctgtatgaaatcataactgagcattttcaattaactgtgtggaatgaaccatgtatgaagaatcagaaaccacattaataggcatatcaaaagcagtcaatacctcaattacagctacaagctccgctttttgagctgaaatatagggcatctggaaatctttactttttgatccagaataaagctttaccattactagtcccatctgtaaaacaatgaaaacgcttagcaggctgcaggttgtttactgcaggaattgtaaatgcaaaccgttcacagtcttgctcagccaaagggatagtgaagaaacagtcttttaaatctatggctattaaaggccaattttttggaattataacaggagaaggcaatcctggctgtaatgctcccataggttgtataactgaattgatggctcttaagtcagttaacattctccatttacctgatttcttcttaattacgagaactagagaattccaaggggaaaatgttggaggaagtatgtgcccattttctagttgttcagtaactaatttctctaaagcctccagtttctctttacttagcggccattgttctatccaaattggcttatctgtgaaccattttaaagatataggttccggaggcttaacaatggccaccatcaaaaattatttcctaatctttggcggaactttgtttttccacttgaagcagttctttcaaaccttgcaaatttttttctagtcccataccagggacatgccccaattcatgcattgtatgttgactttgaggactatataattgttctggaattagaacttgtgctccccattgttgtaataaatctctcccccataaatttataggtacagaagttataattggttgaatagccccaggtcgtccatcgggcccttcacaatgcaaaatataactactttgatatatttcagcggctttaccaactccaaatatgttacattgagcgggttgaattggcctcacggacggccagtgctgtagagaaatgattgaaatgtccactcctgtatctaccaaacctttaaatttgtttccctgaatagttatttcacaggtaggatgtttatcagtaatttgacttacccaataagctgctttgccttgtttatttgtgcttccaaatcctccttttcatttaatttcacttttccccattcccccatacggcacaatcaggagctgtgctatgcactctcctggctctgctgtccagggaacagaagtagttacaacaatttgaatttccgcattgtaatctgaatcaatgactcctgtatgtattcgcaccccttttaaacttaaaactagaccttcctagaagtaatcatattgtccccactggcaagggtccacagactcctgttggaaccttttgcggaggttccccaggcagaaggctcacagcttttgtgcagcataaatctactgacagacattgtacggaggtgatggaatggcctgagctggaaatgccccggtttagaacggggcccgggacgggcccctcatggcgtttcccgaaatcgggttcccttctatatcaaacttagagtgacactgattagcccaatgttttccttttttacattttggacatatttcaggctcagcagttttcttttttcccctatctggcagcctgactcgcttattttttctacattcttttttagtatggccatgcttcccacagttaaaacaagctgcaggaaatggagtatttcctttatccactctcagtcttgccattgcctgtgctagcagagtagctttatgcagattacttccgataccattacaggccttgataatcaactaaatgcgctttccctctgataggtcgcagagcagcctggcagtcgggattagcattgtcgaaagctaataactgcaacactatatcctgagcagccgaatctgcagtcatctttttaagagactcccgtaaccgagctataaaatcaacgtatggttctttggatccctgtttttgtagcactaaaggaagggtattgttctccacttgaagtgattttttccccagctctaatgcacactcctctaagctgttctatggcatcatccggcatgatgagttgtgcatctaaagcagcccagccgccgacccccaaaagctggtgcgcagttatattaattcgaggttgggcctgggcattgcgagcagcctgaatggaagcttcatctgcccaccaagttttaaattgtaagaactgagcaggagttagacaagctcgagtaagagcatcccagtcagtaggaatcatccgactggaaacagcaacattctttaacagtcccattacaaaaggagaacctggtccatactgatttatagcttgtttaaattctttgagtaatttaaaatgaaaaggctcaaatgtagctataatatttccctgttgatctgggggtgtattctaacagggaactgccaagcctctaaatcactccctcgtctagcttgctgaattcctgcctgaatagaattaagagtggtcgctcgaggtgctgcttgaacagtcactggggcaactaattttcgcccagtgtcctccggaaaagaaagatctggaggatcattttcttcaaaataataatgagggggtgcagaggggtagggatgaacctctccctcctttgctgctttagctttagctggtaaataaacatgctctgtaacctcttttgttacctagctatactctccttcctcctcatcatcggtgtgaaaaagttccaaggtgggacgaaccacacccccacacttgtcctattgttaccctgatgcttctgagctccccttcttactcaccagggggattgctttgagagtactcgggtgtcctccagctagttccgcattctccagccatcactctggcgacccctccacctggattcgagcccccacgatggacgctacttgccgagaccagctcggtccgcgagaccctaacccagaggcgctagaggaattaaagacacacacacagaaatatagaggtgtgaagtgggaaatcaggggtctcacagtcttcagagctgagagccctgaacagagatttacccacgtgtttattaacagcaagccagtcattagcattgtttctatagatactaaattagctaaaggtatcccttatgggaaacaaagggatgggccaaattaaaggaataggttgggctagttaactgcagcaggagcatgtccttaaggcacagatctctcatgctattgttcgtggcttaagaatgcctttagtggttttctgccctgggtgggccaggtgttccttgccctcattcccgtaaacccacaaccttccagcgtgggcattatggccatcatgaacatgtcacagtgctgcagagattccgtttatggccagttttggggccaatttatggccagattttggggggcctgctcccaacactcctctcctccttcaattgcagtggacaggctgatgaaaaaagagcagagccaggcttaataatgtggatgaggcacttctgccaatggaaagctaaaatgatgtcgtgattcagtagaaaaaagtggtaagacaatgagttgtcattgtgacacacagttaagcatattgaaccccaatataactaactctctacactggattcacattggaactgactgtgcagtctcaagaagacattgtccttattgtccatcagtgtgcactgttaatcaaaatttggggatgggagttttagttgcgtttagttataaatgtgctttgattttatagttgtaaaggagctagatgcgtatggcagacagactttaaggtgacccctaggattcttgcctcctggagttgacgcctttgtctcattgtctcacctggagttggatgtggcctgtgactcgcttcccacttctaactcctcttgccagctgactccctctggggccattcttcctggctagctttgaggaagaggcccctgtggcagggagctgaaggtggcctcctgcctatatccaacaagaagctggggaccttagtcctacagctccaaggaaatcagttcttttgcccacaccccgagtgggcaacttgaatgaagacccttccctggcggagtccccgctgcgtagtaccctcattgcagcctttcagggacccagctaaactgtgcgtggacccggacccctgacccacagaagctggtagaggataaatgtgtgttggaagccactaagtttgtgtacttcattatgcggcaatacgaaacatttcaggacttacacaagttgttactggtacttatttaatgttataaaaatctgagccaagtcagatcactttaggatgggaacatctgaatcacagccttggtgagcttctaatccaccgttccctttttcttcccatcaggcaaaggcaaaagtggctcctgaggtcctttttgtagcactgacaggtttccttggtcatagtggaagagaggggcatcccacatcatttggcccagtgttcttttatggaaggacacatggaggacaggggctggccccttaggcttgtcttccctgaggtcagctgcagcttccaaggaggtagcatcttgagacatttataatctatcctttgtacagctgcttgtggccccccccttgtcacataatgagttcgcagttgggatttcctcgtgtgagtttccagcaccctagggccatatttgtcctaggattctcctcatcatttccccccacccccagtcactgctgcctcttagcctttgcttctccgggctgaggaattcctgcatttttaatctgtcctgctcctgctggcctgttttgtctagctactgcccttcaaaaccatatccagtttcactcataaaaagcagggggaaatggtcaaaccaaaccctccagcctcccctgtgtagtcctggctcttgtttgattgttggttctctgaagaaaggtgctctgaggaggaagagggctgcctgtgcccccggcaccccccatcatggaggctggcctcctggtgtgttgtttgattgggtgtccttttgcacccctgaggtcctgctagtacctgcagtgctgacagtccctgtgggcacgggtgtgtgtcaggccttagtcatcagcacttaaccgctctgagctgcaaacattgggcctcagagctcagtgttgatgtgatcaccgtctcacttctgccaaaaatagatggggaggaacatatttctgttaagctcttgagggttacagctggattaagttagagctcctgaaaacagcacactggcttatactagtggtttagattctctaagaaatgtgtattgatataaagttatcagactattgattttttgtagagtgaaaatattaaattgttatttgaagaacatcatagatcttgtaaaagcaaagttgaagaccagattcaaagttactttacattcttcttgaaattccttctagaatgttgtgctaggaaaagtccctcttctgttgagtttatttactttcttttaatggacaaaacctatcttatttacctttttacctttgccactaggaaacttagaaccaaacgaatacaactcagttgcagtaaatcttgagttctaagcttctgactctgtttgcttttaaagtgtctcatttgctgtgtgcttagtgttttctaaataaatacctaccattaggggaggaattgctttgtaactttgcacattagctccgtggtttgcgttgacctcgattctaagcagaaacagctgtgagtatgttctattaattattaggtgagttgttttaactagtgcagacaagagcttgttgacctgtgctctgggtgagaactctgatttctgcttctactcaaaagggtcaaatcccatgatgtagttttgacttaggagaatttagttctggcctggagtgaatctttgtgggattgatgcagaccaagactcgtgttaaggccgagctctgcagcagctggccgcttgtttgtcttctgagcctgtttcatttgccttccctggtctgcttgagcagaggagagaggaagaaaagctgttggcagatgtttttagtaagacccttaagcgtaagggaggaagctaattttagtcctgtttttaatattatggtagtttggttgcgtctttcctcttagggtagagcattttagcttttgtttttgcttttgcatttcctgtgtatatatcctgaagcaaaatggactgctaaaaatgtcacttggtgtttgttattttgtgcctagaataacattcaagacccgtgagcactgtgagtcactaaaatagttttaggagaaaggaatgttgtctgtgttactcttttctatatttccttctagaaattttccagttgattcctgtgcttatgttaattggacatccataatctctttcttttatcatcagcaatacagtaacattgtatttgttagcacattgcatctctacttgcatgcagagctctttaattttaaaagtacagtaagttttggaagaagatcatggctaaagaggcaagttgctggaaaatacagttgtgctgcttactcagtgaacaaccagccaacaagctgcgtgcacgtttattgtgatgagaacttaaacacaaagcagacgtgtaagttcccctggtgtccccagttcctagcacatagtagaaactttgtaaatatttgtttggggtaaatgaagtcagtagcactacagataggaggccgtaaggaaggatggtttctaaaacaataaaaagggacatcagctaggccagtggtcttccaacttactgtgtatcagaatcacctggagagcttgttaaaacagattgctgggcctacccccagagtgtctgcttctgtaggtgtggcatgggcccaagaatttgcatttctaagaagtctcttggtgaagctgccgtcgttgttggttcaggaccacactttgagaaccgctgactaggctaatgcctgtggatgagaaaagaggcttagagaaattatgttttgcctaattgacaaaaccaattagtggctgaaacaacacagaaggccaggtttgtcctctcacttcctaacttgaggacagagaaatatattctgatgtccctaactggcagtctgctatggtagtgaccacatgcccatttctttcttgggatttcgtcccagcctgacaaccttggaacagaacaagaggacaggaggtgtcgttccaggtatgtgttagctgcaccagccactctttgtggcatctgctacccatcaaaggacgtggttgggctgggagccaagttaagttttctcattgtttggcagttgtgtccccagattttcttgcccatcttggagatcttagcacagccggggtgcttggggctcagctgccttgaaggggactcagtcccccacacaggtgattcccatgtcccatggtgggcactgagattggggtgaggggagcacacttgagggacccttcacttcctcacagcccttgcccctttcctcagggtgcgctgggaagaacccccagcggctgcccatgcccacctcagaagctgttcagtttgggcagaaggaggttattgtggccaccttctgtccacggttttcttttacatcctttccattgcactgttggtgcccacctccccattctaaaagacatggccactggctccacttaaggaaggcactttattgtcatgattaagactgtgaggccagcctataatcccagcactttgagaggccaaggtggaaggatcacttgagcccaggagttcaaggctgtagtgagctacgaccatgccactacactccagcctgggccacagggcgagattaaaaaaaaaaaaaagactgagtttttgtcaaactgagcagttcgagttcaggctgtttcccaatcatgctgtgactttgcacctagttcttttctctgagctttagtttcttcatctgcaaaatggcaattaatgtctgcctgtcagggctggcgtatagtaagtgctcagtaaattacaggctatcttttgaggagcaagaagtagactagctcctgactaacccttgccttaaattcctcttctctaccttcattccctgggggctttcctggtacaggggcaggataatggtgtgtgcttactttggattttgccttgtggcaatttgctgtaagacatggttggggaattcatttttatctagacatcaggaccaccagtacattggtaattcgtctcttagtggaaggtggcttgtgggtgtttggcttctcagcctgttggggaccatttttagatttctgaattaatcctttctcatggccggtgaagaaaaaaacacatggtgaaccctgtggacggcacgtcccggcacccgcaggaagctgccgggctccctgctcccgcagagccctcctccacagcctcgcccagcccctggctcttgccctccctgagtcaggtcacctgttcagctgaccctgctgggctggggccttccagatgtgctcatccctctgctgggagcattttcccctcggtccgtgcctcatccccacgagaaatacagcgcaaatccagccaagtgcagcaaatctagccaagtgcagcaaatctcaccagcttctttttaagccagtttcctcttggtggcaagcacagttgctaccaccccccaccaccctctgtggaaagggctatgacgctcgccttctctctgctccctccctcccagctgctcctccagaaccccccagtgtccctgcacatcccaggagtctgcttctggggaaccggaccaaggtttaagcattcaccttggggaggccacccccacccctctctccagacttggttaggggtctttggcctcacttgtgtagcacttgtcccctgacctcggtagcgatgcttcaggtctgccctccccgcgcctccacagggtttcttgttctctgaggagtaggggacaggacagaggcttttcctcagcaggcagccagctcagattggactttccttctagggatccctcttcaggttgggttggtgggaaggccgtctgaactggagcaggtgggctgtgtcagggaggcggtcaccggactggactctagccagcggttcccacctccacgcgcccaccgcccaagcagccagagctccagccctagccgcccaaaacaatgcagggcaacggttttctcctgagccaagtgtggagacctagatttccttgcacctgagggagagggaccacagtggtggcttctcacgccttggggaaccggaccagggcctgttcataacacagagatctgagctccttctcaagtcaggctgactgctttgggtaagagggcagaattttaaagcaaaaccgtgctctgcagggcgcctatttcagcattttcagactggtcttaacgtagttggttcattgccctcagaaatgaatgttgaaagcggtaagccccatttgaagcacccccgattttaacaagcttcaggacacatagttctgtgctaatatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcattctgctttttacagagtttagagacccatttatagattcagtccacggattgtcatgcatttgcaaaaacgtctactagctctccgagttccatatttttattatcaagggacccttagatctgaggacatggggactggcagacaccagctgcagaacggaaccgtcttttaggaaacagaggccacgatgagtacatgatgggccccatctacctagtggaaaatgaagcggcatgtttttcttcacggtcactggtggctcttggcaatttctgactcagcaccattggactttctcctggcccctcctttcctctctgttgggtggggcggccgggggggtgcttttgtagccctccacagatggagttgataggaatgtcctgctttctaaccatctgcagaggacctgtgctttgggtcacagggtcctcagcaaattcctttcccttccagttgatttacagttggttccaattggtttacctgtttagaaaattctaagtccatcttaaatgtaaaaggtggttatcatcttagaatgtgctcaaagaactttaaagataactgctttccactgaggacacagttcatctacaggacagggtcagcagtggagttgggaccccaacctctagcttttgggcctgctcctagcaggccaggtggcatggtggcttttcatccagccctgatttgggacacactgatgtttcagcccctccctcttaggaattctgatttgaaaatcactgtatctactctgtattcctatgagagagactaaaagattttgttcagatttgctttcttctgattgcaaataggaacatgtatggtttttttgggtgcactttttcagaccagacgccaggtcattctgacccaccccactcctctcctgagaatcactgacttagtgcagttatttgagggcaaaaagcactttttttcccagcacaaagtaggtgctaaacaaagtctacagccaaatataaacaagcaagccctgaagcagaaggaagagcagggctcagtggtggctttggccccctggttcttatgtctgtcactccacacacgcagtagggcttcaggagatactggctgactggtgctctgagccttttaccagaagagcctgattcagctaaatttccttggtaggggtgactgcttagttggaatttggtggctggaactggtggtcaccccctcttaccctacacgggccttttccaggttcagcatttacagatttgtttcccaaccaggaggggcttatcctaaggaatgttctgatctgagatgagattagaacttcccctgctgtcgaagtcaaagggtcccatctgcctgtcacttcccatgtgccctgggctgtgctgggctagtcatcagcccctccccgtctttggcccaagatgtggaaaatcttaatagctcaaccggttccctcagacctttgtcttctgaaacagtgcttctcacactccagcactgcaggcccacctgttgaagcccagtgtcctgggtcccttccccagagaccccagttcatcagattcttaggtttgcaccagggctaaagagctggcatccagaccccctcccatgtgacactgatgccgtcatctgatgcccagtcccttttcagctgaacgaaggatgaagacacaatgttgtcctaaaattgattcagtgaaatagcaagtagtgaaaaagtaaaatagaatttaaatctttagatttttgacatattttgtgtacttggttgtaatataaaatacgtttcttaccggggtcaaaaagcttattagcctctgccttagctacttctccctctctgaaatgcccacctgtgcctttgcacctgtgcttggtccttagttccaggctcaggaggggaagctaaccagtgtcttggcaacttttggctatgggctaggtttgcggtcttcaccaccatacatgacccctaacctacagcagcacctattggcccagtgagggggtttctccactccacactccagggagaagggtcttcacatgtttcaagttggttgtgattaagtttcgtgaaacgatattagccttaatacatgcatggcctctgagattttctgtttcatgttttcatctatgacattgattttgggaagtgctaaatgggttggttgtgcatcgtaaacatcaacattgggagtaatccacaaatccacccctcaagtggccagaaccagttcccacaactctccagggcacctgttctcccccagctcaactgccctgcactttccacagccagatcctgcaccgtctgccagtctcggttccagggcctccattcatgaacttttcctgcatctctcacaaagtgacccccacatgtcctcagcatttgactcacctcacagtgtgccatagccctgggttggaggcttgactttcttgtcagcttatagaccacctgagtgcagagcctgcattccagtgcccccagaacctctgtggcagcaaaggccccacgttgttgggctggttggaggcgctcagccacattgcaaccccagttttgtgggcgggcccagaactgggacttggtttttaactttgtttcaaggggaaggtgtgttctgattccaacaactgacttggaaaagaccgatctctgctttgcctctccaccgtgtggcccgtgcctcctccctggcgggctgagatgtaggccttcagacagacggcaggaggctgcctcctgtggaggatttgggcctttaaaatagaacttcaattccaggagacttagaggatacagctgctgagggagagcaatgaaaaatgagattccctcttgaaaaacgatcactatttcctgctctgaggattctagagtaaagcaactgagtttttgaagttgggttgcccctggtttttcctaggggcattccccggacagtgtggggtttagagagtgttaaatgagagaggtaatttggagggagttagaggaatgctatttggctgagttcaagatccagggaagggggatggctgtcttttcaaaacacttggttgaggagcctctttaatcagtatggcgagttttgtaactgatcacagactgctaaggcataaaggcagtgagaaagggaggactttctgacttaggaagatccccttctccgctttcttgccaaatgttggcaattccaggcatcactgaaatatatgttcttccccaacccattatttttggggttgtttaaaaatagtgtcttggttgcacccataatcccacctcccaagtcgagagagccagtgtataactttggcctcttccttgaggccgggagactgtcccgaggttttgcgctgagagtatttttagcccaggtgctagcacagccgggaggtctttgatgtgcgtctgctatgaaccagccatcttggtcctgggcttttccagaagggtgtaattcacttttacaagcagtcctggcctggaagtcttttcttctcctcttacagtgacttactcccctggtgatcaaggttgtgaacacacttaataaacagcttatttgctagtctttggcttcaaaagggggaagaggagcctacaccaagattgtggcatctgcgtcagaagcgagggtggggacaggatggtggtgatcctagccaagcccagtgtcccacgctgagtgggtgctgacttaagtggaacactgacccagaggaaataagaaaagtcctctagggccaagagcagacgtgagccctccttcctctgaacttgaattctgctttgtttgaaccatccttagggtacttactcctctctctactaaattaggagaccgtgtggctggtgtgtgaagcagaactgattcaaatccagggtctgtcacttactcctcggcctcactctccctgtctgtggcatgaagacagtggtacctgtattggagggtcacttcgaggcttcagtgagatgaggcctgttgagtgcctgcggtggtgctgggtgctcactgcacaagaagtggtcctagtcattgctgtgtagccattgtcatcgctgccagctccacgtgggcagggccttgtgttactcagcacctgatacaactccctgtacatagtgggggccaatacatttgactggaaatgaagtggattgaattttaggctctaacccaatgaaattctgtctgtgcttaaaccaggaggacttctgattttcccagaacctcaagggccctcaggagcctcccgtgggggttaggccagtaactctgaagtaagagtcagctggtatcagtagcaccagggtgggctcttctatcccagccctctgcatgcttgggtgtcatgtcagaacatgaggaggagaaagggctgagggaggcgagttgacgctttctcctccagttcggaggaaggagcctgaactgccctcgttcaggggcaggggggcctgggtggtaaactgggcctcctcctgaccccagcaccttgcaagtgctttgcgtgtaaatgtttatggagtgaaggggtggatgagtgaggatgccacgcagtgtctgacctgcactgtgcagtgcagcctgcttccctaaggtgacagggagggacttttgaggtgactcctgtcccttcactgtcttctttctctgcccatgagctccttctgcagtgtcccaagctgctagggattgtggctgccagctccttcccctgttgtctgggagataaatacatgaatgtatgcttactgacgaatgaaaatgctgtttttcctctggaggcccagagggtggcctgtcaaactgtgagttctcagagtctctgagcagggctagcgcagcagaggtgggggccgtctgctgccacctcctgcctgcaggcccatggggctccatcaccacgacccagccccagctagacaggccttcctgcccccagactggctgctttgctggtggcactgcactggagagcaggaggctgcggccccggcagagcactgttggagtgctgagatggcatgctgcctccacctgcccctcctaggctggcagccatcctaacaggcaggttcctctgagccacggaggctgccccaaacaactccacctaaaagacaaaggccgggggagggctctgcctccagatgatgagatataccctggcctctgctctgtggtttactcagaataaactgttattttaccatcactctttttttcattttgcctctgaaaataaagctgagaaatgactaattcacatctcaggaagcctatgaagtctgtggttttcatctctagatcaatgcctaacagtaatggaaaagaaacgcttccctgggagtaggccaccgtggggacaggccgccttgagtggttcaggacaccggctagggctgcagtcaccttgtctgtgaaaatgggaggggaggggaggtttaaacttaaccctgtgaccttggccaaggtccatgactaccgtgtgactcggtctcgtcatctgtttagtggtaataagaatacctcccctctgatgttagcatgaggaccaggcatatgccaagagctccccacatattagaagccccactcctggcttctaaggggatttcttaaattgtaagttttttaaaaatctaaattttaatatctaatttaaaaatttctgagaggaagtttaaaaacagccgctgctgatttaaccacttgattgggctccgggagggaagccgctctgagtctcagaggcgtcccttccatcccctcaagcagcatctgtggtttataagaggagcgagtctgggaattctcttcacgtctctggcaggtaagggaggggctccctggacatcatctccatgctttgttcacgcggaaaagtttacctgacgagggctgtgggttctgtttaaatcctaggagatgcttaagttattagaatttttctctatttttaaagccagttgtgttaagaaataacagctgtccactgaagatggtggcatttatcccaaaaaggagtatatttttgaacggtctggtggccacagatgacatttatgaatgttaactaagtgccaggactgggcttagtgactcactgtatgtgcagtactgtatgacatcctcccaacggcccagtgaggtaaagatcactactcccattttacagcagagaaaagcaagccccagggaggccagctgactcagcatcacacaagatgacggcctttcccttccatctgagacgtgggtgggacgggaatacgtggataggctgccctaggccacgtgtagagatgagtgccacttctgtttgccccatgtcatagccataggacatggtggcagttcccctttgaatgactgtggtccctaccttcagagaaaatcagtctggaatgttgggaagctgtgatggtagagatttcttctcttgaaacaatagaagactgcctctttttccatgcattccatcaccagaccttgcacagtgacatttcttgaggccatcacccagccacctctgtccctgtaccaggtactgtggaggaggaaatgggcagtacctccgtgtaggaagagggtgtgggagggctccatagtctgggactccagtgctgccctgagccctgcctaaggcgagcaggaagccgcctgtgactcggtctcctcatctgttgagtggtaataagaatgccttggctgggcgcagtggctcacacctgtaatcccagcactttggggaggccgaggcaggcagatcactggaggtcaggagtttgataccagcctgaccaacatggtgaaaccccatctctactaaaaatacaaaacttagccaggcgtggtggcaggcacctgtaatcccagctactagggaggccaaggcaggagaatcacttgaacccgtgagatggagatggcagtgagccgagttcgtgccactgcactccgcctgggtgacagagtgagactctgtctccaaaaaaaagaatgctttgaaggcgagcaggaagtgccaccttcaagacctcagcactccaccctgaagcaggcagatccaaccaggccaaggctctttgcttcatgtcccagccgtcccatcacaggaggtgagggcccaggctgtgcgtctagtccagcagcactggaaatgtggccagtgccatctgagatgtgctgaagtataaaatccacagcagattaatatgaaagaaaaagaaggtaaatagctcattaatcgtttttatattacatgttgtaataatactttagataaattgggtcaattaaaaaatatttttaagactgggcacagggactcttgcctgtaatctcagcacttagggaggctgaggtgggcagataacttgaggtcaggagttcgagaccagcctggccaacatggtgaaaccgtctctactaaaaattcaaaaattagccaggcgtggtagcaggcacctgtagtccccgctactcaggaggctaaggcagaagaatcacttgaacccaagaagtggaggttgcagtgagctgagatcttgccactgcactccagtctgggggacagagtaagtgagactctgtctcaaaaaaaaaaaaattttgttttaattacatatgtggttcacactatgtttctattggatagtactggtccagagagtccgttagaacctagaggaggagggtgaacagtataatctttcttgtctattccctggaggtagcttgaacaacagatgttctagtaacccaggctgaagcgtcccaccaaagaaagttcctgaatgagttgtctctgactcgtgtgctagaactacttagagaattatattaaaaatccatataaaccatcttatctacatctctgatattaccatctggtgtagactgaatgtcatagctgttggttgttacagggttaattcattgattcttttatctgcgtgtttgctaacaagcacttatttattttatgatgtgtcagttattgggctaagtgccagattccaaaatgaatgagatttgattctctcattggggtctcaaaggactagtaagtagaacccttctctgtcccctgaattctgaaagttggaaaagaagacagtaaggtagatagatggggacccaaatatcaccttgatttctaaagccttgcttgaaggatgcagcttgttctaagagcccagtgagcttcccagtattgagtcccaggattagaccaacattacccaaccactcatagtggctttgcacttgtcaggcctccccatctgggggacatcggagaacaggcttaccatggagggcttactctcagaggtggggagggggttggttggggcggcacatggttgggtgcaaatcacacagggcctctctgagggagaatagatgccatcagaggttttcaaacagaagggtgacatagcgagacttagctcttataaggactactctgattgcagagttgagaatggggagggcaaggagcaggggacagttagaaagccatcgcggtcgtccatttgaggaataaagatggcactgggcaggctgaccgtggtgcaggtggtgagaagtggtggattctgaatgtaccattaaggtagaactcacaggatttgccgaaggattgccagatggactcaagcaaaagagaagaatcaaggattttaacctgagctgctggaagggtgaaatgtcctgtttaccaagatgtggtcaaagcaggtttgggaggaagcttcagagatacagttttagacttgtgtttgagccacctgtcaaatgtccaagggaatcaccaagagcttgtgttgtgtaatgagaccacccaacaatgaagtcatctggccctcttctctatctacacatgtccctgagggcctccactggtcttctagcttcctatactgtgtatatgccgacagctctcgaatatatacccctagccttcacctagctccttcacttctcttgaactgccaaattcaggctcctgtggatgtctaatacagtatttgtaagaagaggaaataaggatggatatactacttatttctgtgtaaatgagggataaaacagaagttatgtagttttttaacttttgaactgtataaatattttacaaattcagaaaaaatcctgaaattgaatatcaataaaaacaaacctaactgtatattaaatgataatataacccacacagaaaaaagaattagaatatctttttgaacacagtacttgctatatgcccatcacaggatatattctaaggactaaaagaattgctaagaaatcttgaacttttacctttagtagttgttaatgatattcgtgtagcaattctgaagaaattttgtgtttattgtaggataaggcaaatgaatagattgatgatgttagaaaccagggttctcactgataggaagggagctgcaaatatggaatcaaggaaggaggaagaacctggtggtgttggcttgcagtaagaaataacagtattaacttatgatttaaaaatatatagatatatacacactcatatttaattatatatatttacattaaatacatgtacatatttctctcctagctgtgtccactgaaaggacatagaacagtgacatcccagtggcaatgagcacatctaatgccccgatcttggtttctaaataccactccccaccaaaaggagctagggtacattaaagaaatggcagattccaagctgatttcctggagaaatggggtagggaaggtacggggtgattctggagcttcttttgcatcaaaaaccaaagaagtattcaaagattgatggagactcctcagtaacactggagatgggctaaaaaggttccctctggccaagtttggaagtttgaacatgaaagggcatgattataatggattataacacactgaataataaatgaacacccaggtccatagtgataccaaaaaaagtaaagggtgggggcctattacttataaaggaatgccagccaataaatatcgaggaataattaataatcaccaatgtgtaaccaccagtaaaataaagattcacataaggatcatcagtggatgccaaactattcagtgaaaatttgttagggaacaagatgcttaaaatctcaaattgcagtacagattacttattagttacaaaggagaaactatatcattgcagtggagaaatttggcagataccaccttaaccaagtgatcgaacttagcattatcaataactgattaataatacagtagaaagcacataccacccaggaactgtgtttaccaagcatgtattacccgaatctcatgacagggaacaggcagatccaacttacgggggacctcctccaagacaactggcaggcacttttcaaaatatgtcaacgtccaaaagccagtcccgtccctcctgcctccagactagataagggaaattggagagacatgacaaccagatgcaatgtatgctccttaattggatcttggatttaaaaaaaaaaaaaaaaagctatagagaatctgataagagaaatttgcttatggagcaaatattatgtcagtgttaaatatcttgggtatgataatgttattatgttatttatgcaggagaatgtccttgttcctaggagagagacagctggtagtatttagagatgtgttataacgtgtgcaactttcagttgctttgatgaaaaataaatttgcatgtgtgtttctgtgatagagaaagaaaagggatggaaagcgagcatggcaaaatgttaacggttgacgaatctaggtgaagggtatgtggacgttcgcttcatagtattctttcagcacatcaatagatttgatttttttttttccaaaatataactttggaaagcgggcatggcagaatgttaacggttgacgaatctaggtgacgggtatgtggacgttcgcttcataatattttttcagcacatcagtagatttgattttttttttccagaatacaacgttggaaccaggcgtggaggctcacacctgtgatctcagcactttgggagactgaggcaagaggatcacttgagcccaggagctcgagaccagcctaggcaacatagtgagaccctatctctacaaaacgaacaaaacttagccagggctgggcatggtggctagcactttgggaggccgagacaggcagatcacttgaggtcaggagtttgagaccaggttcgccgaaatggtgaaaccctgtctctactaaaaatacaaaaaaaaattagccaggcatggtgattcatgcttgtaatcccagctactcaggaggctgaggcaggagaatcacttgaaccaggaaggcagtgagccgagatcgtgccactgcactccagccttggtgacagagtgagactccatctcaaaaaaaaaaaaaacaaaataaaacaaaaaattagccaggcatagtggcgcatgcctgtagtcccagctcctcaggaggatcatgtgagccccagaggtcatagctacagtgaactgggatcacaccactatactccagcctgggcaacagagcaagaccctgtctcaaaaaataaaatgttgggggaaaatgaaggataagaggaaaggaactgtagacaacatataggcaagtctttcaagtggttttgctatttagagaaacaaacgtgggagtagctggaggagaaggtgggcttaaggactcgggtctttaagatgggggagatctaccatgtgtatgtgcagacgtgaagtgacacacagcagaaggaaacctggtggtggggagaggagagaatggctggtgcagtgtgtgagcaggccgggtgggtggggccccaccgctgatgtaaggcacagatgagatgcctaaaaagtcattgaatgagttttggttttaattcttaggcgagcctcatgagacagatactattattaaaagtatattgattcaatcttggttaaacataaaaaattataagattcaattgtatttatattaagttcctagaatttttcatacagtaagggagaagagattggaaaatgcttatttactggtgatttaagatcctaagaatgtatacatttatgtaggtgttatcttttattatttttaaaaagatgagacaaaagtttcctgagatattcacaggctcttcctgagatagtcaattcagagttcttagggaagatactcattctggaatattcatgggtaaatacatttgtttgttttagggaatggaatttccttaagttgtaaatgaactttgcagttgttaatctgacccatataaaaatcatgtgggctctttttccgaagaatcttagacctttgtatctgggttatttcacctttttgttggaatatactatacatcaggaagtatatacacataccttatgtagatagcttgcaggattttcgcaagttgaacacactggtacaaccaacccccagatcaagaaacaggccataaccgtcacctcagaagcccactgcttcatgtcacctgccagttaaccaccccccactccccgagcataaccactatcttgaatccccaaataatagattaaatttgtctgtttttgcatttatataaatggaatcgtataaaatgtactcttttgaatctggcttctctctacactcgtgagaaccatgcatgtcatgggtgtcgattgcatgatattccactgtgcgacggtgccacggttcacccgtcctgctgtcgacaggcattcgccgagcactgctgtgatattctggtacatgtctgatggtgacctcacacaggcgttctttggagtggagttattgggctggagaggaaggatgtgttcagccatagtgggtggctgtcagtcagcagggtagagagtcccccttctcttcatccacaacaccgatagtgttccctgttttttctttttatctattcaggcatgtttgtggtggtagctcagtggttttaatgtactgcttcctgatgacaaattgagcaccttgttatatgtttattggccatttgaatgttgccttttgtgattctgaatctctttgtaatgcttaccagttatgcaagtaaaatgaaaagggtggttctgtcagatcttaacccaaatccaaggtgaagcctggtttcctgcataggcgagaaggccccagggcccagaatccctcctcaccccttctgcctccatccagggccccactctggggcaggcagtgctggctgcattcagctcagtggggggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagcagagcatcatgcagccattaactgcactcacatgggaaaatgcccacaatggcttgttgtttaaaaaaaaaaaaaagtgaaaaaatatttctgctgtgtgtggaattatgagaaatgtttaccgtctacgttatatatttttacagtgcttggatttttataatgagattgtttgaaaattttttaaaagataggcttaatattcccattagcagtgtcatagttatccagtagacttcctgaacaattgggtagtaggaatggattttcataacaaaagagtctttggaattgcaaaacttcaaatattgttttccctctgttttaacaggaatagttgtatattaagtaagacagaggatctttccatgttaaagttgttagaaaaatataactccaggccgggtgcagtgcctcatgcctgtaatcccagcactttgcgaggccgaggcgggcggatcacggagtcaggagatcgagaccatcctggctaacacggtgaaaccccgtctctactgaaaatacaaaaaattagccgggcgtggtggcgggcgcctgtagttccagctactcaggaggctgaggcaggagaatggcgtgaacccaggaggtggagcttgcagtgagccgagatcacgccactgcactccagcctgggcgacagagcgagactccatatcaaaaaaaaagaaaaatataactccaggttgcttttggctcgactagactggggttatttttagcttttgcctttttaagtgttggcagagacctgacgaggttatcacatgacaataatagctgccatgtattaagtatttgctatatatcaggtccttggctacatgctttacacacgggtcacatttaatctccacaattacctgaggaggagctaggtctgtggctatggctttcctctaggtgaggaaccggaggctcgggtaaaaagtttgcccaggttagtggccgagctgaagttaaaacaaagacacacaggcctggcgtgatggctcacacctgtagtcccagcactttgggaggctgagatgggaggatcccttgagcccaggagttcgagaccaacctaggcaacatggcgaaaccctgtctctaccaaaaatacaaaaattagccagtctcgtaacctggtctcaagataaaataaataaatagatttaaaaaaaaagccacagacttcagctctgctgcctcctgtgcccatagccctctgtctccatctttaccttgcagtccacaaaatcctagacaagtgaaaagacttttaaaaaattggaaatcctcatctttaaaaaagcttttcctaatgtcctcaatcacgcctccactccatttgtcctttttatgcatttggaaaatggggaatgtttattaagtaagtgatctctaaatccttcccagtgctcgacttctgagcccagtagaagacagggaatgaggaattagccacagcgtttctcaagattggctgcctcaaagttgtccaccttgcccttgactttgtgatcccgtgtggttgatgtttagagactccccaccatccctggtgagagattaagttgagacagaaaccactgctaagttgggaacccagctgctgctacaaatgacacagaaagaaggccagttgatagccacatttgtcagcaacaggcagagaccattgttaagcctggccgaggggcaagttaaaaatttaagaatgaaatattggcatctggcagaccacttgaagaaattgggttggctttgatgtctttttgctctgcttggttttctgttgagacatgattctgtgagcaggctacatcctctcctccggcccatcctctttctctctcggtagagaaggacattcatccgacagccagatctgtagcctgcgatggttgcccaagaaagtggctgctgttggtaacatcacagtcaatttatacagaaattgtttgtaagctcatataagccacccttcctctggaaggaatgactagcagattagtcactgggagtctctgaccttggggtaaatgtaacatggagcaagagtctgaggctttctgttctcaagttcaggtgaacttgaagttgctctcacagattagatagatcacaataaaatacaccagcatatggcatttccaggtgaaggaggacttttgtgtcctttcttagacatggccatgtgggaaagtttgcatgtctggcaaccccaggtgccgggaggaatatggagcaactaggactctcccaaccttgctagtgggactgtaaagtggcatagccacttgggagaattgttttgcaatatctgtaagaatcaatgtggcatataccctacaatccagccgttctgctcttagaggactgttggcatgtgttccaggagacatgtatgagcagcattgtttattaaagcaaaaatgctggaagcgacccagtgtccactgacaggagagcagataaataaagctgggattatggaatctacggaatttctcagcattgaaaacgaaatcactgatacaccccagcatgcctgagtgtcaggcctgctattgagtaaaaaacaagagcgtgagaatctttacaatatgccatcacttaggtaacgttcacaaacttataagttaaactgtatatgtcgatataaactatcctgaaaagtaagggatgataagtctgaaagtcagagtcgggctgcctgtagggaagagatgtggctgtagaggagcacatggcagcaccagtggaatccatccgcttctcgagctgcaccatccagtgtgccagtcaccagccccaggggctgtttacacagttaactcacagttcagtgcctcagccacagcagccacaatcaggcctcagtagccactagtgcctgtcgtgttagacagttcaggtaccggccgcctccatcgctgcagaaggttctgtttgctaggccagatggtgggtgcctggatttgattcattctctataacttgtacatatatatatttgtatgaaatctttaaattttttgttttaacttcaattctagaaaattactaaagagacgcatatacaaattctacagtgtaacttcctaagtgtgaaaagcaggggaatagcaagagagcagttggtggcactgcctgcgacgcagcagtcatgtgggaacactcccttcacgtcgccctccatcccagatgattgacgtgcatgagaaaggggcagggagagtgcatctgtctgtctgtctgtctgtctgcctgcctgtctggagccgttggcgagattgccctaacagcagtgttcatgtgagggcacctgtcgtttcctccccaccctgctatcgcaaagcattatagtacctcctcagcactcaaaggcatagtgtgaatgaccttgagaatcacctgaagcctgtgctgctaacccaaggtttcaagaaggatgtgacaaacatactgtcctagttagtgctgtcctcgatttccagcgttgagaaggttggttgtcatttgaaagaatctcttctctctgcctgatttatggcttcttgtgctagagctggctgtgctgaggtggataccctgaggagggagatttattggtaggcattgcactgtctttaggtgctgacatgttttcccagccttgcccaaggcagacaagaattgtgagtgcaataataaacctcttgagttccatcaacagctcataggcagaagtgcccttagttggtccctgcccttgcatgaacctgagagggttttttggtgatcgacctctacacctcacttgtctaccccagttccgccgtggtcatgacggcgcagttgtgaatcttgccagctcctcagccccatgcctgcctgaacagcaactcagggcagtagacagtggagaaagcggaagttggctcacccagcctgaagatctttgagcaccagagaacccacgcatcctgcccagacttccccatttgtgtctgctttccctgcttcagtcctactcaacaggatacaagtcacatggattaggaaactgctctgacagcccatctgacttgggaacctgcctggtgagggaagaggctgtgtcttttagggacactgtggggctgccatcagaagacatggagtagggacagcaataggatccgtatgcagggaggcaggttaaaccaaagagggaaatagactaataggctaaaagccagattgagacttctggttcagtgccaaaggaagagaagagtgggcatttataaggtctcatttacttagaatagtgagttaaatgttcagtgttgcagaataactggatgaagatctggaagcagctgggaaataagaattcggtatcgatcgaccttgctatgcatccaagctccttgtgttgagcgggtgccgtgtgccaggcattttgtgaaataccttattgtattatccacagtaaatatctcatttaatctacatcacatcagccatctcaagaaatataatgttatctcactcattttccagacaaaataagggaaagatttagagagatgatatctaagtatttgaatgcaaacattctgactccagtgcacaccccccttttagaaaattttttggccgggcgcggtggctcacacctgtaatctcagcactttgggaggccaaggcaggtggatcacgaggtcaggagatcgagaccatcctggctaacacggtgacaccccgtctctactaaaaatacaaaaaaattagccaggcgtggtggcagtcgcccaggctggagtgcagtggcgcaatcttgcactgcatgctctgcctcctggattcacgccattctcctgcctcagcctcccgagtagctgggactataggcatgtaccaccaggcctggctaacagtgcacaccctcttaagcatcacatgaaggattagactgttcacatccatgttgaagtataaagaaggaagtataaactgtaaatgggatccaccctgcttgggtgaagagagagaagaggcaggacagaggggagcgggagaagtcacaccatcccagttcatttgaatgcgagggatgactgctgacatatgagggctggtgttgagagcctcctgaccctgttgagctgttccaggtgagctagccaggtgcagcagcttcctgttgacttgtgtccccatctggggactaagaagggctttctgcagctctggccatcacacagctgtgaagctgtttggtttgaccacatgtgaatgcgggtcaggccctggcttttctctttggtccagagcgcagtgggtgcctaggtaatttgcaaagggcaggtagtttatctgatcctgcctggccacctggaaggtctttagcaagggaactgaactttggccttgttaagtcacgtgcagcaatagtagacagagtgagagccatgtagtgcaaggtgccgtgctatttatttggagggttgttttgtttggttttctggtttgttttgttgtactaaattgctggaaaaacttgacagagggagtgctttttatttttaaaactacaggtatttatttttccattgcgtaggacagtgttttgttgcttaattttcagccaatttcaagtatttctgctgttactaaaagaagcagtcttcttcctgggatatttttgttgttggttggtttcttcatttgttgaatatatgtttactgattatcttctatgggccaactgccatgtcagcactgggaaaacaggcatgaacaagacaggtacagtcctcagggaacttgtcccccaagcctttatttttttgagacagggtctcgctctgttgcccaggctggagcgcagtgctcactgtagcctctaactcctgggctcaagcagtcctcccacctcagcctcctgagtagctgggactacaggtctgtaccaccatgcccagctaatattttgtaggtagagacaaagtctcactctgttgcctaggctccaactcctgggctcaagtgatcctcccgccccagcctcccaaagtgctggaattacaggcatgaaccactgcgcccagccatacttgcattcttgtgaggagacaggtttaaataaatcgattaataagatgttttcagacactggaactggttgtaataatgctgagatgaaggaagactgccagtgggcttttttaaaaaaatagctttattgatatataattcacatatcatacaattcattcaaaaagggtacagttcttttttttttctagtaattcactgggctatacaaccatcaccatattctaattttagaatacttttgtacaccaggagaaaaaactccatactgattatagcagcccctctccatctctgccccgtccagtcttaggcaaccaccaatctactttctgtctctatggatttgcctattctggacatttcaaatgaatggaatcatacaatatatggtcttctgtggctggctgctttagcttaaataatgttttcaaggttcaactgtgttgtagctgatccgtacttaatttatttttattgccaaataatattccattgtatggatataatacattttatttagtcattcacaaacatggacatttgagtttttcccacctttggctattatgaataatgttgctgtgaactttcctttgacttacctgtacaagtctcatggatttaggctttcatttctcttgcaaatctgcccaggagtggaatttctgggtcacatgtcaactctgtgatcttgtgagaaactgcccgacattttccaaagcagagaaaccatgttacattcctaccagcaatgtgtagggcgttcagtttctccagtcctcaccaacacttggtactgccttttttattagacctagtgtgcgtgaagcgttacatttccttaatggctaattatgttgaccgtctttccatgtgcttattgccaatttgtgtatcttctttggagaatgtctgctcagactctttgcccattttacattgggttacatgccttttattctagagctgtaagaattttgtaatgttttctgtatacaagtcccttatcaggtatagctgaccctccatatccgtgggttctgcagcctctgctgattcagtcatggtcagaaatatacagggaaaaacaataaaaataacagtgtaataatgcagattttaaaataaagtataactatttacataacatttacattgtatttggtatcgtaagtaacctatagatgatttgaagcatgtggaggatgtgtgtcatacacaaatattccactgttttatataagggacttgagcatcgtggattttgatccccgcagaggatcctggaaccaagcccctgaggatgctaagggatggctgcatatgatttttaaatagagtcatgctctgcataacgacatttcagttagtgacagaccacattataacatatgtagggcagaccacattataatcttatggtcccataagataatcataaagctgaaaaattcctgtcgcctcgcctgatgtagccatcattacatccagcgcaatgcattactcacctgtttgtggtgatgctggtgtaaatatatagcacatatggttatgtacagtacgtagtacttgataataaatgactatgttactggtttatggatttactctactttttatcattatttgagagtatgcttctgcttactaaaaacaaaaaagttaactgtaaaacagcctcaggcagatccttcaggaggtgttataaaagaaggcattgttatcataggagatgacagcttcttgcattttattactctgaagaccttccagtgggacaagatggggaggtggaagatggtgatactgatgatcctgcccccgtagacctaggctgattaatgtgtgtctgtctttgtctttaatgaaaagttttaaaagtgaaaaaaaaataataattttttaaatagaaaaaagcttaaagaataaggatataaagaaagaaaatatttttgcccacctgggcaacatagtgagacctcatcgctacaaaaagtttaaaactgagccagacattgtagcacttgcctatagtcctagccactcgagaggctgaggcaggaagatgtctgagcccaggaattccaggctgtggtgagctgtgatcacaccactgcactctagtcttagcaaaagagtgagaccctgtctcaaaaaaacaaaagaataaaaatgttttttttaaattaaaagtttataaagtaaaaaagttacagtaagctaaggttaacttactgaagaaagaatattttaaaaataaatttagtgaaggttaaatgtgccatggttataaagtttaccctggtgtacaggagtgtcctagaccttcacatttactccctgatttactcagagcaacttctaggcctgcagcctccattcgtgatagtgcctttcacaggtggaatttttaatcttttataccatttaccgtacttttctacatttagatatggttggatacacaaataccattgtattacagttgcctgcagtactcagtacagtaccgtactgtacaggtgtgtagcctcagagcaatgagctattccatatagcctaggtgtgtagtaggctatcccatctaggttcatttgagtatactctatgacatttgcacaacgaagttgcctaatgatgcattactcagaacttattcctgtccttgagcaacacatgactgtattttctttcatcctgtgggtttgttcactttcttagtagtagtatttgtagtgcaaaagttgttagttttgatgaagtccaattttctatttttttattttgttacttgtgcttttggttttgtatctaagaaaacatggtcaaattcaaggtcacaaaaactgtttttttctgagaggtttacagttgtaactcttacatttaggtctgatccagttcaatgtcagataggagtggtgagaacagatgtcctagtcttaattcctgatctttggggcaagtctttcagtctttcaccagggcccagaggattttgaacaccttacttctgattcagtcaccgctgccaactccagagccttgcacatgtcacttgttgcagtttcttaaagaatgaagaggttgatgcgaaagggccttcctttccagttctcacatcctacacatctgtgatttgactgggtgttctttcttctcagccagttcccttggatgttagttagatcatcacacaaactctgtaaggacacttgggaatatttgcaagttctttttccatatttatttggactgcctttgatttccacaattccttgatgaaaattgcaaaaattgaagcatgtaagcagaaatgttttgtaatggatccatacgtcctttcccttgaaactctcaacagccaagaaaaaagatgggtttggggacattgctcatttccacaaaaggtcaatgaaccatcgcttcttcccactcccatctaacagtcagtaccctctttgttttcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagtaagctgactctggatgtttctcctggcctcacctgcttccagcaatatgagtttgtgcgatttgtatgttccctccctggggattgagctttcagtgcatcatacctacttcgtagcattccatgggcgggacctttggtgtccttgtaaaataagaaccattaggatggtgagtgtttgccacgttagccaagctcagttggctaagacagttctccttttccagctgtgtcatcctctgggcatttaaaacagctcagcacatcatgtccacaccccaggctgctgcctccctgccctgcagttccctacgttgccttggcgcacactcaaacacagggaactctgtgatgtccagaacatccatcatttggctttagggcctgtgctctgaaacatgcaaaccccttgagacacagccaaagatgtcctcaagagttagtggcctcagcagggccagtcaagccagatatgttgaaacagctattgactttcatcaacccctcccttcggcctcaaacagccatttcaaactctgtaggaatccaggtttcctctcttccaggaggcaacagacagatttctaccagagggctaccctctccccttggatctggagcagcaggcagtagaatttatgtccaccagtgctgtggcttccaggtctcaaaggcagaaggtcagtgtaacattaagaacaattgggtttgccttgccttctactgcagaatcctggtccatggttttggggatggaaaaaactctattgcactattattatgttcaactgggtggtgaccgtgggctgaattgttcaggaaagagtccaggggaccttggataaaagtgagagtttatgcaaggtcccatgatctttggagagagctttgtggcaaaagcttagggattctttctggggttggtttgggtgtgctgcttgggtccaacgggttccaggggatgtgggcgagtctcatctctcaagaccagctgttccttgaattgctaagatgatctgaatagtttagaagggaaaaggcttctgaagcctccgagtgctttcttacccatctcacaaggctggtggagtgcagtgagaccgccgcataaccaagtgctctcagagccccagacacctgtgtccctaacatttatggagccttttcttggtccagtgctgagtgctttacatgtgtcctcttacttgtcttcatagcaaccctgatgtgtgaaaagttattttgccaaaaaggaaactggatctatagaaatattaagcatttagccaaagtcgcacagcaaaaaggtggcaaagtcaagatttgaatgcaggctgtctgacgtcagagtctgaattgtcgagatgctacgtttcctctttatgaaagacagaatttttaatatctcgtgaatttaaatattaatcctgactcattacataaaaataaaactaggctgggcacagtggttcacgcctataatcccagcactttgggaggctgaggcaggcggatcacctgaggtcacgagttcaagaccagcctggccaacatgacaaaactccgtctctactaaaaatacaaaaaaaaaaaaaaaaaaaaaaaaatttagccaggcatagtggcaggcgcctgtaatcccagctgcttgggaggctgaggcaggagaatcacttgaacccgggcggcagaggttgcagtgagccgagatcacaccactgcactccagcctaggtaacagagtgagactctgtctccaaaaaataaataaataaaactaaacttagcaatgtaaaataaaataaaccttgtagacagatattcttaatcctttagtgattatccaaagtataatttctatgtagcagaactactgtcacagccatccatttaatgccgctggtaaacactagcctgttatttaaatacataattcttgaattttgcagttcatctatttttgggttttatgttgaccagcagaatatcttaaaattttagttaaaagtggaggaaaataaaggttttaaatctaaaagtcttttgttgaaaagtggtttttcctgccccctcttttaacgaaaggtgactgacaagcaagagggaaacagtcagtgtttgccagattgatctaaattccagattgaagaagagtaatacagtagatttggtctgtgccacagttattttttattgcaatctgtttagtaacctcttgtagccgaatgtagtattaactacaagtagagtgtaattgtcatccaacactagtccaggcagtcagagtaaaatgattcacttactaacaacgttatcctgctagtgaattctgatatgaaactgttcggccactcaattcctgggatttcccccctttttgttgtttttgttgtttttttgtttgtttgtttgttttgagataagagtctcactctgtcgcccaggctggagtgcagtggagcaatctcagctcactgcaatctccgcctcccaggctcaagcaattctcccgcctcagccacccgagtagctgggactacaggcgtcctctaccacgcctggctaatttttgtattttttagtagagatggggttttgccatgttggccaggctggtctcaaactcctgacctcaagtgatctgcccgcctcatcctctcaaagtgctgggattacaggcatgagccaccgcacccagctgggattttcccctttattcatttttccaagagaggtcacagagaaaaattcagtgctaaagtaccgctcatttagtggggtgcctgtaaaccccaggggccatttggcaatgtctggagacatttttggttgttgccataggaaggcaaagcagatgttattggcttctagtgggtaggggttgggaagctgctaaacatcctacaatacacaggacagccccccacacaacaaagaattctctgccccaaaatgtcagtagtgccaaggctgagaaacctgttctgtagcagggagctgtaggtgtgatcttcacccaagaaggaatgttacccctttttcatcattgctcattaggaagggttggatgtctgtgttctgtcccaagccacctgcgtgggacaagtaaatgcgaacctcttgcttcgtggaggcccatggacagaaccagaagcattgagaaacttcccagagtacgtggacttagaggattatgtccaagaaaccttgcagtgggtctgtcatctgctgccctcgttgattattcattagctctcttaccacttagggagtgattacgtacattcttattttacttcaggtcatatgcatggctttccctgctcagatacgagggaaatggaagtgcagggagatgaaagtacagattcagattcgctgccacttcccgagggctccttctcgccccagccctgtcctgggtggtttcagacatgctgtcttatttactcctcaccataattgtgtggggaagcttttattattcccactgtgcagacagtgttggccctggtgcacattttcttgatcaaaatctgtttttctcactatattctgttgtcttcccagactgattccacattagcagtctcttgcatcttcttagtgaatttaaaaattcaaagtacattgtgatgaacttctaaacttttttgcaaccttttaacaagtctagcagtgagctgcagagtgttgaagttgtagaggaaatttagccatatactgggtgtccaaaggtataattacaatgagcagtgagcagggggtcctgggaggtgttaatgccccatctctgagggcatttggacagagattggatccgagtgctcttgggtggattcctgaaagcctttccccttcagctcttccagggagatgctgctgccggacagcctggtggcaggtggtgatttggtgctctcattgtaaccaatgtctgtgttcgacatgtcttcttgctaggcctcactgttctggactaataggaataatgttgcattgccattttttttttaatcctgcaattctagttttttattatactgattgtgacttgccctccccctcactccctggctttacccacattttcagggtacactgtcctatagtgtggaaatgaggcttatgttgctgtggagaggggaggcacccaggctgcagatgggacaaggagtgacagagcaagtcgggtgtcccggctgcggcacggctgtggggagagaactgtctggagaggagggccagttttcctcaccctcttccccgccatctcctgtggcagcacatggctgtggagccacagcctgggcgtcagaaatgaatatggcccacggggcaggaaaggcgatgggggttttatgtccatctctgccatcggggtcttagtttactcgtttgttaaatgagatctttttgaccaggggatctcaagtaaactttttaacttcagcacatttctgatctggtctttattctcctctctatctctccaggctctgaactcagacagaccaagttcaaattccatatctgtcactacagctgtgtggccttaggcaagttgcttaacctcccccacgtcccactaagcctcagtttccccacctgtgaaataatagtatccacttcacagggtggttgtaacctttaaacaaaatagcctatataaaatccatagcacagtgggtgcctccatgtccccgatgagtggtagctacgatctggcctctttcttccctttcagatgttcccatcctaggccctctttctctgctttattactggcaggtatatggtctctggtgttggtatagtgcctgttaaatgttgtgaaccacttcatatgctttctcattcagtcccccacagtcacctctttagttacacggggcagatgttattctccccattttgtgggtgacaagcccaaagcccagcagttggctttgtctctaagccatccccagacacggacagcctcatttagtttccaggcttatgtggaccaatgatggcaatccatcccccacagcaggaggggtgcgcaggtgaacgcacctgccctcgggttatgcagcgaggcagcttcagcaaagccaaggcatggagtccccagtccgagccagtgctggatgtggctgtgtggctgtgaactctcactgctggctgcattcacaaggatccccagcttgacagctgaaaggctggagaatgcacaacacccagaggccattaattctgggagtagaatctgagttcacggaggcagcctggctgtgctacattgttggctcctttaggaggagcccaggacagcctgactcttaaacagctgatttgatctctctgcaatgacagaaaaactctctgctctgaagtgccttgccactttcgagtgcctcccatcttcagattagccactttctccctgtgtgacctgatgacacattttcttaaaatgtttcctgttcctcagcaagtttcatcattgctggtctctaacactttctgatgtgctaaggtggcagtgttactgtcatagtcctcttcttgcctggttgaccatggctttaggcacatctgaggtctgtcggcactgcgactccttcacactcaggttcctccctgccccgggcagatgacatgaagcagagagctcttgtccacgaggtggaaaagtaagcgcccagcctcttggaaacagaccgtaaacaaatctgtcaggtagtgaaaagagaaaaataaagccagggtgcaggacccagggatggggatgaggaagggcacttcccccaccatgggagaattgtgtcttctagtctgcaggacaccttgtgggaaagactcaatgaaagaaatgactgggtcttttgtgcattgtctgactaaagtagccatttatatatttttcttttgacattcccatgaaataaaagcctctactattgaacatttttatatttaaaatgatattctgcacctttttttaaactttatttttttaattgagacggtgtgtcactatgttgcccaggctggtcctgactcctgggctgaagtgatctgcccaccttggcctcccaaagtgctgggattataggtgtgagccacttcacctggccaatcggcactattttagaagaaaagagctagtattcagaatcataagcactttttattaatttctaccatttgtttgtctgtatattgtttaaatcacctttttctagaaattatcttcttgccctcagtttttatttatatcctctagacctctgagatcctgcaggtggctgtttgcctcatacacacccctcttaatttgcactagacatgtaatcgactacttgagtacactgtccattttgggatttatccattctgtagactactctttttttttttttttttaaaggacagcctcccaaaccagaacaggttcagagactccacttctgtagattactcttagcctccttttcctgccagccagctgagacctggatcattgacatcagggcaagtagaggggaagttggagagaagaacaaaaggggtgtgtagacccaccaactggatccaaggcctcccacggtcagggagaaaagcttggggttgtggcttaaacactggaaagcgcagggctctgtattttccctttctctcaggtgggcttctctcaggagcagagggaccatgaatgctgctagcgcccactgcatgagtcgtgattgaatcttgagaatcacggtcatctgctctggcttctctgccttttctccccagatttcctgccccttctagccctgggagcttccaggcccttgaggaatagcatatcatttccttgagtgggggcttcagtggggtgaacaatctgggaacctagtgaggagtcctgagggaatgggtttcagcccctcatgccctggaccagtcttacacagtctttcagatctttgaaacaaaagcctggagcttcttgatgtgatttacaggatacagatgtaccatgggccttgactggtgcttctccaagtcatcagcaaattagtcctcactctagttaacagggttagtggtggtctgtcagtgtggctgatgaggacagacaggaggataagtggttttcaagacctcagggtctggaaagggaattcagaaatttctgaatgagctatcttggtccaagcccccttcttccttcagctctaccctctgtctcctgattacaatccttagaaaaatgatctggcttggtttctgtagcaagagcctttccattcctatcgatctcaagctggtttaaagaaaatgttcctttattttttcaaaatagctccctttaatctctctcctcctccttatgcctaacgtctcctttcagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacaggtgagtggctctgaagtctttggctgtgtcagaacaatggaagccttagaagcatcttggtttggtggcactggaaactcaaggttcctaggaacagtcaggaaaaggactccatcacccctcatccttcccctgaccactccccccacaactatcccgtgatgccatctcagagttgaggtcactattactcctgaagcccgggacacatctctgccatccctagggatgtggccacagtgtaagtttgtggtcattgcagaacttaactgcgtcaagccaggacgcctcccggacatggagcctggattcactgcgggtgggaggagcctgttttgaatgaaactttttgagtttcattatctgtcaggtggaagctactgtttccactcatcgccagaggcccagactgaagagcaccagcagggcctccatctgcatgagtctcttcacagacttcactgccaggggctggattgcaggctcacaagctaagagttttttagtaccttagaccttgggggttacacagcagcctggaggctgcacagggaggcgaagaagcacaagctgggagagagagaagggaccctatggaccagcgccgcttttggggttattgggtccagggcgggccttatccaaacaggcctcctgcagggagctttaattggtgggtttaaagcaagcaggcacgtgttcaggaggcgcagcctttgactaagaggtggttgctttaagttctcaggcaaatggtctgtttaaaggatcagtaggtaagccaggagctagcctgctggcgggcaaagatgcctgtaagtttctgtctctggccaccagctagagccagtcgggtagggtgtagtattaggaaccttgtcaagggttcgtgagccctgcttctggtatgagaaagctaaacatattttaaaacagatgccgaggcaacataaaattacaagcactcgctgcaggggacatggagccggcctttgccccaagaagcttttgttgggtaatacttttattgctggagtacattttcctcttaaaggttagctagcagcttgtcctgtatttattgttaaatgtaaaaagaaaagcactaccaaatgtaatctgaaatgaaagcctagcaggagctttttcttaagaggctggcacatgttttgtttttcttccatggtacctgttcaggataaatgcttctctgtcgcaattccgcaagatgacttagtgttcatttagccccatgaggctaagcttttatgaactgctttcagaacttggcaatgaagttcatagttttcttcttctgggggataaagcaaatagtgtctttatttacaagaaactctctgccctggggcttcctccctggagtttcagctgacgcgtggagactgtggtcttttggccagaagctcgctggcgctggttggtgacgggaaggaggcagggcatgcttgtcttcactgtctttcccagagtcagtccagctccggctcttagaagtgttcggtgctgggctcctaggagcgcatgtgctgacgtcatgccacagcgagatgtatggattccctcttagaacatgtttttgtggacctagtctcatgtggtagtctctgccttggaatagttaaagcctagttgaaacaaatcagctccctctgttctacgataaagcacttattttacggtacagggaggaagctgtgttggagtttgaagaagggagagttacaggggtgttggagttgatctgatgaagcctcttgactgagtagttcctggagcccgacctgagggaaagcagcagttggattggcagtgggggcaggagaacaagagcaaaggaactgaggccactgggcctggtgtatcccggggaggggagggcggcgactcgggcagtcatgggcagagggtatatgtcctagagcatggacgagaggggaacagtgggaagaggcgactgatcaccctgcaccctcaggcgctaagcctctttgggagagtccaggatagcgtcccctggaccctcacacccagagtgtattgctgctaggagtgttgcttcccagagccaggctctgcttggaggtcacttgcaaaccctgggtaagaactgatgaagtcacatggtaatggctgggggtattttttgtctattgaggggtggctcttaattgacattgaatgtctataaccatttcctagaggagaaaatgggaagtgcctgggtgtggctgtaaggacccatgaaatatggtttgttttctggtagtcctttgactaatcccattgaaggggttttccttctgaaattcttccaggctagtggaggtggttttcttggtctcccacagtgattggaaatacctcctcagatgctccttttagatgctttgcattatctctttcctccctaagtgcagtttgcgagctggaaggtcctttctcgtttcttccgtggggcagggagtggggggtccttgcaaacaggccctttgccgccctcacctcggttcctgagacagtgataggctggcctccaacaagcagctggctcttagcatgagctttgaatggaggattcccgagtgaggcacgcagaggcccatgtgagagcgagagtcacactcgtcacatgcggagggctttgctccattgtggaactgagccagcagctgggcctcagatggcattttttatagtcctcaactttccttcctttcttatgtcttagccccttgacacaggaatattctgcttccaagctaatgacgggaaggctggacataattccagcaccttccgggaaacgttagcatccaatgcaggtagaaaggaagtagtgaataaaagtgtttcccctctttcacctcactgttaccagcagtgtgacagtgagatgctttctccggtggaatcctcctacagcacatcaggggaaggcagcaggcttctttcaagatgcctcacctggccttgccaggaagcagagcgaggtccagcccagccgttagaagcacattcccctgcaggatcagatcagctctggtccaacccccggagagactgcagggtctttgttttcccctctccgtcctctttcctaagagagtagttccaacaacaaatacttttcatccatataatcttctaaaatacccaatcctggctttctcagggctcctttaggaattttgtttgtttgtttctaatggacttgaaaagtttgctttcattcctgccgacccttttctcctgttggaacatgcagagtggaacgcctggctaaatggaaactttagatccttgcaaaaattgtttcctccttgactgattctgaagagcttctcattaaagcactatttggttcacatttttgttctaaatagctttgtttttagaacctgttttaatcatatcttacaatattatatattttcctcaaagttatatctttggctcctaaatctgcatcattttggggtgtttttttgttttttgtgtgtttttttggagtagaggaggttgcagcacataaattttctatattgttgctcttcctctgtgataattgtttgaaatggaaaaataatcctttccacaattcctagggaaaattatctttagttatttaaaaatacgtgaaagatgtaaaaattctccattcggctgctactctacaatcattgaggcactcagggcttctgtttgtgggcgctggcatcacagtgtagctggtagcgtggtctctctctcacacacacacacacacacacacacacactcacctgcgttcccatcctcacatccccaccaccatcacaggccccgtcacccctgatttgctattctcaaaatagtcttcattcgtgcgctcctgacgtctgtctcatcgttatagtgcagaagatgatgaagctggccccgtgacggaggaattctaataaactgcagacctgttttgagctcatgactgttaaaattccgcaaacctgtcggctccttgtggcacatctaaaatagatttgattctaattgctaacaatcagtatacactgcttggacctggtctagtgattagcagctagaaggaggggaagatggggcactccttgagagatgtgatcagaatcttgtagaaggatgtgaagtttgaaaaagcatcttaactatcgtggtggaatttttgtaatgttacatttgggaaatgaaaaaaattttgaaacacagattagaatataaagctccacaaaatctttgttggatgtatggaaaaagtctcatgggagaagtttgcttattaaaaggcagtatggattttgcacaaagaaagttggagaaacacacccttgtcaccgagaagctggctctgtgctaagtgatggtcatgctttagattttctttttttccattcttctcttccctgtagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggtaccggtgcaggttccagacagtcccagtcagggacttagagcagcctgcctgctggtgcttgtcacataagagcttgctcctgaccttcaaacattagaatgtctttctgcgtctctggtgttggtgcgctctatcccataactacttacttctctcaggactggtgcgaatggctcttagggaaaagctgtctagagcagtcagcccttactgagcactgcattaaatcttagtgagtcttcgtagcatcgtgctggctgagcatgcttgccagctagacaaaatgcaatggagatcgttttcacaatgactttaagcaaagctcccagcatgtcatatcagcactaccttttcatgttctgggagcttctaggattcttggtagaaaagcaggagtgagatgagtaagaaatggaactttctgtatttacttgatatccatgatgtggtctgtgtatttgctatccagagaagtcagaaacagcataagaaattgtgaatcctagttaagatgggaagcaaaggccatagaaggtctggaattggggtcagggggacaaatcctaatagagaaaataagtcctagcggatgggaagcaagacagaatgttggacatgaaccaggtaagggcctttgggtcagggccagggctgcaggcagcaggacagtggaaaccccgctgttgtgtgaggccatataatgtagtagaaaggggccagccttagcacctggctagatttgaatcccaagttcaccacttcgtagtctatgaacttgaacagtttactcaactgctctgcaccttaagtaactcttttatgaaataggtataataatagcatcgtgcatctcagggttatagggaagattacactagtcaatacacataatgcttctagaacagcacctggcacatacggagcagtcaggccttagctgctatttattattaattatgtggtgctagatgcatgctttgtaaacagatctcttggcttgaaaaacctgtgtccctctcctttctggacccctcaatccaaaattatagctgaggtgtttaccccaggtcaaaaaaaattccttcccactcaacgaggctaacaaattcctgaaaactgcctccttggcttaacattccccagcagctctggagagtagaataaggacccccaaaggacttaaattatagagagaggctgagaaagcattgctcagcattgcaaattgctccagaatgaaatatgtgtttgccaggacatctgggtggccctccaaccccagcagcatttaaggggaggctgacgtgtctgctggggccatagagttcatgtaaaaggggcttgcctagatgacatcaatattttcctctgaattctcccatgttctccttttttttttttttctctgagacggaatgtcactctgtcacccaggctggagtgcagtggtgcgatctcggctcaccgcaacctctgcctcctgggttcaagtgattttcctgcctcagcctcccgagatgctgggattacaggtgtgagccaccacacccagctaattttatatttttagtagagatggggtttcaccatgttggccaggctggtctcgaactcctgacctcaggtgatctgcccgcctcgacctcccaaaatgttgggattacaggtgtgagccactgcgcccagcctccccatgttcccttcattccaaaaagttactagtatctgcttagggcagcgagactcaaggatgtagcccagggtggctgttgtgatcagagctgatggccctttccaggatttggaggacaggcacgtacattatcatatctggtcctcacagtagcacactgggttcagcagagcagagtggaacgtggcctggggctttatcagcagccctgagtcactctggcccacccacccctgctgttcctgtctaggcttctgaaaatgctattattgaaaattgttattcttcaggtaacattgttaaggtttccttctatcgaattgattctgatgagatgttcacaagttagagcagccaaaacagaggagaatgagtttccactcataaagctctgtggcagtcccaagtacatttcctctatggagtcattacagcaccacttcattagtagaaaggcatgtctgaaagaaaaatttccttgatttttcaaagtgactggggaaaaaaaaaggagagagaaacctataggttatgaacttgtcaatgtcagagcaaataacttttccacaattgctttaaaaatattttagccagaacaaagattctctaggtgagaagctttacaaattcagttttgtttcatttattcaagaagcatttagtgagaaccttctatatgccaggcaatgagagataataggaaatatgagcaaagctggcacagaccctgccctatggcacttacagtctaaggggggcaggaccgtaaacacaaaggcacacccatgtggtatagcgctgccaaggaagatggcacagggtgtgatgaaagggtatgatgaccttcctttctcagggtggtcagagacgcttccccaaggaagagacaggccagcatctggaggatggacaggagctgcctgtggctgggagcttttcgtgctggagtcattacagacagtgagagtgatcgagacactgtgacgctggcatttgttgttattgtctaatagtaataacagctaacatttatggggtgctttttgtacactgtcctcacttaatactcatgacaaccctccataataggcataaatggctgccccttgcccctttcacaggtgtggagactcaggctcaggtggagcagtagtcagtggcaaggctgtgattcccacccccaacctgctgccccctccccggctcctgtgcaccatgacaccctgagctgctgcctcccatgggaggacaggattctctgcactcccacctccaagctagctggcttccagcctctctcaccgtccctttcaggcctgggacaccttaaaagcccatgccctggtggcgtgagagagcctcccccagctgggagggactggagctgtgcagaagggaaatgcactcatgaggatgttgtcagcccacttggaggaggggcgttggacgttcttacactgactcaccgttgtttacgtaacccattcagttgttcaagggagtctttcctctttttttttttttcaaatgattgaacatgggttgtaaaacaggattactttggttttgtccctgaatgcgtggtagcatttatcatttaaacctccacataaatgccacttgttcaagctgtataaccttgggcaagttacttccctgagtttcaagtaggttttaaaatatttaccctgaagatttgaggaaattcagtaagataaagtatataaagtacctggtaagaactaggtgaccaggaggcagtggggaaacagtgttacctggagaagtgttcatttctaacggctcacagtgaccatttttgacagtgattatggctcttttccaggtagtcttatcatctcaggtaaaagatagacccctgtcccctcatctggctctggggctgcttttccaccgggagcctgtagctcagagctgattatgactcttgaaggaaggaaatctgaggaatttaaagaccctcaatgtttttctctgagaaccacacccagcctagcacctggatgctggggggccgagccactcgaggccaaagagatatcccagcatgaccttttgaaatcggtaccccacctcttcccaacttcaccaggtaatttactgtgttacttgagcaccagagctgtattttgacttgtcaactgttatttaagcccttccttctctgtgatcattttcttttttttttttttttttttttttttgagacggagtctcactcttgttgcccaggctggagtgcaatggcatgatctgggctcactgcaacctccgcctcctgggttcaagtgattctcctgcctcagcctcccaagtagctgggattacaggcacgtacaaccatgcccagctaatttttgtatctttagtagagacaaggtttcaccatgttggccaggctggtcttgaactcctgacctccagtgatccgcccacctaggcctcccaaagtgctgggatgacaggcgtgaaccaccgcgcccgacctatgatcattttcagtatgaataaaatgaacatggaaataaagtattacatatttggagagctacttttccaaataccgtttttgacttttgaaaactgattttcagtgaccagtcggcagtttccagtcactgctgtagacatagactctagagtagtctcttcttctttttgttctgagacagtctcactctatcgcccaggctggagtgcaacaacggcacaatcttgctcactgcaacctccgccttctggattcaagcaatcctccagcctcagcctccggagtagctgggaccacaggtgcatgccaccacgtccaactaatttttgtagaggcagatttttaccatgttgcccaggctggttttgaactcctgggctcaagtgattcacttgcctcggcctcacaaagtgctaggattacaggcatgagcaaccacgtctggcctttttcagtcttttctaactcgtgcctcaggacaattaaaaagtctgacatccctctcaaaaaattctaccttcagtaggaggtgttgggctcatgccaaattataaatggtcaactttcaatgagattagggtgttagcacagtagccagatatgtgcacattttaaggtttctcctctgtgatagttaaggcaagtcaagactaaagaccttctgtctaggcagggagataggtggtaaatttaaaaagcagcccgccccttttatagtcttttcaagcctaggccacgcgagctagtgtagggagcgtcattgggatcatgacgtcatctttgaatttgggcacatgtctgcacatgtgtgcctgtcattccaggattgttttgccattgttcattagttgagttcacagctgcctctccagaaagatgacgatctaattataattgctcatgaatcaatgaagaaccaggaatgttttcctgtatcaacagatgcaaacaacacagacttctctctgttccttttgccctgcttgtaaagaagagtgaatctgaaagtggggcatccagggcactgtgttctggcgctctttaactccctctaaggccgtgatgctcctctttggggcctggcgttgtgcttttaggaagagctgcttctcccaccgtcctccctcctccaggcggtagggtgcaagggagctgcctcttttctaactgctctcttcactgattgtgtagtctctcctcctccatcttgtcctgtttgtaatcaccagctagatggctgtcccttaaatattaacttctaaattgtgctaacatgcaagtattaaggttctcctttcttgctagtacttggctcttagagattttgcttctccacatttcttcaagaatagacatctgaatggggtaacaactgtcacagagtagggtaacactgaacctgcatctgtggatatgcctggctgagcgtggtggctcacacctgtaatcccagcactttgggaggccaaagtaggaggatcacttgagcccaagagtttgatatatgcatttaattttggagggcggggttgcttgtttaattattatttcagaagtaatatatgttcatttcagaaaatttagaaaatagaaaaagaacaagataaaagggtgtttcatagccatattttttgtattacatatattcttgatttggctttgtttacaaaacgtgcaatataaaccagcatatcacctagaactgtttttccactcagtgtattacagcatctttccacgatacagtgcatattcttgttgtgactttgtctttaataacaacgtaatggtcagcccattgtctggttctatcatgacttatgtaattgatacatattatcaaatatttaattgtgggatgttgaactattcaaaattaccacattaatgatacgtaatcttatgtatattctgtgataaccatcttttgtggtttaatttttgcacacattcatgacatttttcttggacaggattctttttttaagagacagagtcttggccgggcgcggtggctcacgcctgtaatcccagcactttgggaggccgaggcgggcggatcacgaggtcaggagatcgagaccacggtgaaaccctgtctctactaaaaatacaaaaaaaaaaaaaaaaattagccgggtgcagtggcaggtgcctgtagtcccagctactcgggaggctgaggcagaagaatggcatgaacccaggaggcggagcttgcagtgagctgagatcgcaccactgcactccagcctgggcgacagagcgagactctgtctcaaaaaaaaaaaaagagagagtctcaatctctcacctctctcacctgggctggagtgtgattacagttcagtgctcctcgaacccctgggctcaagccgtccttctgcctcagccttccagagtgctaggattataggcatgagccactgcacctggtgcaaaattctcataatgcaaatatttaaggcttttgatatatactgataagtcatccctctggagaggctgtctgaagtggtgctcccacctaccatgtctggaagtttctattttattaccatccaaggtggtgaatgtcttatgattattgaccattggtatctgtaaatttcttgtttgatatttttttcggcgtgttcaccttctagtttttttgttttcgaaagaacccttgcgctggaaaggatggtaactgactctttgccttatttgcagcatacgctgccttttttgtgtgtggtgcttttttgagtctggagaggcttggcagccgctggttcagggtctctggttactgtgttgcccactggcatccgctgccacctcctctgtaacttggaaacagctttctgctgaaagcctggaagcccctcatcacacacatgcaggccctggccaggccagatgtccagcaacaggaaggtggagggagaagctgtggtgcatccacgagtgggaacactgctggcagcgagcagcaggcgcctcgcccacacgaagcacagctgttgacgctgagctcgggggacggagcaggcaaagatgtgcggacaggaaatggattggcagctgccaggggctgggggtcgaggggaatgcggagcttccttatggggtgatgagaagtcctaaaattgattgtgttgatggtcacacaactctgtgaacagactaaaaaccactgaatcgtacactttaaatgggtgaatttaatggcatatgagttatatatccataaagctgtttttaaaaagaaggttgacacaaaagtgtatgtatgatatggttccatttatatcaagttctaggacaggcaaaagtaatctatgataatagaagttaaacagttggggcggggcagattggctggagacggtgatagaaatgttctttgtgtttttagtggcgcttacttgggtatatgcagttgtcaaaactcatcaaactgggaaaaaatgcattctaatttaaaaaaaaaaacacatgggcacttatgtcttcccttttttttcttttgctacgatttgaaaaaggctatttttcttttctgtttttctcagttaatggttctaaagtgatttctttgctgggttatctccccttaactccctctccattgacaaggatcccagccagccctcaccccacccccaccagctagcagctccaccacacctgtggccagctcgccttgggaaaccacccatgccatcatcgtgcatatgatctaatggctttagagaactaggaacagagttattccccaacaaactgactgggaacctgttctgatgagtattttaatttgtgtgataaacaatcattttgagaggctggggtttgccatttccccttccaagaggaagtgcctttacgcatttgaaacttgacatgccatgaaggtatttttggagggcaggggacatttgggaagtcatgcagattacctaaggcaagtgatacttgcgtttatggtgcgtggggaatctgtaggcacagaaatgagactcagcagcagaggacagacagcacctgcctgccttctggtggaaactcagtggtgacgggagctttgctcattgcctttttcttgtgggggtaggagctggtcaggctcaccatcgagaagcagggacgtccgtctccgacgagccccgtgaagcccagttcccctgccagcaagcctgatgggtaggtgctgactaaccctcgtgtcgcgggtgtcacgctcagtggcaaagtctgcacttgacaaggatagggcccggtggggtgggcagcatgagggtgggctgctggaggcccatattcctttttcagtggttagcagtgtgtgtatatttcacacaggcttgaagtattgccctgtctcaagtttacccttcagcatgactgtttccaaggatcttctgtgagcgcgtccagtgacacataccagtgcttttcctgggcagcttcgtttcataatgacaaagaacttttaaaggcttgggtttgggtgctttgacttgagagcactcttgtttgatcaagagtaaactgaggatgacatggatggttgtaaaggtttatattcatctctactccaagctcctggtaaaaatataaaacataaatttggagcttttttttttgtttttgagacagagtctctgttgctcaggctggagtgcagtggtgcgatctgggctcattgcagcctcctcctctcagattagagcaattctcttgcctcagcctttcaagtagttgggactacaggtgcacgccaccatgcccagctaatttttgtatttttagtagagacagggtttcaccatcttggccaagctggtctcaaactcctaacctcaagtgatctgcccgccttgacctcccaaagtgctgggattataggtgtgagccactgcgcccggcctggagcattttagagaacccttagatcattttcagatgaggaaattgaggtgcaaagttgggggcacagccaagctccagtagctcattagcaaccaaaccagaaccccagggttctatatccagggagcctgctcttcagccccacctcacccactgtgttcttcctggtcacgtcctcaccctctcagggcctgtgtgtgctctgtcccgcctttgaccttctgtaaccccaagttcttcccaattctccagcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataataggtaattaccttcctatttgtccagtgcctcccatggcagaatgagaaagaaagggaggaagacagggctcgggccctttcccctcagcgctgagggcttggccccccttgggaggctgactctggagctgtccccaccccgccggccctcgctggccaccctgagctctcctgaaggcctccttgtgccctcagcccagggagacatggtatgatttattatgaaagaaaaagaaagggttgttcttttttgttcatttggtatttacaggttttattttggcggaggggagtaggcaggagttgaagtgtgaacattgggtgtggagagtctagtaatgaaagaaccccacatcctgtaccccaatatcacgctgaagagctttggtgagtgtggtttggtctgcctggacgtttcggtctgtttcagtcctccaccagcattgccacccaagaaaagacagtcggcgccgtcccctacccgagtggctgtggtggcccccatgagccgagccaccagtggctccagtttgcctgttggaatcaataggcaggtaatgcagcccctgttccctgcatgggaaggcagggagggggtggggggctcagggatgtggctcctgaagctgaaagaaacccatggtcttcaggcgctggtgtttgtcacatcgaggagtgcgagaccttgtacccatccctctctctccaggacacggtccaagttcccatatggggataagggtcagggcagggagggcagagccaagggcgtctcctggggataggtgagtccagccccagggccctccctggccacaccccccacaaactccagatggctgcttctcagctgtatgtgtccttcgactactgacgtcagaggtggtttctgagttcgcctggcagtatttccttctctaagtaaatgcaccggttgcctcacccctggtctgtgccaccgtttctcagaagtgatttggctttgtttttctttttccacttgaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactaggtgagccgccaccatcctcctgttccatcgtgtctcggtggcttctctggggccattacagtcctgggtgggagtcccaggtcatgcaatcattgactacgtggctttggctgacttgtttaaaatctgagcctcagcttcctcatctgcaaaatatggataacagtatctgcctcccaaggaagttgagcatgtaaatgaaatcacaatgtaaaaccacagcctagatattcaagcggtgactgttagttcatctgtcagtgagtaatttgactctctttaccaaaattaagagccatttgtgttgagagctttaaacaaaggggtgggggtcctgacaacacttgacagaggctgaaggggagggagccgcgcgagccggccttctcgttagtcagtgctgaatgtgtactgtgcgggcccctccgagtctgctgggcagggggcttagagagcaggaagctgttcgtatcctgtgaactagatattttcacttctgagaatgtatcctaggagcataatcagtgattaatagcaagattttcattggtaggaaatcagatgaattatggtacattcatttgctggaataatctgtagctattaaaaatcactcatattgataactagaaaaagtacaggaccatttacatagtattctcaattgtttctttttttttttttttttttttttttgagacagagcctcactctgtcacccaggctggagtgtagtgacacgatctgggctcactgcaacctccgcctcccgggttcaagtgattctcctgcctcagcctcccaagcagctgggattacaggtgtgtgccaccacgcccggctaatttttttgtctttttaatagagacgggatttcaccatgttgaccaggctggtcttgaactcctgacctcaggtgatctgcccacctcagcctcccaaagtgggccagcgtgcccagccaatttttgtatttttagtagagacggggttttgccacattggccaggctggtattgaactcctggcctcaactgatcggcccgcctcggcctcacagagtgctgggattacaggcgtgagccaccgcgtggccctcagttaggctttttcaaaaaggaattgtataggcaaaaaagtcatttaaggaaatacttcaaaatgtaaatagaaagtacagttagattatggtactgtgggtgatttttattttcttgatgtaatttgccacggtttccgtaatggttgtgtattttttttttaaataagaaatgtaaaaaataaaagtatagcaaacagccatattcccatctggtttgcttttataatcagggagaagaatgaagaatataacatgtgaatataaaataagccctggagacaggtctttgtcacacacccatgagcgagccggcgagaggcgggcggggggagctggctgctcctgcagggcctgtggctaacgggtctctttttcccctgttgtaactgcagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacagtaagcctttgttgcactgttgtcaggaagtgcattttataacctgaaatggcagtatgttttatttcagcattagaccagaatcaaatcagtggcctcattatttcataaaagataggccagccaggtatgtggacacttctgggagccaggttttgtcattacacgtgatcatttttaaagcctcatcagctgacctctcctttacagtttctatacaatctcaggtccggtctccatgtagcctgagggattctcctctttagatggcagcagttgaccttctggcctgatcacagtgacagaggggaacgagtgtcctggcacgcaggacagcattgcagcaacatctgtgtagagcgaggtggatacgtgaatttcagcagaacttgcctagtttccacagagtgattgtctaaggatccctgtctagagcacactgtctctgttcatgctcccagaatgacttggaagctggggttgcccagcaggagtaattcagcacacttcttggaccagacattttaatatatgatgttattggagcccagggttggagctgaagttttgaatattttccaacggtaaatctgtcataaaagtaataaggagagttctcctggaaattcggttttctcctagctcccctaactgctccacacttctgggacttgcctggccccctctgtccccgccctctccctgcttcactagcatagttctgcttcgattttcttggcagcacagctgtcaccgtttcaatgtgtgtggtcacattagccacacagccccaggcttccctggcctcagttgacacatccagcagagaacttctatgacctagaaatggaatctctactccaaattcccaaatgagagcttctgagcccagcttagagctgggccccattctcaaagaagggaagacctggcttggttcagtccagcaaggatcgccctgagggctggctgcgtggtccacagaaggcggcggctgcgatgatgtcatgtatccccagctcctcagtgggtgttgcccagcttgtgtgatggcctcagcagtgtggtcccccagctagagggagagctggctctgtgggactaatgatgtcatccccatctgtcgtgtatatttgctcatcagaaaccagggctcccgcagaggggtgtgcaatggcactgccagaagcatttccttctcttcccctccctctgcatggacaagtgtttaaagagctgttggcctccccctccacccctgttatcttgggctgcgtgccattcaggttcaccccctttccttccctaggggaggggtcctctgagctcagacactgggcaggatggcatccttgcaagctgcagcagatgccagagagccttacccttccagctcctagaacaagtgtgggcggcggtcctcatgcagggtctatagaggggagaaggaaagggaggggtagccattgtttcctttcaaacagtctcaagtggctgaaaatccctattaatttaggccaccattttgaggctttaaccaattcatcactgtctccagcactggagcctgcaaacctctaaaaaactcctgagctacagccatggtgtgccctgagctaaagcttcacatgccctatggaaggtagtcctgacagccacctgcaaggcaggctctattacctccaatttcataggtagagaaactggagctcagaagaactgagtattgcccaagatcaacaagcaagtggggcacagatctgggactgagagcctggcctgagttgtacaagcctgttacacttcctcccaagccgaggaggaagagattcagccctccttccttgagatcccatccagtttacagtattgacccctgtgcaggggttggtcttctccgtaccctgtgaaagagccccaaacttaggcaccctgagcctcatccttgtccccagtctgctgttcactccccgaggggaccctcaggtgaccttgtggaaaatgcctcaaaattgctttgagggaaagaaggaaagaatcatcaccctggccgcgtggctaacgctggcctgagttcatgcacgctcagtcccaatgtcacgacgtgtcctcatcatttgggatgcactgacatcgtgagggtccccagcccctcttgcccggagcagccccatgagtcccttgtgccagacgagccttgtgatcactgtccggcacctgaaatccccacagtcccaggccctgagcactggcggctgaaccttcccagcaatgctggctgtgttaggagcaaggcctctaaaatcagcctctgggctgcttttgaaatggactgggtcctcctcatttctagaaggctgggagcatcactgctgttctgtgcttggctagcaggtgtctacaaggacttcaacatcaagagttcagaaagacctcctgaagagatcacagttttacagaaaagtcaggcagagatggttgtgtttaatctttttcttttttccatagctcactgcaaccttgaactcctgggttcaagggatccccccacctcagcctcttgaatagctgggaccataggcacataccaccattgctaatttttttcttttcttttttctttttagagacgggggtctcactatgttgcccaggctggtgttgaactagcctcaagtgaccctcctccctcagcctcccaaagcactgggattgtaggcatgagccagtgcgcccggtcatatttagtctttttagggagcagtttgtgggtgcttgggatcaccttcctaggcttgcctcttcgtctggagcctggtgacattggttgtgcagcattaaagaggaagtgtggggctgggcttggtggctcacacctgtaatcccagcactttgggaggacgagccaggtggattacctgagttcaggagttcaagaccagccagaccaacatggcaaaaccccatctctactaaaaatacaaaaattagctggacacggtggtgcatgcctataatcccagctactcagtagactgaggcaggaggatcgcttgaacccatgaggtggaggttgcagtgagccgagattgcaccactacactccagcctgggcaacaagagcgaaactctgtctcaaaaaaaaaaaaaggaagtgtgagacaagctcaaggggctgtgagctgccctttcagtagcagcagctgacctcagaggggaaccatttcttcctgtgcatcttttacaaccaagttctgctcggtgcttgttggagctagtaagaaattcttacatattcttttaaataaagaaggtgactttgaacactttccttcagtgacactcctggagagagagcatttcctctatacctggacccccagtgtggctcagggaagaaataaactccctacctctgtgactgtcttcctcagctcagtgtctggccttccttgatttgttgactagttggggtttgcagagaagcctctggctttgtgcttatttgaagatacaaaatttagcactgcagagccaccactttttcttggcatctgaatctcagctccacctggcagctgctcgtggcacttgcgacatgcctcgaggggaaagtgcctgctcaggaggtagctgagacttgccatccctgcacccgccatgtgccctcgcttgagtccccagttcacattagggttccccattggtgttgcgcgtctgccggtctggacgtgtctcctccgttagcgcatcagacagagtgtgatttcattgcccgaaaagtcctccgtgctccgtctgttcgtccctctctgaggtgctttcagtggaaagccccctagctgctgtgggaagaattgggggaggggttccctgatgtggcctcccccggcctcgctgcagctttctcccttgtttcacagtgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggtgagtgacaccttcccttgtgactagaacttccgatcctagcaggtctctaggaaccagaatgaccctccttgggggcagggttaaccctcctccctgctgtggcagggccctggttttgggcgtggaaggcaccatctcccacacagatgcttttacttcctccttagatgctcaccagcagcccagcgcccactccaccacctccccaccctggggtgcagggacctttcttttccacagcagccccgcgcagcagggacaggcttgtactcagggtgtttgctctctctgctgacagtctcttgtatttttttctttcttctttggcttcaacatagacctcccagaaaggagggactcaatcaaagcacaggacatggtctgtgcacagccatctgtggacttgattggcataatgggcctaactgtgtagagtgacttacaacccagccttggccggggagggcccaaggaaaacaagtgccattgaagtggaggatggctttaaacagagccactctgtttcagacatggcaccttcctcttctagaaaacactcgtgtgctaaggactcctgtgcatgtaaggaagcacgggccagcacagaaggcaagctgttccaccgtgggcaccccatgaggctctggaactgcccaggcactgggagggtgagcagatcgggggtacctgtggcatccctccaaactttctccctttgctgccagttaatgaacatggagggccctagtcaggtttgaagatctgagcctcttgtccagccatgctccccaggaagaggaagctccccagcagggagctccaggcttgttcagagctgcctgggctgctgctctcgtgtgctggccagtctggtggcttctaccaggaggcgactggtgtgcactgggccatcttttatccattgcgagaggacatgaggggccatctgattcttctgggaggcagctgcagactggaggacaaatgtccctggattactccgtataatcaatcacctggggctcagcccagtcccaggagttcctgagccttcctatactcagtgggctgtggctaaccaagcaagctgttttgtttccactcaaaaaccacactcagccacttcagaggtggccatgtccagtagaggaaaggccaagcttggagttgggagtcctgaattccagtcctgccacttgttagccgtgtcacacgtgccattttcagagtctcagatcctcacctgccctgcccgtcccacagacacaattgagaatgtgaatctcaattgctctgaagatgtttcaaaaagggtcccaccatggaaacataaatgcctcatttagagaccccttgcctaaaatgtttggttagaactgttgccgagagccaggagtggtggtggcacatgcctatattcccagctacttgggaggctgaggtggaggatcacttgatcccaggagttcaagaccagcctggacaacatagtgagaccctgtctaaaaaaaaaaaaagccattgctgagccagatttattgaaaatattttcggcccatttgccatccttgggcatcttctccatactgtggagtccacaggcttctgaatatttggggagacacccctagggagcacgtggaatcagaacctgttctaccacgcctgcagggcagtggcgagctcagcccccggaggcctgttaggaacatctgtgttgaacacctccccaggtaagcaccagggctctcatctggctctacatggtccctgccacagctcctggcatccccattataagtaaattgaggcagacagagccagcgaaccttaatccaagcccacagctagaaacagaagacctgggagccacacccaatcctaatgacagcccaggcataccacctgacaggtcctgccagctgctggtcacaccctctctcaaatgcagatgcaggaagcgttatccacacttcacagacaaaaatggtgctcattacacacacctgttggcccatgtacagtgtggtaagcaatatttcaagtgcttcacacgtatcatcccatttcatcctcccaacagccctgtacaggagacactagggttatccccattttacagatggaaaacctgaggcacggagacctttaagtagtgcccaaggccaaacgggtgagaaatggcagggtccagactcaaacccaggctgccggagccccgtctgagttctgaagacgtgtgaatgacacatggatccactccccacagaggagcagctccaagcccagagtcagcccagttctgtgtggctccagccccctcgtcctccttccacccaacctgcttccagtggacacaatttttaggatctagtgtaaggaaatgaaggagggtgccctttcatgcagatggccttcggcagctggttttagtccctgaactgggcccagaagccatccctctccagaacgtctgttagaggatgtggagagcaacctccacggcctttccctgcacggacctgactgttctctgcttctctccctccttccctgccttctctctcctcccctctgtccagcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcggtgagttgctccctgctgttctttacttggaaacgcgtgaacagggccgttccttggaagcgtgtgcctcagccatgtgttctgctgcccgtcgcggcccctgcccttctgcgggtccctacacctagatgggaaggctatgaatggttggttctctggggccttaaagaccatgaggcatccaggtgaggcaggggcaggcatgggaaatgtgagtggccaccttgggagcatcaccagtctggcataaactgacagagacattttagcctttttatcccaatctcgctttggaccttggatcagccctctgtgttccaggattaaaaaggaatatagccaggtgtggtgtcactcacctgtagtccccactcctcaggaggctgagacaggaggatcacctgaactccagagttcaagtccagcctgggcaacatagtgaaaccctgtctcaaaataaatagataagatagatgagatggatgagtagatgggtggtactattcctcacgtagaaagccaggtcgaggagagcaggcttcactagcgcaggatggtttgactctcagggatgtattagtttgcttttgctgcataacaaaccacccaaaacttggtggcttaaaataatagtgagcatttgtcactgcttaggacacggggtagcaggatgggtgtgctgctctggcccaggcttggccaattttggctgaactcactgacatccctgggacctgagctgagacaatggggctgatttggctgtgacccatgtagtctgtcacttccatcaggctggcctgggcttgttcacatgacagctggcgggcttccaaaaataacaaatggaagcgtgcaaggccccttagggcctcagctcagaagtagtgtgatgcctgttccattgcatttgctcagttaaattacaaggccagcccagattcagggagcagggaagttgcttctgcctcttgatggtagttgctactaagtcatgttgcacggggcatgggtccaggaagggaatgggctgcagccatttgggtaaacagtttactgctgaagcctaggggctgacactgaagaggggagtctttcactggcatctgcgcatgtccaggaaccaaaatggccaccattctccctttcgtctgttaaaatgaaacttagcacaggggaaagaactctagaacaatttcgagtcccacttgaaagaagtttggccttgggcagtgcaattctccccccatggccccccgccaaagatgcttcagcgtctttcctttgggactggattttacttgcctcatattttgtaagtgtgaaaattaagtaaaattatatgaaatgtctaggtatgtagtaagcttagaaagcttattactgttcttgctctcattgtcttagtaataagagttctggattctagtcttgttctgtttctaactttacacatgagagttaacctgtttggccttttttccccctctgtaaatgatgagtttggaccgagtgacttttaaagacttatccaaactcaagttcccagtttggtcttgtctggtttccatctgtgcccagggtgggcagtccaatgcccagtgccttcgaccaagatggtcctgcctgtctgaggaccttggagtgcattctcccaatgggtactgaggcctcacgccttagagcccccagcatccctactcatgctgggaagatgcgctcccctcaccctgctgtggccacacagaagcccctggtttcctcagaggcacctctggcaagctcctttcacaaatcttgcgaaacttggcctttagacaatccgagctcttgactgagctagatttttgtttttgttttctttccccttagagtttccacaatatcccttttgagcagttagggttagaggactatgaatgaactggactgttcgctacaaaattaaattcgaggacattttaattaagtttggttatgagtacgtcatagtttttatccctgggacatacaagagccttaagacatcttgtgtctaaaacactgcattcttagcaaaaagcccaccaaggagcctgagggaaggaccttataaggtccttatgtcattaaaaggagaatacctcaggaaccattagtaatggccaggtttgggacattcagcacccagtatgccggaacctcagagaagggattcagtacagtgccaacatgtccttcatatatcctttggttaaattctgagatgagccccagacatagagctttggattactatcagagcggccctttattcctgactttcttcattcattgctcctgggcctgtgtggtttgtccagcatggaactctgaaggagtgccccttggaaacacagcagttgacaaatctgaagacacctcacgtggttcttggcacagtggacgattatttccactaaaagattctaaccattgaaaacctcttgccaagggaatttgtagggcactaaacctgtgtggaacaatttaaatggaggtggatactgagaagtattctcattcactccttccctgataccagggatgggtttaattcagcaagctcaggacatcaacttttccaggccgggttgcaaaagacatgcagttgaggaggatggccccgagcaaagcagggccacaggtcagcaggctgaggaagacgggcatgaagcctgcgcagaaccaaagaacatctgcacacatattaattaattttgggtctgagtgcgtcatggcttttggttttttgtttttgtttttgagatggagtcttgctctgttgcccagactggagttcagtggcacgatctcggctcactgcaacctccgcctcccaggttcaagcgttctcctgcctcagcctccggagtagctgggattacagccgccctccacaacgcccagctaattttttgtatttttagtagagatggggtttcaccacgttggccaggctggtctcaaactcctgacctcaggtgatctgcccacctcggcctcccaaagtgctgggattacaggcgtgagccactgcgcctggccacgtcatggtttttatccctggaatatatgggagtcttaagataccttgtatgtaacatacaagttcacaccacatgaaagcacgtgtgaggaatgacatgagagttgtaggcatagaaaccttgtgggtggcggagcaaggacagggtcgtgggggctgggggtggagcttgaactgtgacttgaagggcagtcgggatttttaggagctaaaggacagggaaagcaagtcaagatgttccaaacagaaggacctgccagaggcatggaggccaggaagcccagcatccattcgggaaggtcatctcaaatgtaaacacttagaataaggtaatgaggggaatgatgacagccagccctcccgtctccccagaacctccactccaggaaaagccagtcctccccatccgcaggctctgccgggcctggactcgactgtttgctgggcttctctctcaccagcacctcccacgagttggtcccagggagtccctccaaccgtcccctgcacaggcttcagaccgagagatgcagaatctctcagtaaccattagggctgcctgtgccctgccggtgctgcagggttggcattggaaaaaacaccttcctccggctgggtgcagtggctcacgcctgcaatcccagcactttgggaggccaaggtgggcggatcacgaggtcaggaaatcaagaccatcccggctaagacggtgaaaccccggctctactgaaaatacaaaaaaaattagccaggcatggtggcgggcgcctgtagtcccagctacttgggaggctgaggaaggagaatggcgtgaacccaggaggcggagcttgcggtgagtggagatcgcgccactgcgctccagcctgggcaacagagcaagactccgtctcaaaaaagaaaaaacaccttcctccatactgcacactactttcttgtacgttctttctttgctaactgaaagttatgggtatttactctcactaagaggtctatttgggtgctagaaatctgttgaaatatttctttaccatcttggcttccagaatgaatctggataattaaaactgctagcagacccaagttgtgagtagaagttatattgaaatgcctgtaataactgtcatctgtttaaaaaaaaaaaaaaaacttcaggctaagagagttaagtgtgtatcatcttgaggactttaatttttttaaaagggtctgcagagcagctggcatcccattctgggcaaaacagtcgttttctgagatgggcccaggtttctgtgcatcagcacatgtgctctcaacagaaggcttgagcttcatgcagacgctcagtccccatgccatggcgtcccctcgctgggaaatgccaggcccagcccctcgggacctgttgcaggctccttcactctgcccattcatctgcctctcactcactcactctttctctccttccctacccacaacctcctggccacaaaccatccccaaggatgagccatcacagaaaccatgggcacactgacgggcctaaaggccaaacaggaaaggggagagatagagagacaaggagagaagaagggaggagaggaggaggaaaacggaatggcccacgggagggaagtggaagacagtccatggggctctcggcacctgttggaaaaaataagttcctgccatcctgacctttgtcctttgttcctccctgatgccatcttgtctcattggctttttgtcctggtcagagctagatcacattgagagagagagcagggagcatctgtgggcagaacccggtagccgggggtgggagaggggtttctcaaggcagcccctccttggggggggggtgttggtgcacacactggtctgaccctccctttgcacggtccacatggagtgctcctctttggggaaaaggactgtgccgctgtccccatgttgtgaagcccccttgaggcctctccctcccactggtgcatgttcctccttggcctggcgtagctcacgtagtacgtaggtgcttcaggttatttcacaccgttgactcctggactgtcctccattcttgggggtttagcagcacaatgtagtctacaagtctataccctcaagggtgtggtctaccagtctgtgcccttagggttagcatctaccagtccatacccttaggggcagagtctacaagttcataccctttgaggcagaatctacaagtccaaggttgagtctccacagatctccagctgtttgagtgcaggcttctctcctcaccagaccctgggctccctgaggtcagaaattagtccccatgcctggcacatagcagacaggcaggcagtgcccattcactcttgtcctgcccctcttgtcccaatcccaccatgtcttgctgatactgcacagggcattagccttgagcgggtccgcttctctccagcccgtggccactcacttcctccccacccccatgtctcacctggatgcactgcagctcctgactggccttcctgcctctgcagtcagaggccctccctgcttctcaaccctgcagctagactatagtgtcgccacatccctgcagaaccagggccagcttccctggctcttcagaggccctcacactgcttctccccaccttaccacgaacctgtcccctgcacacctccactgccttcccttcatcccttcccaacatacgagtttctccttcctgcacaaccctgtcttctccccaccgtgttttctccttacttgctgtatgaacctgagcacaccgccctgccccagtgccctgggccccgctttcctctgtgcagtgggagcacaaggttgttacaaggatgaaaagcacacatgtagtacgtgacgcacaaccagcatttcatggaaagggagctattagcatcagatctgtcgccatgtgggggaggctgctgctttcctgtgtcatgttccggttcgtcttctcaggattgcatgtcccctgaggagaggggatgggctgtgaactggcagctttggtgcagcctagcctctagctcccatgtaacagatgcattggtcccaggctctggccaagaatccattttcttcctcattttccttccctactgacctgaggctctggctgctgtgtctgactcaagagtttcccaggtagttcctgtctgcagagcccttgaaacacagtttggctcctgcagtgcgttccccctgtgcttttccactcttcctaaaagacccagtgctgctctgaagtgtgaaggctggattagatcccactcagcttgacctggtcttgtggaaggaggtacatgcagaccagagccccttccaggtcactgcgaccctcgggataacgtagagccacctatagagaaaggcccagctctggaggagacggcgttacctcctgagcccaggagcgagcctgccttgccttactgtgggcagtagggagtatgcccatctcagcagcaggactggtcacagccttgacagcaggaacagagctgagagtgcctcgcattgggggctttcaaaagcaaccactctgatgcagctgtttccaacccctggttgtagactttgagaatctttattgtttacagcctggcattttggctgatcggtgccccttgaccagcttcaggcacagtagtgtcactgtagcacctggccgtggttgtacttctgactccatccatgacaggcaaactgtcatgtgggagttcagtcagggtggtggggaaaattacagaggagaagttttaagataaagttataggaaatagacacaaaccttcttggaaggctggtacccacaggatccccattccttgtaaaggtcgtgcactgacacgcatcctgagggccagttccacgtccagtgcctctcgcctttacttccacgtcaggctactgtttccctatcgagggccttccttcctattctgtgatcaaatggttcactgcagttctagagatggagaagccaggagagagaagctgagccatttgttccaagttaagctagagccagggttggaatccagaaccctatcatgaaaaatacagcgttagattaacatttttgaactgcttaattgcccatttttgaactgcttaattgccaaataaattttgagatctcgtaaggctgggtcaaaagaaaagtgtgtaggctggacgttgagaggcgtgtatttctccttcatgttctgacatgttacaaagtgtagctacaggctctaaatagagttctaagaataagtataaattagagcccctgtcaggctgttgaaatgcaaactgagtaaaaatagttgtcagacttctagaactgaatttgaatcatttttcagtctgtactaaatctttctataaagggttgatgctattcagatcaacacttagtgaattacagagcatcctagaatgtattggaggttttgcaagagttaatttgccatgaagccattggccaaaacgtagtattttcagtggagatattgtgattccagttgcaaaaatacatcacatgagaaggaacttaataaggaacttttgcattcacccatcttctcccaagcaacgcatttttgttcttttacatccttttttcttaggatattcaggtggtttttaaaaataagctccactaaggagtttatttgaaaagggagaagatattttttggacccaacataatgctaatgttgcctttctttggtgagaagaatgccatcttgtcattcacacagtgtgacccacaggactgccttcttaccaggatcaaagacaaaacggtcagtggcagatctcagttcatgtgcatgtggcattggcctcagaacctaccacttggctttggaactcatcttttgacattatgtaaggtatagttattgttttaaattaacacaagggcatcaaggaaaaggagttgcccctgggcctaaggtagaccctactgtgtaaaccagtagttaattgggaccgtaaggaaagagaagacaaagccagaggtatccctaatagtttgccaaatggagtaacaaggagtgttaccaagcacctttcctggggcaggagggtgtcctgggagtggtcataccccatctctataagaatcaaatcagataagcttttctccccagacaatcacgtgggtgtcatcatcagtgaaaagctcaatttccttccagaatagataaattagggcccacactttgaggctcacagtcccctagttgaaggacatatgtgctctgagcccagcgccagtgctgagctgtggctcccattgattctccgctgaggaaggaagcccagaccacactagaaaagcagcttcccctgaatgtgttttctcacaaatgagggataaaaatttaagcccgaaaaccagctgtccaatagcttatctgttttgctaagtagcatccaaaaactctgaagtcataagccttacttgagccaagattatgcagtaatgaccaatttctggcaacttctcttcccaaacacttcaccatgccagtgaatccattcatttacatgaccacatttcgctgtaactggtggagctgacaattctccagggcttggagctcaagtcactgtggagcaaccattctgatcaaggttcctcagcctgtgtccctaaccctcagccgctgatgagcagacagcctcctctggcacgcgctcttcctgatcagcagaggaattaagtggagtggctgttatattgaggactcagaattgttcctttaaagatctgctttcctgctgggcacgatggctcacgcctataatcacagcactttgggaggctgaggtaggaggatcacttgagcccaggagttcaagaccagcctgagcaacacagcaaaacgctatctctacaaaatccaaaaaatcagttgtacctggcgacacatgcctatattcccccctatttgagaggctgaggcaggagaatcagttgaacccaggaggttgaggctacagtgagccaagaccgcatcactgcactccaacctgggtgacagagcgagaccctgtctcaaaaaaagaaaggaagaaaaagatctttcctgctttcttgctaaggcaacacagagcccatccctaatcctttttccatgccaggactataatagagagaaggtgtcaccgaaaactagtgccttttctaagtattttacttgtgagaaaaaaaactggtgcctggccagcttcaggcagctttgccttttaatgaattggccacacgctcgcatatgaggtcatcagcctccagcatcgtttcgactccggggcccagtggctttcgggggtgtgtttccaaaggagctggttactgattccaccttttccctgcctgtcctgccacactctggccagtgcacccctctctccatcctggcttatggatcaagtctcagctcactgggctttgcatgcctggtgtcacaaagcactcagctaaggaactctgcagatttggtgaggctgtaccctgcagagctgtgggattgcatggttagggcctgtctcgtccaggatacacctcagtatttcagaaaacacgaactgattgtgatatcagccatacccacgccacctcttgccagctgtgttattaggcacgtggtctcccctcccagcctcagtattttcatcagtaataagaacagtaaggcactgtgtgtacgttaattgagatgatccgtgcaacacttacatctgcctagcaggaagcatgaggtaggaatagttgttctcgtcctcatgaggcagtccctgctgtgtttcgactggctatgtgaccagggctgacattgggggccaggcacccctctcctaactggcacccctagatcttgtgcagaagtttgcaagtctcagacaggcagcccttcccgttctaaaatcctcagcccaaacagtcttattctggctataaataaaagttcctgctgcacagagagcagcagctcgtcagaagcaaacccgggcacgagccagatcctaaaataaactccaggctgtgatgaggcggcgtttctgtggaatggcccgccctgcctttctctctgcccctgtgggtaagcgtgatcataaggggctggaagtattgctctggggaatcggtagagatgggggcctgttgtaaatggtgtgaccatgagccctgatgcagctcctggcatctgcagagcccaaggggcacagcaagggcttcatggtgatcagaaggttttccctgtgtctccctgccccgtgaaggtacctttccagtttggctcttgtcccagcacgactgcatagcttgaataccagaacgtgagctcacagctgcagaggcagaggcagagcaggccaggcccctttgtccaagagaggccgactctccttgctttctccttgctagctgccccctccttggcagcccacacccctggtcatttccctgagcctccctccccagtgtctggacctgaacccatgcagtgggtgaagttcgtctcttacccatccacactcaaaactgagacgctgctgtgagtcaggtaatattctagacaccttaattaatacagtgcctagactatgtattaggtgcctactaaaatacgtatcagcaaatatgtattaggcccctactgaatgccccagtactgttatttagggcagttcctggattgttgggagggcaggagaggacggctgctgctggccgagaggtcgtccgcaccagcaccatgcggaggacttgcacgcagcgctctgcgtctcgcggaacgtcgcagaaaccttatgggggaggggctattgttttcatccccgttttaaagatgaacagcttgagctgaggctcaagaacttcagtcacttgtactagggcacacaagcggagatgccatgaggggcaactggagaccttgcagtcagccgctgccctgtgccgtctcccggaagaggcaccatgctgtgggagtctgcccctcaccttgttgaattaaaaccggctaaacacactatatgattggttaggaagacacttctccaacttggtacattttgtgatgacacaaaagccatttgtgtatgtgtaaatcaggtgctcagttattgcagggcacgtggaagcacaaagtgactttacacgggggcgccgatgaggctatttcaagactccagaaggagtcagcgcggaacatgactccttaaactaggcagcagcaaggcaaggtgagggggatctgtttagcaaatctcgtggcagtgtctgggcattgggaatgaacatctggcagatctgagaattggggctacaaaagattgagccactccctgaaacagtcatacaagggttccctgaaggcagcccccccagcagcacgccgtcccacccctcagccagtgcatcctgcttgctgtcttctctgtggactttcccagccagtaagggaggcttgctgtgtgcaggcatcctccagagatcgatggaaaacccagaaagccaagcccttcaccccactgccatcccaggaaggcccagagcgagctcccaggcctgcagcgccatcctgggtaattgctgtgaaacgttgaagtgttgcgtggagcctgctgtgagggtgtaggtgagggcggcaagccagggtgtaccaagcagggtgtctgccccccgagctcctgaaagaaggatatgaagggaacttcacttgtacaggtacctgagtgttcagtgctggtcacatgtatgacacttccactgatttatttgaccatggcatagggttggccttgagtttgtaggttagatgggaaagcagatgtgtaagtggtagtgagtgcttagggcagatgtcatggatctggtgtgagatcacaggagtgagatgagggaggagcttgaaactctggtcagtgcagccgggaaggggccacggctgtacacacaggtggaaacgagagggttgcgttgtccctcgagttacggtagctctttgtacaggttaaagggtagctttgccagactgcttaagggccaggaatggtggctgatccctgtaatcccagcactttgggagactgaggcgggcagatcatttgagctcaggagttcaagaccagcctgggcaacatagaaagaccccgtttctacaaaaaaatcaaaaagtgagccggttgtggtgacatgcacctgtggtcccagctactcaggaacccgaggtgggaggattgtttaagcccaggaggtcgaggctgcagtgagcctgggtgacagagtgagaccctgtctcaaaagagaaaacaaaaaactacttaaggatgagtggctttgacctcttgttagtttaaaacttcatttttcttcctcttcttcctcttttccatgggttctgaaaatccccagccacagcaaacacagagaatgtttgagcgagtggcacgcacatttgcactgggcttgactttcctcacgtccctgcctctgtagtgggccagtgagcccggcaaggtctttgttttgtttaattttgtgactcattcattcacccatatctgcaaggactttggacgtggccacccccacagcgctctcccagctccccatgatggtagcagcatgatggcaggcctttgtaggacacgatgacatcacatcattagattctctccacgtggtggctgctgaccaggtcctggaacacctctgtccctccttcagcagcagagccccagccgggggtgctcactggaccccagaagccatgggatttgctgtcacttctcaacacagtgtctttcctctctgatgagcatctgggggagtatagccttgtggctacaaggtggcatcaaagctgttgtaagatcacatttgtttttatttgagacaggaccttgctttgtcacccagcctggagtacagtgacttgatcttgcctcactgcaacctctgccttctgggctcaagtgatcctcccatctcagcctccagagcagctaaaactgcaggcactcaccaccacccccagctcatttttgtattttttgtagagatggggttttgccatgttgcccaggctggcctcaaactcctgggctcaagcaatccacctgccttggcctcccaaagagctgagactgcaggtgtgagccaccatgcccagcctacttcatttgttaaaaaaaaaaaaaaagaaagaaagaaagaaaaaaatggggtaggaagagaaatggactcagacatcgttagcatttccatagtgcagcttgccagccacgcttaaggtttgtgccgctcctttccaaaagcattcaaggtggatttcaatgtttaaaagttgcagtgtttgactcttaaggaataaaacctgagagattcatccagaaattcaaaatgagtaattacaatgacattgaatttggccacgaagttcctgagcagacaagacagcgatgggccacgcaggttttattttctgtcccagcagagcatgtggccacttgagccgttctctgtgtcatgctgtttagatagccctgaggacagcgctgttcactctccagtctcagggcccttctcaagggaggaggtgctgggtgtgggtatcacagtggcctgaggactgggggttgcttggcgtgattggtggcccgttagactaagttattgtgaacggcctgtcactgctcagctactgccaatctaattactttttctcttttcttcttgtattctcgtttttgtttgttctccacctggattctgtagtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggtgagaactcagcgtgcacacacacacacacacacacacacacacccctgcacatggggctgcacgttttttaaaaagcggtttcacgttcctgaaagacactgcctcccctttactagcagttgggggctgccagcgcacacctgctggcagcatggctgagctgacagctactgagggtcacaaggtgcaatgggagcccatgtgtttccagaacagaactgactcttctatacaaagttctatcaaactaggaatctgattttccacaaatggattagtggccatttagagaggaacttatcagacgcataagatacaaaatgctactagctttccatttacttgtctgtttttagggaaaggtacaaagccctttgcaagtgtggaggtgacagattcaggacaagtgtctgtttggttgcatgtggtgccgatgacagaagcctggtctctagcctgttaaagtgcctgtagcgcttcgtccaactcagagaaatgctgccttgcagattggagcagacaagtacatggggcagaggaagtgcaggcagcggaccccactccccagtatgtgggattgtcttgatgtgttgcttctctccctccataatcgtttcccgccacactggggacccctgctgtctccactacagtggggccatctctccaggatgatttagccccagacaccattggaggggcagcagcaggagacttggatcccctctagcacagaggcaagaggtggcaaaagcagctttgctctctgcacctgggaagaccagagtgcaggctgtggcatcccctggccagctgtgagggccggctggagggcctggcccatgtgtctttcctctcgtcctgtctcccccagagtgaaaacgccagtgaggaagctggtgagggtgaatatgtcaatctgtattcctctggccagagcagcgaggagctggctccctctcgaggagtaagtaacctcgggcggcctcctgcatgtggcctggcctggtggggcttgggccctgccctcccgaggccgcttcccccgcacctgcttctgttgggctgagccccctcctagtcaccagcagactgggctcctgcaggctgctgggagccagctcggccctttggagaggacgtggcttccaggtggaggtctgccctttgctcctgcttcagtgcgtgtggcactcctcagagcctggccagatgggtcatctagaaatctctgggaccagcgtggcacgggccccggctgtgtatctagtgctctctgtggggttccttcctccctcatcttctggtgttggcttcatcttctgtccctcatgcagagggagggactcttcttcccatagggcctttcagaccttcatctccctccccagcatgtcccattgctccaacactgactgcttctgaggaagcgggtgagtctggcccatagcccctgccatgactatgcacaccccctcctgagggagccacaaggtacccgacgtcagcaccctcgtgatgctgctgccccagctcccgaccatcgcggtacagcagttctattgagcaatccactttccacattttgcttcagccaaacatgagcaagttcaaaagcttcagaaattgctccccccatgagcccaggtgggacaggttccttgaagggaggcccatgagggctggaagactcccagtgatccaccccagggcgggcccccacccgtgaagagcttggtcacacccgttcaggtggttctctcagcagggtccccacaggggttcagaggcccacccagagccagccctgtttcagacattagcaggttatagaacattgaagagtgtccactccagtgggatttgacccagtccatgggagctgtctcctctgctgacatgtgcatctggcaccccccggctcagcctccccatggtgaagtccacgtgcagggagaggccagcttcgcatggctctctccctccactgtgacacttccagggctcactggctccttgccttgaagcactctttctgtatttgtcctgccccagttctccatcaggctcagcagcagaccagggatgttggcaggccatgttgtcactgagtagggccagcccagggacccaggaggaagcaagtctgccggaggaagaggggactggcaccccagggcctgagagctggccctttggggactgaacccggttgagcactgcagccctgaggacttctttaaatcagcagagtttggttcacgacagcagggcccagtggttaagggcacaggctttgcaggtagatagccctgggttcaaatccaagctctgctgtttatgagctgtgtggtcttgagcagggtccttgacttctggcctctgtttctatgcatggagtggggacgatggtgttagctcactgacgaagtcaaatgaggagaagtgggcacagcctagagcccagtccctggctgtgctcggggggagtggctatgacagtcttctttgaggaggtagttgaggtggctttgcctaggttggcagcttacagatgagacaaatagtggcacctttcactttctccaaaggccacatgctagtcttgagggcttgtgtttcctgtgattaacggcattcatctttaatttgttcacatctgagattgctccataggaacttgcactccacagccacttgcaggcaggaatgctgggaagacagagcagccccgcggagggcccctgtccagaactcagcacccactcctctttccaggagccaccggctgggaaagacggacatcccagagatccctcagcggtcagcggcgtccctgggaaggacagcagagacggcagtgagaggtaggaagtggacccagaggagctgggtcccccgagagcagtgcgcccactcatgaggcctgcctgagcagcctctcccagctagcccctaggcctgagggtatttcaagttgaaactcttccttctttccttatttcctttttttgttttttagagacagggtattgatctgttacccagactggagtgcagtggcacaattgcagctcactataaccttgaactcccgggctcaagcgatcctcccacctcagcctcccagatagctgggactacaggcatgcagtaccacgcccagctgattgttttagttttttgtagagacgaggtctcgctatgttgcctaggatggtcactaactcctggcttcaagcgatcctcccacatcagcctcccaaagtgctgggcttacaggcatgagccactgtacctggccctcttcctttttttctgattctcaaataatacaagctcaggatagaaactgttgaaaagcatagaaaactgcaagaaagcaagaaaaatcactaataaccccaccctgcaaaggccttcacatgtagtttgccattacttcttgattgtttgcacctatattatctaccttacaaattacccacgatagccttgtcttttctttttcaaatcccaggccaacctcccttggtcttggcctctttcaagttgatagggagtgtaaaagacaccccctccacttacaaacttgttatcagggacatttctagacatatgtgtgcatgtgatgttgctaacaagaatgtcttgtatatcttaattttttgcagccaagatcaggagctgttcattgcatttagtcattacagctctttaatgtcttataactttttttttttttttttttttttttgagacggagtctcactctgtcgcccaggctagagcgcagtggcgcgatctcggctcactgcaacttccgcctcccgggctcaagcgattctcccgcctcagcttcccaagtagctgggactacaggcatgtgccaccatgcccggctaagtttttatttatttatttattttgtatttttagtagagacggggtttcaccatgttagccaggatggtctcaatctcccgacctcatgatccacctgccccagcctcccaaagtgctgggattacaggcgtgagccatgatgcctggccacatttttcaatattagcataaaccaaacctgaccaagtgtagaaatacgtagtagatttccccagtatgcacctgtgaaatatgatgtgtaggatctgcaaatgggcactcccacctgcaacttcacattgacttccccttctctatgaaatgttccatgtgttcaagcttttcctccctccttaggtcaagctttagccacctctggggtctttggtgaccttagagcaagggagtgcccacttgtcattatcagggctcagcatgaatggttgaagaggcagttaataaaaatagcaaaagaaagaaaaagaaatgagaaggcattgcatagggacctgttgaagagggccacctgcccagcctgcctcctggccactcttgtgctctctgacttgtctctctgacttgtctgcccagactgagctttccccaggtgtgaagccaggaatggtgtggtttctaggttaatacctggggcagagtgtgtgggccaagcaaatgcagctcgtgggtatgccactagcttcactggaccccaaagtatcgtcttcagagttccagatggttctcgtgaaagagaaggatgaacactttgactgctcagaaataattatgggatgttgtccctccatcaaggccaaaccacagggtgaacattgacgagatgtggagcagggattttctcgagactgggcagggcccactctgacccatccatattcttttactgaaggcacatttttttttttcccttgagacagagtctcactctgtcacctaggctggagtgcagtggtgcgatctcggctcactgcaacctccacctcctgggttcaagtgattctcctgccccagcctccaagtagctgggttacaggcaagcgccaccacgcccagctagtttttgtatttttagtagagacagggtttcaccatgttggccaggctggtctcgaactcctgacttcaagtgatccacccgcctcggcctcccaaagtgctggaattacaggcgtgagccaccacgtttggcctaaaggcacatatttttacatctcagatacctggggttaaaatgtgacctatgaccacaagacgggccagaataaaatagaggaacatggaagaaaatgccaggggaaagccaggcatatctgtaggcccagcttccactctccccagaacaccctaagctgggagactcatcttggacacccccggccgtcccaccttcccctttgtgggaaatgttctctcccatccttcagccggcaacttaggctcagtactgcaagcctcggctcacccatcccattccagaagcctcccgacctttagacgaggccagaccccctggctgtgctcatggtacccttctgggcttcccctttctctgtgctactgtgaccacttgttttaaaattctgtctcaaaaaaaaaaaaaaaaagactgggcacggtggctcatgcttataatcttaacactttgagaggccaaagcaggagaatcacatgagtcaggagatcaagaccagcctgagctacatagtgagacctcatccctacaatgaacagaattatccaggcatggtggcttgtgcctgtagtcctcgctacttgggagactaaggtgggaggatggcttgagcccaggaggtcagggctgcagtgagccaagatcgcaccactgcactccagcctgggctacagagggagactctgtctcaaaaaaaaaaacaaataagtggctgggcacggtggctcacacctataatcccagcactttgggaagccgaattgggcagatcacgaggacaggagttcgagaccagcctgaccaacatagtgaatccctgtctctactaaaaatacaaaaattagcaggacgtagtggcatgtgcctgtaatcccagctactcaggaggctgaggcaggagaatcacttgaacccaggaggtggaggttgtgatgagccaagattgcgccactgcactccagcctgggtgacagagcgagactccgtctcaaaaaaaaaaaaaaaagcaaataaataaattctgtctcctgctcgactgaaccctcagggacaagaggctatgtctgcttggttcacagctctttcttagcgccaagcaaagggtcccgtggcaagtcggtccttggagaagacttggggagcagcctcaagagcaatgcagctttctctcccattctgcttgccccttagctcctcctctccctaaatgctaactgtgcggtgggccttggcagggagtggctgagaccatcactcaaacagcttaatggaacctttttattttcccagcggaatcacttccgtgtacagatggaacatccagaggcagcagcgactgtcctatggccacacagccagtcagtagcagagctgaggatccagtccatagtgacgtagctgccatcggggcaggcatgttccgggagcggtttcgagccgtgcacaccggcactgccttggcctccaggcatcgggagctgagccggtttgacacttgcaacacaaaccacttctccccgcagggccccaaagtcaccagatgctctggagtcggctcagtcggaggaggaagtggacgagctgtccctcattgaccacaacgaaattatgtccaggctgacgctcaagcaggaggtgagaacttcccgggctggggctttgcagcctggccccacagaggagagcaggtggggcagagaagaatgtgatcttgtcataagcagaacaaccctaggaggcttagagaccaagtctttcaatgcccctggtgagcctctgggctgtgggctctggaggggtagactccaggggaagtgtgctgtctccttctgatgcttatagaaagtcatcttacacaggtcaagttctgcagcctctctagctaaagatgccagaactcctgagggtgtggagatggaacccctgtaaatgctctgcagacagagcctgcatgtggccggccctcactaatgggaaactttttctgtggttgaaaaaatagctccactgtagcttcagtctgggagacagaggcaggggaatggcttgagtccaggcgttcaagaccagcctgggcaacacagcaagacccatctctaaaaaaaaagaaaagaaaattcaggcctggacactgtggattccctggtcctgtgccttgcctgcagaacctcgttggtgaaaaagggcccaaacctgtgacagtggagaggaagcaggacagagagtgccctgcctctccctcctgccgtgcagtgctagaagtacaaaggagcggcttcataaagcagccttggcccgcaccaggaggcaactgttttggggcttcgatttgatgacacatggacaaaagggcagatactgccctttgcgcactcccaggcaaggatgcgctggctctggccatggcagggagcagcccaggaatgtgtctgcgccttgggctgtcacacacaggcagggctgatgagggtactcacacagctgggctcctctgcagagagatccttgccataaatttcttccttaaaatcaggtcaaaggcatagttcctactcctagaggtaaacccaagacaatctcaggcctctggagtcaggaggtaaaataccaaagcctaaaaataaaaaggtgggctagtcccggagtgtgtaccgcagctgagagggctggttccgtccctccagcgttacagagcaaggagcattgagggccaggggcagaaacaggcctggggggttgtcctggacctctgttcctggccctagtcacagctctttttggctctacgctgggtggcctctgtttgcccacatggaagcaagacttgcttcttaagaggcaggtgggttggtggcaggtgtgcagcgtcagaagtcattgaatatttctgtctgtaatgctttgctctcctttaaggaagggccccacagaagaaccttgtgccaatgcaagtaacttctacttccacctggggagacggatttagatgtagggccgcttgctgcagttttggggaacatgaacatgcttagaaatagtcctgctgcctccacaggcatcctgggcaaggctggggactgtcttgcccccagggggtcctacctcacctctgacttgtggtttggtgagcaaggaaggatggaaggtgctatgtcccctggcccaagttgtgtgctcaaaacagtggcatgccctggtgccttggtgccggggcagctcccaggccatccagctcccagacacagtccagtttgtgcctgtcaccaagcacaaggtgagtctggagggcacccctggcttcgcagcgcagccacactgctcctgggccgaggagcacagaaggagaggggacttggggttgcagggcattttgtcatctcattcctgcctgtttcttcctaaactgattctctgaagggcatactctgcctcataccttccttggctgtgttcattacagggtgatgacgggccggacgtccgcggaggatctggggacatcttactggtccatgctactgagactgacaggaaaggtagggtgtcagtgagctcactagattggggctggtcctgccccgggtgccactcggcctcccaccgctatcctgtcccctcctggcagccacagccctgagcaggtctgatcagcagtcctggtgcgcctgagtcagagcagggagagcccaccttggaagacaagtagatcatgttcaactccaggcgtgcgtggcatctgtcctccgctggtacaaggtagtgaccccagggcctccagggtccttgaggggctcagcgcatactaagcgcaccacagacagcgccttgagtgatggcatgtcacccagtagtactaaacttaagataacatgcaggtaccttttgattcctttcctgactgctgagtcactctattgttgcagaccattagaccggacttcactcacatactccacaaggaaattcttgaaggtttgttctgtccaggaaccttcaattctgtagcagtggcctcagtttcacagcacacagctgccccaccctaccacgcattcagtgtgctgattgagagggctggaaaagcagggaccgtcccctaatccctaaaacgtcttgttgggtggactctgctagcaaaagagttgtcattcccagtcatgctctggaaaggaggtgctagtgacctgatggggcatggccacagcacccttcactgcctgccctcaaggggccagcaccacctggccggccagtctctccacacgctgcttctctttttacgtttaaaaaaatgatttaaaagatgatgtcagagcaatggtgaagtaaattgtggagggaatgaaaacacccccaccttgaaatcctagcccaacccgtttcatttctgtaagggactctgtccctgtgtttcctcagcacgtttcccaaaacatgtgacccagagtgactcggggaatttctgaattatggaagtagtactaaaaaatatttacattgcagaaaattagagaaaaagaagagatggctcccacaaactcaccgcagccactgctccgccctccccttcactgttccctcaccctttgtttgttctgaccagggcagggcccagacctggcgatgctgcatcctagccccagctgtgccatgacaggctcagagggcccctgggcagtccccgggcttctcggcctgagccgactccacttgttgaaggggtgaacggtgcctgttgttgtgtggattacgtgagggagtgtgaaacctgccccgcatgtcagcggtgctgggggcgtgatcagcagcatcctgagcgccgagtgcagcccttgcttggcttctctgcagtgaatccccctccctgcctgacatggggggctccatactcagccaggcatgggagcgactttcatttcctttttgtccacagcgaggggctgaaatgggagctggcttcagacctcggctccaaagggtgaactccactgtcctgtcgggtacagccagctgtggccaaggctggaggggtccctgagacaggacagccaagaggcttctggcttttgctggctggacctgctgagaggacgctccgtgccggtgggagctttgcctgattttactagcagaagggttggaggctccccagaaccaaagttttacgtaggaagtattactgaggcagaagccatggctccactgggagggtgaagcaccctgtggcaggtaacaaagcaagctccttgggcaggtgcatcctgcaagccagagactgcaccagcatcacgagcagctgggagccccgtggctcaggcccgtggagcccagcctgccaagcagggcttggcagggagaggccgtgtgggggtgctttgtggttgcacggctctgctctcaggtgtcaggacctgcatgggagaaggtcaggtcagccttggcctcaggcctcagcttagatcctgtctatcccttgacaactgtgtgccaagcctgtcacttagccccggagcttccgattccttaggaggaaaatgagggacaatttcggggccttttagggctgtctcaaagaccaggtgagccagggcgcacagagtgctcaggaccgcatcgagagtcctgtgatctctagaggggtggcacagcactgcccgtcccagaagccaggcgctgtcccatctgccataatccagggcacagcagatgggggagggctctggaattgggcagacatgggcgccgaccccgccacattgcttgcgggtggtgtggcctcgtgcctgggctcctcctctctcggtagggtaacaggactctgtccttgtgggattgctctgggcattgaaggatgtggcatatgttcaaggcatggcccagtgctcaccagcgagtcccacgaagttgtcatggctactggcaatgatgcacccgcaaaggccagttgacttgggccccttcttccagaagcaggtatgggtctatgctggtgccatctctgcttccttccccaaactctttgaacaaaaatccaagcttgacagtgaactgggtgggtgtgggggccgaggaatgagcctgagcacagtgcggatgggccctgctgtgattcccagcccggagcctccttcacctgccagccccaccccacgcagcccccagtgcaagagcaggcgtgggttttcctctcgtttgatgcaagaggggatggggcaagggtgggggcaggagccaagccagcatgactcagctggagatgtgggttcctcgagattcctctacccagcagctcgggaatgagggagaaggtgggagcaggtggtgtatgtccagagcacaagatttaagcagtgcatgtttgcacccagcctcacagtgaggagcacagctgcggagcctccttgggcctcacacctcagcaggcacggggggtggctgcagggagtgagtctggccacccgttggctcaggcagtgtcctacattttaaaattccacttcattctgtaatatcagagacagcacagttgagaaggtgtcaccacagcaaataaatagggctgttgtaattctggaaagtctgggagtccctgactggtaccagccccctctaagaggaggcaggcatggagaggtgaggggtaagctggagctgccagcccacacctgcccagtggctggcaccatgcctctccttggtacccggcccaagccgtgcctcttcagcctatcccttaggacccaaaacgtggaatttccccggatttttctgattggaccctaccatctaaaagtactgaccaggcacggtggctcacgcctgtaatcccagcactttgggaggccaagctgagtgaatcacttgaggccaagagtttgagactagcctggccaacatggtgaaaccttgtctctactaaaatcagccaggcgtagtggcgcgtgcctgtggtcccagctactcgggaggcttgaggcaggagaatcacttgaacccaggaggcagaggtggcagtgaaccaagatcgcaccactgcactccagcctgagtgatagagtgagaccctgtctcgaaaataataatcataataaaaatttaaaaataaaagtaaagcctagggtttcatttcaggatcctgctgacgggtttgaacagacgattttctttgttcccatgatggctgagaccctctgaagcataaagccttaggacaggcagagcctctcagagtctaatccagggctggctcctacctggaacaggcatgccaccgggttttgatgcctagggcaggcgtcactcgtcagcctaagtgcccttttcccctgggaccagagttggcctcagctcccacagcacggttctccaggcagcaccatcatcggtagaaagtgcccatgagataaaaccctttcctgtttcccctctctgatctgccgtttcctttgagagatggacagagaggacgtgtgtcttctctgggacatgcaggcggagacaccagagggggttcccaagccctcggctccctcgcccatcccactccccgtgccatctcccctgcctctctcagagcaaggactcaaatccaccctggctaccaccccccagcactctgcacccagacaagcagtttgcattgtttttccctctagatttggtgttgtactgcgaggcattcctgaccacctacaggaccttcatctccccagaggagctcatcaagaagctgcagtacagatatcctttccttcctgacccagggcccctgcaccatgggcattttggagagagagggaccctcttgcccttcagtcctcgtgggggaagccgagcagcatattgggtggcagtgtgattgaagtagggacacaggagccccatggaccgaggttcccacctctaccctcctgcattccagctttgagctcaggcaagttcctcatctctaaaagggccgagtgaaatgatgtgaagaggctggaacatagtctgggaatgtgtgtctggtggcagttgtggtcattggatgattctaaaaacgaattagacatgccccagactgggaggggcaagtgtgccggtcctgcagacgcctctgagagaccctcatggtcggctccggcagcttctcagagctgagccccagggcgttgggcacgaaggataccaagacccaaatagacagctcaggggtcagcacagtcaccttccctggagcggaccctgcgactgccacatccacaactggaatgggctcctgtccccagatctaccccatgggcccaccctcagtaaatgtcaccctctgcagtagtggctgaggaggaccccaggggtttggaaggacccacttgtgtgacccattgcctcttcaagtccaaacctgcccatcctaagaggctgacctgcagctgctgctctaggagggtagcctgggtcagctgctcctcagccacctctttgcacatagcccacggctgccatctgctgggcagccaccaccacctggggtaggaagtcctgagtccacccgcgcccccgctccttcctgtgtgccctgagccttcactgctccactcagggcctcctgcagacctcctggcctcctattctcccctcgtgttgacctttagaatccctgatctatcaagacagacgtggacatcctccattggcggagcctcgggtccccggcaagttctgttactcagagcacctgctcacaggcctgactcagtgaatggctgtcactcacacgtgtcaaggacttgctggtcaggcgagatgtgctttacacctgtgctttcacctagccctagctctatgaccattttttaatatgtgtgtgtgggtgtgtataaaattaccatattatacatggggccactgctctataactccctattgtgtaattgaggaaaccgaggcccagagacatgaaggacctgacccatgtggctgcttggtgggagagcagccacacgctgcttgccccctgctgcctgcgcccaggctctcagcctctgcctggctcagccatcatggaaatattgcagcatcaaggtctgggcctggttggctggcgacccctgtgctgtgggccaagacacagtccctggtacgttgctctgtcctgagccccatgacttggaaggtcgtggatcactagagagcaggcaggagggtgtcagagagatctggggagtcgatggcgagcacaacagccgggcaggaaaccctgaccacaaagcagagcccgacctcagggcatgagctagagctgatcgggtgcttgaagtgctgccctggagacagggagccaatgtggagcgtgctgcagctctgggaagagagacccggcccggtgtcacggaggtgagagttcccttgcagagcccagggaggcagcctcaggatggaaactcacagaaagactggagggagatacttctggcctacacacctgcctagggacctggggtttggagggtgtttggtttgggcccaccgttctctacctaaagttcagcaaggcactctctacgtgtctgtaatctcatgggcacctcggggtgaacccgatggaaaggcgggtctggacagtgcagcggagatggcgtggcagggaggagagggcagcagccgggggcatccctggggacagacgcctgtgctcaaatcctggctttgcagttgttccactgcgctagtcccgtgccctcgtttctggatgccagtgctttacatgcaggaagatgggcacattgtgagcgctcagtgagtggtcaccaggagtcagtcctccactccacgaccctcagccggccacatggctatttctttaacccgtgctccacatatgagaaattctctccctttgccgacacattcaagaagcgcgtcagcaagaacacgttcttcgtgctggtacgggtggtggatgagctctggtgagtgcttcacccttggggtcctgggggccagtggggaggcaaaggctccattccacctgcttctcctgcccatcggctctgggcagagctggctcttgcctgctctatcttggtcctttgagagaatggcctgtgcccgatagaccagggtgagatgggtgaggtgtctctccaccctgcacccaggccctggatttcctcatgaggtccctcctggaccctcaggagagaacccgcccaacgcacctgctcccatggtatcttaggtccagtctccagcaggccgtgctctcagccgccagccatggtggaggctgtgtggaggctggaatgggagaggccacctctccctcgctcctcagtgtttccatggctggccatctgacagcatggcacttggccatatccgttccgctaacaaatctccatcaggcggactgccttcctcctgctgggggagatgaccatggtaagtggctgtgcggctgggaaatggccacgtgtggacagtgctcagcagggcaagttggggagcatctagtctgagaggccgggaagtcttggtgtctcattgcccaatgggagcagcagctccccagggcgggattcgtgtaggacttgtccctgcagcccaggccccagcacagtcactggcgcttgtccagcgccaacagatggctgttgagtgtgtggcaggtgcttgtgaccatcccaacacctccaaggacacaggcagccatcccaggctctcgtctcctgctctcttcccatgagaaatttcccagccagctctgtgccggtcacagccccgtgccctttgtgtgtctcaaggcaaagacagactctgcctgggccttgcgttcctgctcctcaccttgtgctcttttgtccttcagcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggtgagaagcccacctctccagccctgcctcttccccaggagccgtgcctttctcagtttaccctccctccctgccagccccacagccccatcctggttctgcacaggccctttgatgaggtgcctcaggaacagccccgtggatccctgggggctgggcctcttctccaggaggcacatattgggtggtgatccctttgtgaccaggaagcgggcagcagggcatggggcttcataggacagggcaggagtgcacacaccctgggctgtggtcagttctgggttgtcccagcacgaacatggcagtggttgatgccagtctgtggcccgtcccctcgacaccgacggtgagtgtcatttgcacctatacatgtctgttgagtagtgggctccttccagtgagcgcatagccttcgtttctttggcaccatctctgttcttgctggccacctggaagtgggctccagccgtgagcgagccttcttggcatctcaactgtccatgagctcacgagggaaactcagtcttctgattccagaagctgctggacatacccagcagaagcaggagagaaaggcagacagtgtcgtcccggagagaggcaggaggccattagggccccagggagccttttggggcttccccgccctgtagcctccacgctcctgctgggcagagaggctctcctgctctgacgcccgcagcccgggcctgctcagccctccccaccggcctccccacccctgacggctcttctcacacctctgtcttccaggccggggaccttgcacgactttcacagccatgagatagcggagcagctaacgctgctggatgctgagctcttctataaaatagaggtacaggctgctcctgccagggggagccacactgtttgtccctgaatgagagaaacccccatcaggggaaagccggggctccacctccatctgccttctttccttttgtagattcctgaggttttgctttgggcaaaagagcagaatgaggagaagagccccaacttgacccagttcacggagcacttcaacaacatgtcctactggtaagagaggcccagcgccaagccctgttgctctggatggtggcacgtctgggtgggctctgcgttttcctttgcagggagctagaatggtaggagaaggagctgcctctttcattccgctaagctcctgggggttcccatgagcactgacaggctgaggacaggggcagggacaggatggggcttgctggaagtggccacctggtcgaggaggctcagcagggaagagtgccagggtcgaggagcgatgtctgccataggtggtgttgggaagggcgtgagtttgccctcctgccctggtcactgccaggcaatctcaagctgatgctcacactgactctgcctgacagaacagttagcaaaggagtgggctctataacgttaatgtttgcatttagtctttaattcgtgtgtgtgtgtgtgtgtgtgtgtgtttgagacggagtctcgctctgcaggtgtgtgtgtgtgtgtgtgtgtttgagatggagtctcgctctgcaggtgtgtgtgtgtgtgtgtgtgtttgagacggagtctcgctctgcaggtgtgtgtgtgtgtttgagacggagtctcgctctgcaggtgtgtgtgtgtgtgtgtgtttgagacggagtctcgctctgcaggtgtgtgtgtgagacggagtctcgctctgcaggtgtgtgtgtgtgtgtgtttgagacggagtctcgctctgcaggggtgtgtgtgtgtgtgtgtgtgtgtgtgtttgagacggagtctcactctgcaggtgtgtgtgtgtgtgtgtgtttgagacggagtcacgctctgcaggtgtgtgtgtgtgtgtttgagacggagtctcgctctgcaggtgtgtgtgtgtgtttgagacggagtctcgctctgcaggtgtgtgtgtgtgtgtgtgtgtgtgtgtttgagacggagtctcgctctgcaggtgtgtgtgtgtgtgtgtgtgtgtttgacggagtctcgctctgcaggtgtgtgtgtgagacggagtctcgctctgcaggtgtgtgtgtgagacggagtctcgctctgcaggtgtgtgtgtgtgtttgagacggagtctcactctgcaggggtgtgtgtgtgtgtgtgtgtttgagacggagtctctgcaggtgtgtgtgtgtgtgtgtgtttgagacggagtctcgctctgcaggtgtgtgtgtgtgtgtttgagacggagtctcgctctgcaggtgtgtgtgtgtgtgtgtgtttgacggagtctcgctctgcaggtgtgtgtgtgtgtgtttgagacggagtctcgctctgcaggtgtgtgtgtgtgtgtgtgtttgagacggagtctcgctctgcaggtgtgtgtgtgtgtgtgtttgagacggagtctcgctctgcaggtgggtgtgtgtgtgtgtgtgtgtttgagacggagtcttgctctgcaggtgtgtgtgtgtgtgtgtgtttgagacggagtctggctctgcaggtgtgtgtgtgtgtgtgtgtgtgtgtgtttgagacagagtcttgctctgcaggtgtgtgtgtgtgtgtgtgcgtgcgtgtgtgtgtgtttgagacggagtctggctctgccgcccaggctggagtgcagtggcgcaatctcggctcactgcaagctctggctcccctcaagctccacctcccgggttcacgccattctcctgcctcagcctccagagtagctgggactacaggcgctcgccaccacacccagctaattttttgtatttttagtagagacagggtttcaccgtgttagccagggtggtctcaacctcctggcctcgtgatccacccacctcagcctcccaaagtgctgggattacaggcatgagccaccgctcccagcctagtctttaattcttaaagcaaaatgaatcccagtaatgtgtttataaaccagagctcttgtctcttcaagaggcgacaaagcccccatagcagctcagcatcaggcaggaccccctagagctcagcagctgtgccacccccacccacccactgttgcctccaggagaatgtctgatgtgttttaaaggccccgagatcatctcccgtttgcctatcttcctccccacagaagcactccatcctggggaaaagcatgtttagctatggcagtccagcgtagggttttgcccaacaggatgtggtttctaaagcagacggaagctgcacacaaggccccaagcctggcttctgacaccagcctctggctgggtgcaagaagctcaggggcacactccacagggcctggctgcacagaggtgcgagtgcagtggctcacatctataatcccaggactttgggaggccgaggcaggagggtcacttgagcgcaggagttcgagaccagcctggacaacatagagagacgcccccccctacaaaaaattaaaattagccaagagcagtggtgcacacctatagtcccagctactcgggaagctggggcagaaggatcagttgagaacaggagttcaagactacagtgagatatactcacagcactgggtgacagatcaagaccctgtctcttaaataaaaaagaagaaccagcagtgcaaagtgcggcaccacctccaagtgaccctggtagtggcccctgtgaaccacaggaaattgaggccagggtgacatccctgctgcatttatcacacagatgagactggcctttggctttggtctcggctttggttgctactaaggttctgagagtttccttccctcgtggctgcccaaggtgacctcttacctcacgtgctagcgggtctccccgagccagtcctgcatcacacaaggaacttgcccagccccctggtacttggggcccatgcttgtcaggaaaggctctgctttcatcctcccatgctccacctgcagattcgaagccccctttgggccttcaccagatttccttatggtcaccagatttattgtcaccagatttccttgtgcctctgtcccaggatgttatgagctcctggagagcagaaactagatctatgcctggggcaggctgcaggtattcagtaggggtgggctcgtggccactggcatgggggtcgtacaggtcctgtctccaccaggacccctgggacctgcagggacttgtcaactcagctgtttctttttcccttggtccatgcagggtccggtccataatcatgttacaggaaaaggcccaggacagggaacggctgctcttgaagttcatcaagatcatgaaggtaatggtggccaagtccttcccaggcccccatcatcagtccctgctctgggagcccgggacccgcctgccctcctgcctcacggcaccgcccctctctcggcagcacttgcggaagctgaataacttcaactcctacttggccatcctctctgccctggactcggcgcccatccgcaggctggagtggcagaagcagacttcagaggtgagtggccttggggcgtgggcgggagggtggctggtaaggggggccgcccagccctcaggcgactagctgtggcagaaagtgctcccactggagcaaatgctgggcctaggcccctgctctgccaccgacatgctgtgtgaccagaacagctgccctcccgccttcctgtctctgatccccaatcttcaggcccccgggagcttcgaggttggttctggggtggtcacatcccggtgttctgctgccacccagcaggcccatccctgggttcccgcctcccccgcccgccctcagcccgttcttctgaagggtctgcttcgggccgggcactgcggtaggtgctggggacgcactgtgaacagcccaacatgatgttgggtgagtttctgctagataagcactaaaagaagaagggtgggcaggtgggccagcccagaggaagtgtcactcatgccaccatctgcagaggaggaggagtttcctgggaagggaagagaatcaaaggggacaaaggagtgcacagccaggagcaggtgggggtcagcacctccagggacaggaggaggccaggggaccacatcccgggagaaggggaccagttctaggtcatgagagcctcaggagcctggtgaggagttggacctttatcctgtgtagggaaataatattgcaaatgggggcaaaacccatggcttttgagtgtcagccaggccacccaggggtcatgtcagggacccaagttcagccaggccacccagggattgtgtcagggacctgagtgtgaccagaccacccagaggtcatgtcaggaacccgagcgtcagccaggccacctgggggtcgtgtcaggaacccgagtgtgacccaggccacccaggggtcatgtcagagacccgggtgtcagccaggccacccagggtcttcttgttcaagcccatgttcagggatggttgtaagctagtgtatggggagaggtgggaaattcacacggcctctgcatggggggtcctcaggaggcagcacttcagggagaggcacgtaacaggagaagaggcaggagaggggccttctgagtggggcagggctggctgagtctcctaggtgggagccccccacccctgcaggagagaagccacccagccctggggagggcgaggtcacatgctatctttagttggtcctccctgagtacagggcagagcaaaggcagctccgagtcaggagtgacgccactcagtgtgtgcctgggaagctcctctggctgcaccgccgaacagggccaggcaggagcccatcttccgggatgtcgtatacacgcaagcgctggctgcccaggcacaatgagtactgtggggtgtttctccacaaaacggcctgaagtcccctgtgaccaggggttgggctgacactcgttgaaaaggacagaatccctgctggccagggccaggacccacacctggctgggtgtttgtgcgtagtgggacctgtggagttgggcagagggtggttgaccctccagttagtgaggaggaccagggctctgccccagcattgccccagcactcgctcacccctgtccggtcctgtcctgtcctgtcctgccagggcctggccgagtactgcacactgatcgacagctcgtcctccttccgagcctaccgggccgccctctcggaggtggaaccgccgtgcatcccgtacctgtgagtagcagcccctccaggcccccagccccgcctgggtttgcctccattgctctggggaagatctgtcaggctccagcagagaaatcttaatttaggggtttctaacggagacatttgtacttggttttacttaaggttcttgtaatacagttataatgcataatatacaatacatatatataatataatatataatgcttcttataatacagtttaaacagaaaagaagcgctcaggtgaagaatacgggttctcctttcccagcccccagccccactctcatttccttctgtagcctgcccgtgagcatgtgcagccatgcttgtgacagatgtatggctcctctccccacacatggcatcacacagtattccagtgtcctcacacgtggctgcgcattagaacaacctgaggatgcacggccacccagggaccttgagagccttggtgtaaagaagttcagaaagtgcttcctgagcgtggaccatgggcgagaggaaatatgtgtttcatagaaaagggacgtagcggaataaccaaaaccaaacaagtgtctgttgcaggacttacgagagcctttagtatatactagtagacactgagaatctccaagagaccaaaagcgcagcagcatcccagtgctgagtgttcaatggcacatcctatagggttactgcagggctgccctcgaggcctcaaccctcagagatacaaatccccaggcttcctgctctgagcactaacagtctttcccactgtggctctacatctgctccctcaagctgagttctccctgagtggaggaactgcccctgtctttctcatctggccttaagtcctctgcggtcagaagcacctattaagttactacaccttgtttgtttctttgtttctttgtttgtgatggagtctcactctgtcacccaggctggtatgcagtggcatgatcttggctcactgcaatctctgcctcctgagttcaagcaattctcccacctcagcctcctgagtagtcgatgggactacaggcatgcgcaaccacgcctggctaattttttttttttgtattttttttagtagagacggagtttcaccatgttggccaggctagtctcaaactcttgacctcaggtgatccacctgccttggcctcccaaagtgctgggattacaggcaggagtcaccacacccagccagtttctttgtttaataaagacggagtctctgtcacccaggctggagtgcagtggtgcaatcatagctcactgcagccttgaactcctgggctcaaggaatcctcccacatcggtctccttagtagctgggattacaggtacacgccaccatgcccagctaatttttgtattttttgtagggacgaggtcttgctatgttgcccaggctggtttcaaactctttttttttttctttttttgagacagagttacgttcttgttacccaggctggagttcttgttacgttcttgttacccaggcagtggcgcaatcttggctcactgcaacctccgcctcccaggttcaagtgattctcctgcctcagcctcccgagttgggatgacaggtgtgcaccaccatgcccggctactttttgtatttttagtagagacagggtttcaccatgttggccaggttgatctcaaactcctgacctcaggtgatcctcccaccttggcctcccaaaatgctgggattacaggtgtgagccaccacacccagcctagctgttctcaaactcttgagctcaatcctcctgccttagcctcctatagtactgggattacaggtgtgagccattgcacccagcccaccacacctgttaataaaaggagatctctgcccctgccccctggtttgggttttgttattttttttttttactgctcatttgttaatgttactttagcagcccacagcttcgcccttatgggttgagccatggcagccgcatcaccctcaggctcctcatcagcatactggcttccgaggtccccagcaggtgcttgtggagccagaggccagaggctgaggcgggagtttgttctgggaaacagacacctcagactggctctttggtttgctctggggtttggaagctgctcactgcgagtcctagcgcctgacacatgtctctagcccttgctgcttccaaaccccgtagcagtaacaggctgcctaacccgtcctcccagggggctgatcctgcaggacctgaccttcgttcacctgggaaacccagactacatcgacgggaaagtgaacttctccaagcggtggcagcagttcaacatcctcgacagcatgcgctgcttccagcaggcgtgagtgccactgccccggggggaccaggcagagctgagccccgggccacacacaaggagagacagcccgggacaccgaggggagggggagccacagaggacccagggacctgccactgctgagatatagtccgggcccttcagtttctgccaggatgacttgagagcatgcccaccaggctccatgccaggcctagcctggccctgggcctggaccccgtgacagcacagctcgtcctcccattttacacaccagaagctggtgcccaccttgctgtgagaagggcctgacaaaccctggcctgcctgactctgaggcaccagagctcccccagggcgggccctggcatgcgttgttgggggcagtgggatcacctggggccccctccctgtgagcagcccagcctcagggccctgtttgtgctccatgtgctggtggcaccgtctctgagcactggtgtcccctctgtcacattggtcaacggtagcccctgcagcatccgtttgctgcgaggctgtggggatggtccccgcggcaccttccaggagggtggcgccatcgggccatccagcccacacaggtgctcactgactgctccccatcccctgcaccaggcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccattgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacag

SEQ ID NO: 15579 - DNA, 16198 bp, Human; identical to SEQ ID NO: 11854

SEQ ID NO: 15580 - DNA, 71574 bp, Human
  misc_feature (1)...(71574): n = A,T,C or G
cgcccagcatcttttttaaaaaaaattgagacagggtcttgctctgtcacccaagctggagtgcagtggtgcaatcacggctcactgcaacatccacctcccaggctcaagcaatcctcccacctcagcctctcgctagctgggaccacaggtgcacaccaccatgcccggctaatttttcaaattttttctaaagacgaggtcctgctatgttgcccaggctggtcttgaactcttgacctcaagctatcatccggccttggcctctcaaaggactgggattgcaggtgtgagctaccacgcccggccaactatttttctttaaattacttttcggttgtcacttctctcaataaatattcatatgtttataacacctttctcttatctaaagagctgacctcaaccactcagggttgagtcgctgtgataaggtttgagggtgcctgaaatgtcatcatgattcgtcctttgggctaagctgaaacctagtgacttgtcaggtcaataaattaaggttatttcccgataatacaaacatttaacaccgtgaagtaggttttaggcaggattccctcttttccactgcaaaggagaggtaagttcttgctgaggtgatcgaagtcctagctggggcactgggaaggtggcgggacattggaacgtgcagtagttgcgttctggagtttactgaggctttcccagtgcggattccacgctacaggtcttagggcgcccctccctccgggcgtggcagcccggggcgtggctcctggcacagatccggagcagttgtcattggagtcattttctggactccagctccatgcttcagagtttcctaagttcagggggcttgtctctctgtcccctcgactaatttccctctgtcgctggcgctgcccggtgccctcggtcgcttgggccgccactctccgcgacttttttttttctttctctcgctggctctttcagcatcagtttccatagggggagggaagggaatgatatttgggggctcccttgccttcctctccgagccgcgaaaggggagacgcggggaggaggtccggccggctttgggctccagccagcggtccgcggagactttggtctccgaaggcctttgacgccgggcatttcgcgagctgcgcgcccctctcagccgcgccacctgcgcccggagttttgccgcgccacccgcgcccggagtccagccgcaccgcgctgtgccgagcccaggcgcccagggctccccgcccccgactcgacgctcccgcgctccccctagcggccgccgcgccgcttcgctccgtcccaggctcgtcggcggcgcagctcacgtgaccgcgctctgggcctgcggccgctgtcggttcccccagtcaccgagcgagagggaagaaacaagatggcggctgaaggcgatccggagtggggccccagcaattcggattgagccttctccctccacccgcttccgtcggccgggcccctcccgcccggccccgcgggcctccccacccggccccggcgctccccaccgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgacggcacatcaagtggcaaaaaactagatttacaagaggaaagaggcgcattgttcaaaatggagattgcattgttgcagtttgcaggccacactcgctcgctctctctccccccccccaaccccctttttttcctcttcaaaatttgtgccagtgcagtgtctccaccgggcaggattgaaactttggcaaacacatatccattgcattcatttttctccccttgttttggtgtggttttctggaatgaaagaagcctcttgttttgcaaacctctttgcatttctaatgtggtttctttcggatttttattatatatctgttacttaaaagggaattaaggatttggacagattgtggtacacaaacacgcacaaaaaaatgcgttttcacacccctagctgtggttttaaaattgtgttaaggaaacggatcatttgggttagtaggggaaccttatctggtcctgtgtgtttgtttttattcttcgagtgctaatgggcccgtgcaacagttgctgttaaatggctgattaaaaagcaacgcagaaagccaaacaagacccaaccaaatttggttattcatccgattcagaattattttggttaaatcaaaaataaaagtacaaaactacaggaacgcgcgtcttaactcatttgatcgctttgccttgcttgggaaatgcagtttcgtgtcacctgttgcagaagatatgtagttgatcatctagacataattgccgaagatgaacttctggaacaacttctaagtcacacggcatcagtatcagatttattacacaacgactttttcttttcactctatttctgaggaaaaagccctcccgaaatccgtaatgaatttctccatggtaacccctcttctgttttctcacagaaagtttctctaggctggtgccgagatgcatttggtgaaacacccccggccccccgcaaaaggctgctttgtacatagtcacaatttactaaattgtgaaattaacataaccaaagcaacaaccggcaagacttttcctttataattttgcaaatctagattaattaaattagaatctggttttaaaagcctttaaaaaataaagtttatgagaaaatatttgtgaggaaaaaagaccttttttttcgttgaagtaaggtgtgtcatgtctttctcagagagactagggtagtagaagtggttaacttgaaaagtttgattttaataaatgcttaaatacttattggagaagtagggtagtattaagccaaatgtgaacccacataggttgtcctaacataactgaaaaaaggtaatttcttttgcccagtggtcagaatcgttgccagtcttgtccggggcaggctgtctggtgaatgaagggaatgaatcaagtgtcaggtatttatgtcttatatgtagaaaggactacatgtaaatccttgccaacttaattttagtactttttttttttttttttttgagagggagtcttgctctgtcgtctgggctggagtgcagtgtcctgatctcggctcactgcaacctccgtcttccagactcaagcgattctcctgcctcagcctcctgagcagctgggattacaggtgcccaccagcacacccggctaatttttgtatttttagtagagatggggtttcaccatgttggccaggctggtctcgaactcttgacctcgtgatccgcctacctcggcctcccaaaatgctgggactacaggtgtgagccaccgcgcccagcctagtacgttttttatagtaataatttttaccttaagaaatcacatgttggtcttctttgcacccagagccggtaattgaaacacggagactgaattgcatacacccctggaggaagttttttctggttaaaaagagctgagacattttggcaggacagttcagctaactttaagtcctattcgaaggcatagcaaataatatttaagattgatgggtgtgcatatgctgacttaaattacaatttgtagctaggtgtcctttaagaaaaatgtgtttacttttgatacttttgtgacattttgtttttctttttttgagaaggagttttgctcttgctgcccaggctggagtgcaatggcacaatcttggctcactgcaacctccacctcctgggttcaagcaattctcctgcctcagcctcccaagtagctgggattaaaggcatgcagcaccacgcccagctaattttgtatttttagtaatgacggggtttctccgtgttggtcaggctggtcttgaactcccgacctcagttgatccacctgcctcagcctcccaaagtgctgggattacaggcatgagctaccgtgcctggtctgacattttgtttttcttaatgacacttgtgtctacttgtcttatccttatatgaaattattaactccttagagataagtattgagcttattccccctgcagctcctgtaacagagttttgcacatagcaggtgctcatcaaagattggttggataaattattgttagtagataagaacttgtaatagatgaagttttgataactctacagtgggtgtcataatctctaaatactttggatttaggaaactaaaaattggtctaattgttttttgtttttgttttttgttgttgttgttttttctaattggtttttgatggacaatttgatcagtgaatgtttttttttttttctgtgaacgtttttcattgcaagagttactttgtttttgagttgctatttcatattgcttgccaggcattttcctttattggctgtgatgttaatttggatgctttaccttttgcaacacattatttttaaagattatggtaaaatagatgtgacttttttttttccttatctcttctaaaaaaaaacgggatacatgtgcagaacgtgcaggtttgttgcataggtatacgtgtgccatggtggcttgctgcacttaccgaccggccctctaagttccctccccttgccccccaccccccggatgtgacattttgagttctaaacttttagaacatgcccacttgcctggaatgagtaacaatgcatgacagtgagttgattaggctaagtaccagtttcattggttttttagtctgtacttcctggaggaaggctgtcaggtaaatgtgtagatagaagaaaaaaagttttagaactggtttaagatatccgaataacacataaagaagtatgattgatgagtttgaatcctgttgtactgtgaaggctgaaagaggaatttaccttattggtaatttagagtaatttgattaatttttatagtttacagggttggtttaagtactgacgtgacattcctaacataagaaatagctcactcctaatacaagaaataactcagtattttgtaggtaatgtaacaatgcaaagacattagttgacattactaaagtcatgaaaggtttattcattgaagattgttttccttttatggaaaaaatgtaaggatgccaactttttagtataaaattgaaatcacctagttttgcttaagctaaaggcatatcgctgaataatgctttaattcatttttactttttaaatttagacttacttcagcctataggttttatgacattgccaatatactgagaaggattgtataggaagtgttttcaataggcatttggtaaggttctgacagcactttgaaattaagcatttgctaattttaagaaattatatttaaaacagaatggttcttgtgttgcagtctcagtcttgtgtgagacttctgagaatacttacctggaattttaaaacttggaacctctgataacttcatgaaacaaaaaccctggtgttaccctgggagagttagtgatttatgtcctctaaggattgtgacattggagatcagtggcagagatgccatgaatgaaccatagattcaaattcaagcagaatttgtcactggtttgacaatattattcctatcagtgtcaatatcttttcagtataatttctgattgctgcatgcgaggtacgcagtgcagtgggcattttaaggagggcgagataatataccccatttaaggggattgatgtgggcatacacttcctggatgggcatgtggagagtaaggaaaggcagattgagggagggagggagggagagggagcgggagcgggagggagcagcaggcactgatagtaaagtgtgggcagtctcaagtaactcggtttagcaagagcctgagtgtgtgaataggaaataaaccaaagctcctttgtatgctgtgttgggcagtacctagaggatcaggctatagcaactgtactttcccccttttctgtagaatagggattgggctggattgtgatcctcagccctttttcactcctgaacacccagaggagttatgttgtattcccagcagcaccatgcacaaacatgaaacagaaccatatcaaatcacagagatgctgttgaaccactggtgtagctgtttctcccaaattgagagaattactggggaaatggcctgaagctctctctctttcacatctgtttaattttgggtattgggatgatcggaagatcttgaaagagtggggtatgatttcagagggatgccacgaagtatagcttagattctcttctgcaggatggattgacaaggacgagatagctggtgggttttgtagccctggatggaagatcagtccaggaggcactttagagttcttcaggccttgacacatagatgtgtagagagaggaatgcattacatatgcctccctaagaatggtagcactttcagtaacaatggggaggtcaagattataagggaaattaatgacatctgttttcagttatcagcacctcaagaggttaaacatgagaattaaacaaaatgagagccaaaagggttatgaaaaagttgggcaatatgatttgtgagtagtagagaggtgtgtcctaggtatgcattaataaatagtcttgcacacagttcgtgcttttctattctgctcacccacgggcgtgtttggaagtttgtattgaaacatgcgtatcacaggactggggatgttaagaccaggaactctggtctcttctgttaggtcctcctttcctctttcctcaagaccctgtgtcttccctttgactaaagacccttaatggtggagacatgggggtgagagactggtagtcatggtgggcaagtagtattctgggtgacacaggagcaaatcctagctgatgcccttttcccttcctgctccttagccaggctggaatccctcttcctgggagatcttccctgagtcctgttttgcaccttggtcttccttctctttgagtgcctgcttacggtggttatgatctcagcactagcttaatgctgacactgattattctaattttatttatttatttatgagacagagtctcactctgtcacccaggctggagtgcagtggcataatctcggttcactgcaacctccacctcctgggttcaagcgattctcctgcctcagcctcccgagtaggggactacaggcgcctgccaccacgcccgtctaatttttgtatttttagtagagacagggtttcaccatattggccaggctggtctcaaactcctgaccttgtgatccgcctgcctcagcctcccaaagtgctgggattacaggggtgagctgccgtacccggcctctaatttttttcatgcttttggttttttaaaatgataagcctcaggaggcagcatgtttcttaatttaaaaaaaaaaaaccacttatacattaaaatgcactttaaaagatcgaaggtgaccgtatagaaataattaaaatgcacgtaaatataattataatgttttaattgttttgtctgctggtatatatctaaaatttttatgtttttctagatagtaagttatattcaactattattttgtgattgtcacattttaaaaatagtgacagtaatagctaaatttattggacatcttctgaattgctgaatgattttcaagcaatatttatgaaaattcagtttttaaaaggtaacagctgtatggagatataatttatatactgtaaaatgtacccttgtaaagtatataatttagtggtttttttagtatattgacagagttgtgcaaccattaacactacctaattccagcacgtttttatacccccgcaaaagaagcccgcaccgtcagcatcactccctgttcttcacctccctcctgctcatccctggcagccactaatctactttgattccctgttgattcgcctcttttttttttttttttttttttgaggcagagtctcgctctgtcacctgggctggagtggagtggcgggatctcagctcactgcaacctccacctcccgggtttaagcgattctcctgcctcagcctcccaagtagctgggattacaggcacctgccactgtgcctggctaattttttgtatttttttttttttttagtagagacagggttttactatgttggccaggccggtctcgaactcctgatcttgtaatccactcgcctcagcctcccaaagtgctgggattacaggcgtgagccactgcgccccgcctgatttgcctcttatggacatttcttataaagtggaatcatataatatatgtcttccatcatttagcctaatgttttcaagcgttatgcatatcttaacatgtatcagtactatatttgaataacacttcattgtatggctatacagccttttttttttttttatggagacagggtcttgcagtgttgcccaggctgacctcaaactcctggactcaggcaatcttcctgcctcagccttccagcctccagagtagctaggattacaggcacacatctctgtgtccagagaccatgttttgcttatccatttcttaagttcatggacatctgaactgtttccactttttggccattaggaataatgctgctgagcacattcgtgtacatgtttttatctgtacgtatgttttcatttctcttgggtatataactaggattatttgctgtattattgcaaattcagttttaatttctttcttttttttttttttgagacagagtctcttgtcgcccaggctggagtgcagtggcatgatcttggctcactgcaacctctgccttctgggttcaagtgattctcctgtctcagcctcctgagtagctgggactacaggtgtgtgccaccatgcctggctaatttttgtatttttactagaagagggtttcaccatgttggccttgcttgtcttgaacttctgacctcaagtgatccacccgccttggcctcccaaagtgctgggattacaggtgtgagccaccgtgcctggaagaaagtaattcaggagttagaatgaatccttagtgatagattggttaggctgggatgtggtgagtgggagaaaaggattcaaggatgaactgacttctgaatctcccttatttctcttttccttattcactccttatttcttctcttcatctcgaatggatctagtaatactgatttctttgtagttctcacacacctaactcctagtcatccatccatcaccttctccagcctgccttctctgatcaccattccctttaccgccaggtggggctaagttcctgtgtttcccacccgtataacctccaggaccatgtgcattaagtgttttagtttccaaatatttgggaattttttagctatccttctgttactgatttctaatttaatttcattttgttcagagagtatactttgtatgactttaattttataaaacatttttagaggtttgttttgcaccccaaaattttgtcagtctaagtgaatgttccatatgtacttgaaaagaattttgtattctgctcttgttgagtggagtattgcataaatgtcaattaggtcaagtttgttgataatgttactaagatctgtctgactttctgcttgttctgttgattactgagagaagtcttgaagtctgcagctattgtgaaggatttgtctgtttctccttgaagttctagcaatcttcatgtattttgaggctttatattcatgtattttgaggctccttcctaaagtccataaacctttaggaaggattattttatcctcttaattatttaacccctttatctctatctttatctgttaagacatggagctgaaatgggcttttaatatctggcccttctttaattacaacctactttgggcagggacagtctcattcagtctctgtagtgcctggttcaatctcttgaatgcagtaggcagcacaagtaattgtggaactgaatgatgagtcaaagaaagcctgtggattcttttcacgctctatactgtccagtatggtagccactagccacatgtggagagttaaattaattaaaactaggcaggccaagcgtggtggctcatacctgtagtcccaatactttgggaggctgaggtgggaagatcacttaaggcagcagttgaagactagcctgagcaacatagtaagacactgtctttacaaaagaattaaaatagtttggcagaggttggcatgcctgtagtcctacctaattgggaggctgaggtgggaggattgcttgagcccaggagttagaggccctagtcagctatggaccatgccaccacactccagcctgggtgacagagtgagaacccatctcttaaaaaaaaaatttaagtaaaatgaaaagttagtttctcctgtggcactagctgttatatgttcatttcaagtgctctatagccacatgtattgcaccacacaaatgtagagcatttggggcatttcatatcattgcagaaagttctcctggactcattgtagtcagtctgcctctgttagaccagggggaatttacctaacatctctttttctctagccttttatttgccctaaatcctgcacagcttgggtagccccagcactctggctgagtgaagtcctcctttgtggagactctgggcccagcattatttgtgtatgtgatggtattgcatttctgcaataagatttggggtcatgtgtgagatgactttccattatttgttgtccttggtggtagggtgaagaggaagttaacatgtgattagaaaatctgccacagtcctggtaattttttttttttttttttttgagacggagtctcgctctgtcgcccaggctggagtgcggtggcgcgatttcggctcactgtgagctctgcctcccgggttcacgccattctcttgcctcagcctcccaagtagctgggactacaggcacctgccaccatgcccggctaattttttgtaattttagtagagatggggtttcaccatggtagccaggatggtcttgatttcctgaccttgtgatccgcccacctcagcctcccaaagtgctgggattacaggcgtgagccaccatgcctggcccagtcctggtaaaattaagctaaaagttatatatataggccagaagagaaggaaggattaggattcagagacttttggttgagaaattaaatttgataattcagagaatttcagtgttataaaagtgtaaaagctgatatgcaaactgaattgcgagatgttagtatgtcctagtgtgtctgggttctcctgtataaaacgtcttaggagtcactggccaaattatttatctatggaaccccctgagatttgctaagaaagttatacttagacttctttctactcatggatatgttctgtaattcacacgcttgggaaacggcatggccatgtgattcataccaaatggcaatgttcagtaggtgcagtttatatattttactagaaatatggcttcttgctcgatttcagtatgttcatagtgcctcttttgaggtctgtgtatagtatatagtatattctatttatggaagttaagaagtatttcagaaatgcatgtattaatctgtgtggaatttctcttgtcctgttctaattcttgcatagatacttgtctcaagagatggtccaacatttaaaatagtgaatgacatcttagctcatcctaaaacaatcctttctaaaggtttatgaacttattcatagagcctcaaaatacatgaggactgataaaactccaaggagaaacagacaaatccttaacaatatcgtagacttcaacactcttctcacagtaatcaagagaacaagtaggcagaaagaaagtgcagttttctgtttttgtagacagcaaaattatttcacacacttcttaaagtcttattcagtaagttactcatttctccaccttatgactgtactgtgctttcaaagtgctgtgcaaagagtaaaatgttttaaggtggttttactgtaatttcacatacatatttgaacttttgagtctgaattatccaggtgaaatgcattggatttctgatcctctgtaaacttggaagattaccttcttccaggtatattggttttccttaattgctttaatagcatgagttgtgaatcttctctgtgtctcagaagaaacctaacagtggagattgtttatggcaagggtcacaaatttacatgctcaggttaggaccctctttaaggtaaagacatgaagtgcccccctttttattaatacataactgcatttgctgataatattgatttgccttaaaaaaactagtcctattgagaattcaggctctttttgcgtttacagacagtgctgtcctgaatgtgctagagatgtacctttagtcacttaagctggtgtttctgtagggtagattcctaggactgggattggattgttgcattatagtgtgtaccatttaaaagtctggaccagattatactctcaacatctgtttttaaaccttccctagtctgtgcttatgtgttttgttttttttttttgagatggagtcttgctctgtcgcccaggctggagtgcagtggcatgatctcagctcactgcaacctccacctccttggtccaagcagttcccctgcctcagcctcctgagtagctgtgattaaaggcggacgccaccacgcctggctaatttttttgtatttttagtagtgacggggtttcaccatgttggccagactcatctggaattgctgacctcaggcaatctgcccaccttggcctctcaaagtgctgggattacaggcgtgagccaccgtgcccagcctatgtggttttaaattaactttttctagaatctactaaggtttactcagacctttagcaggtgttcttggatactgactaggcccagagtcctcttctcatcaatttattggcaaatacactcacttgcgatgtgatatgagaccctgagttttacctcccaaatggcaggatgtctgttttgagagtttcctggccaagtggtggaaagtaccatggaaatggagttcttcattgcttcttacttaacttgagtttggaccatagagaagtcattcttgtgtggacctcagtttactcacctgtacagtataggatggactagatgatctaatggtcaggggactggcaaacttgttcttaggttaccaattagtagatatttcaggttttgcaggccatctggctctgtcacagctgctcagctctgccctcatagcaggaaagcagccatagacaataagtaaacaaatgagcatggctgctttctaataaaactttatttacaaaaacaggctgtggctggccatagtttattcaccccatttttgagctcttgacattcattagtctgtgatttcgataattcgtttaggaaaaaggctttgagttttacaaataatgcttctgaaaatctagtaaaacctttaaattttatttttgcttcttctctttatcaggaaagtaatgtagaacatttagaaaacccagaacattaatattttggttcctctcattagttaaccatctttgtgtaaacatgtgtatgtacatacttttttttttgagctggagtatcgctctgtcacccaagctggagtgcagtggcacaatcttggctcactgcaacctccacctcttaggttcaggtgattctcttgcctcagcctccagagtagctgggactacaggtgctcgctgccatgcctggctagttttttatatttttttagtagagacgaggtttcaccagcccaggctggtgttgaactcctgagctcagtcagtccttcctccttggcttcccaaactgttgggattacaggcgtgagccaccacacccagcacatgtgtgcatacatactttttacaaaattggaagaagtataattcatttgctaaatattttcacttatgccatgaaatcagattttatctttgtgtataaaaatacctgctctgctggggcttctagttgaaaactaatgaattttaaaaattaatttagtatttagccacctattcttttttctaattgtttcttgtagcttttgctttgattggaataattttactctaggaataaagttgtgtcatctgcaaaaatgaatcatatgtacacatctgattttcttacatttgtatctcctttttctcttcaaattacattgccctctaccattgatgggaacctgggtaataaaaaaaaaagaaaaaaaagaaacaaattgcattgtgtaccacctccaaagcaatgttaaatgttagttataacgataggcatcttagtatgctttccgaatttaatggaactgatgcgaatatttcatggttaactgtgggtttgagaccttcaatgtgttgaatgtattcacctggttctcttttttttcctaagtttttttttaaaaaaaaatcagctatggctattgtattttgtcacatgtcatcttagcatcttttaagatgatcatatagtttttctcctgcaagctacatattaattactgtggtgtatattcatagaattatattagatcttataatattgatccacccttacattcctgcagcaaacctctcttgatcctactttttcatgtactgtttgacttttaaaaaggtattttaatttttaaatagtttatacatgtacagtgcataatgtatttgagattcatctatgttgttgtgtgtatcagtagtttctttattgctgagtagcagtcccttatatgagtgtatcacagtgcatttatccattcaatagttggatatttcagttatctctggtttttggcaactatgaataaagttgtcctaaacgtttccataatggttttgtatgaacacaatacttgtttttcttgagtaaatacctaggagtatgatttctgggttgtatgtttatgagaaactgccaaaactgttttccaaagtagctgtaccattttgcattcttacctgcaagtgtatgaagagttccggttgccctgtatcctccctagtacttgatattgtcagttttttttttaaaagacaccttaataagtatatagtgatatccccttctggttttaatttgcttgtccctaatgacaaatggttctgagcctccttttatgtgcatctttttatttgccatctgtataccattttttatggaaaaatactgatttttttttttttttttgagatagggtcttgcttgttgcccaggctggagagcaatggcacagtcaccactcactgcagcttccacttcctagcctcaagccatcctcccacctctcagcttccccagtagctgggatttcaagtgcgcacctccacagttggctaattttttatttttatttgtagagatagggtttcattatgttgcccagactgatttcaaactcctgggctcaagcaatccacctgcctcggcctctcaaggtgctgagattacaggcatgagctgccatgcctggccaagataccaaaatctttatttaagatgtttaattgggttgctgctgctcctcttgttgttgttgttgctgctgctgctgctcctccgcctcctccttcccctcctccccccttcccccttttcctcctctccttctcctcttcctcctcctcctttctatttttttagacagtttccttctttcacccatgctggagtgcagtggcatgatcttggctcactggagcccgtcattccccgcctacccaaggctcaaggtgatcctcccacttcagcctctgaagtagttgggaccacaggcacatgccactatgcctggctaatttttgtatttttagtagagatggggtttcactatgttgcccaggctggtcttgaactcctgagctcaagcaatccgcctgtctcggcctcccaaagtgctggaattacaggcatgagccaccatgcccagccaatttcttattattgagtagtaagagttctttatatattttggatataagtgctttgttaggctgtgtgatgtacatatattttctccctgtcagtgccttgcgtttcattctcttaacagtgtctttttcccagagcataagttttaaattttgataaagtctaatttaccactttttttcttttacacatctggggttcgtctaacaactctccctaatccagagcttgccagatttttttggtaaaaggtcagatagtaaggccaggcatggtggctcatgcctgtaatcccagcacttcgggaggccaaggcaggcggatcacctgaggttgggagtttgagactagcctgaccaacatggcgaaaccccgtctctactaaaaatacaaaaaattagccggtcgtggtggcacatgcctgtaatcccagctactcgggaggctgaggcaggagaatggcttgaacccaggaggcggaggttgcagtgagtcgagattgcgccattgcactccagcctaggcaacaagagcgaaaatctgtctcaaataaataaataaaaaataaataccactatttaatactaatataaaattagtattttatattagcagtaatataatactttttttgactagtgatagaatgacatatctttttctacccttttgcttttaatttatatatcatgatattcgtctattgtttaatttgtgaaaataaagatggggttttgccatgttgcctaggctggtcttgaattcctgggctcaagcagtccacccacctcaccctcccaaaatgctgagattacaggtgtgagccaccatacctggccatatcattataatttgaaatggtttcttgtttgtttttcttttaaatttaatctgacagcctcttttaattaatgtgttttggaccatttacatttaatatgattgataatgattggatttaggtttcctattttattatttgttttctgattatctcttttttgaggggtttcttctgtttcttttttctgcctacttttggattaattgaatattttttagtgttttattaattggcttttggttatatctgtgctatgtttttgctgtaggaattacaaaatatatacctaaactatctacttagagttagcattttacctctaaataaaatgtaaaataaaacgtaaaagtattgcaaccatacaggtttctttattctagcgcccctcccttatgttataattgtacatatgtgtatatatctttatacactttcaatatatgtagatacatatagatatgtatctacatatgctttcagtgtatatctatatgcatacattgtatatatacatagacatatatctacatacattgacagatatatatctacatacatatacaatgcatgcatgatacctttggccactacatccttcttaaatttcctgttgcaactcatgactcaatttccttgaccagttactcctccttcagacatccctcttacatgtgatagtcctcagcatttagtttccccaactttcccctaattatcagttgtctgagttaccaccataatatcaatgacttctagatccacttttcttcttagacctctcctctaaactccagttatgtatttccaactttctgtgctgtcccagataaactccacattgtaggaaataaaaagaaaggagttataaaagtttaggttcaaagcaaaatttagaaactcacaaacgagacaaagattttttgatgacaaaggctgtggtccacaatgaaaatataaaacatgtctctataaaacatatatgtgatagagactgtccccaactttaagcctttcagtaattcatgtaactgcagaacatctttaaagtactgagagaaatgtcaatccagaattctgtatccagcaaaaatacccttcaacaattaaggccaaaaaaaaaaaaaaaaaaaaaagacatttcagatgaagaaaatctaagagaatgtgttgccaaaagttctgctgtaaaataaatataaaagaaggtctttaggccaaaggaaatactagaacttcagagataaagagcaacagaaatggtatctgggaaaatgtaaaaacacaaacagttgtttcttaagctctttaaaatatgtatagtggtttaaagcaaaagttataacactggtgagactttcaatgtatgtagatatatatgtagatacatatatctatatatatgtagatgtatgtagatatatacctatatctacatacatataaatatatatctacatatatagatacatatagatatctacatacatctacatacatgtagatgtatgtagatatatacctatatatctacatacatgtaaatatatatctacatatatggatacatatagatatgtagacatagatacatatagatatatatctacatgagattgagtctagctttattgcccaggctggagtgcagtggtgtgatgtcggctcatttttgtatttttagtagagatggggtttcaccattttggtcacactggtcttgagctcctgacctcaagtgatctgccctcctcagcctctcaaagtgctgggattataggcgtacctggccttacatgagactttgaatgtatgtagatatatatctagatatatatatagtataaatatctgtatatatctagatatatatacagaagatatatatctagatatatatgtataaatatctgtatatatctagatatatatacagaaaagcttagttaatgtctctgtacgcacctttactatagagcagttctatcacctttgggtgtgagggtggtcttttgtgataatgagatttttaaattgtctggagcagttgtcttttttttttttttttttttttttttttgagatggagttttgctcttgttgcccaggctggaatgcaatggcgcaatcgtggctcactgcaacctccgcctcctgggttcaagtgattctcctgcctcagcctcccgagtagctgagattacaggcatgtgccaccatggccggctaatttattattattagtagagatggggtttcaccatgttggtcaggctggtctcaaactcctgacctcaggtgatccacccacctcagcctcccaaagtgctgggattacaggtgtgagccaccgtgcccggcccccgcctttttttttttttttttttttttttttaagatggagtctcactctgtcacccaggccggagtgcagtggcatgatctcagctcactgcaacctccgcctcccaggttcaagtgagtctcgtgccacagcctccggagtagctagctgggactacaggcatgcaccaccatgtctggcgaatttttttttttttttgagacggagtctagctctgttgcccaggctggagtgcagtggcgcaatctccgctcactgcaagctctatctcctaggttcacgccattctcctgcctcagcctcccgagtagctgggactacaggcgcccgccaccacgcctggctaattttttgtatttgtagtagagatggggtttcaccgtgttagccagtatggtctcgatctcctgacctcgtgatccgcccgccttggcctcccaaagtgctgggattacaggcgtgagccaccacgcccggctaattttttttttctttttttttttttgtatttttactagagacagagtttcaccatgttgcccaggctgggctcaaactcctgagctcaggcaatctgcccatctcggcctcccaaagtactaggattgcaggggtgaaccactgcgtccagtctgttgccttacagtatgtctcaccatttggatttatctgatttttttatttattttttttgagacggagtttcactcttgttgcccaggctggagtgcaatggcatgatctcggctcaccgcaacctctgcctcccaggttcaagcaattctcttgcctcagcctccctaggagctgggattataggcatgtgccaccacgcctggctaattttgtatttttagtagagacagcgtttcttcatgttggtcaggctggtcacgaacttccaacctcaagtaatccatccgcctcagcctcccaaagtgctgggattacaggcatgagccactgcgcccagcctgattgttttttacatgcatagattgagtttagtatacttgtgataggaatgctgtataagtgcacgtctcctcctcagcacatctcatcaggaggtgcaccatcaatttgttccattattgatatagatcacttggtaaaggtgacatgtgctagaatcatccctgtaaaggtatctttcacctttgaaagtagtatttatctgtaaggtgattctttgagaatatcctattgcccaacaacctttcacccagtagttttaggatctgttgatggttcttgcttgaatcagttacacctctgattgcaaatggtgacttctctatttctatcatttctttgttaattatctggcatttgaagacatctccctttcttcctctctccctttggagtcttactgaagagtggcctcgagttcttttattattcattgtgaaaaacaagagggcaggcatggtggttcacgcttgtaatcctagcacttggggaggcccgaggtgggaggattgtgtgagcccaggagttcaagaccagcctgggcaatgtagggagaccccatctcgacagaaaatttaaaaatcagttgggcatggtggtgcatgtcttttgtcccagctactcaggaggctgaggtgggaggatctcttgagcccaggaggtgaggctgcagtgagctatgatagcaccactgcactctagcctgagcgacagcaagattctgtctcaaaaaatatatatattttattttatatatatttataactatgtatttatataaatgtatataataaaaaagaaaaacaggggatctttatgttacagtttttgagcccacattttaggaatgtttaccaaactatcctagagccatacttacttggggaaaaaactaaagaggtatatgaaagctatttttatctttcaaaggctaaaagacattaaatgagttcttaaactttttcgaagccaaaatttttctttatcctgttttgctactgaagcaaaattttttcttgaatatagggtaacattcactagtggttgatgaaccattgtatttagtggcaatcttctgtaaataaatctttcaaatataaaagaagttatcccattaaaataattataaaatagtccaaacattcagaaaagttttaaaaatataggctgggcatggtggctcacacctgtaattcccacactttgggaggttgaggtaggaggatcacttgggcccagcagttttagagcagcctgggcagcatagaggatactgaatgtattttagctttgtgttgacaacccagtgggttatttgaacttcacttattgtgtggtagtccctagatgtatctctagaccagggctgtccaatagaactttttgtgatgatggaaatattctgtatgtgtactgtcctgtatggtagccacgagacacatggctattaagtaagcacctgaaatttttgttcaggtctcatactttataacattgtcacttcactgatttgtctcctttatctgtcatttctcccacctgcacaataggcacttgttatttctcaaattccctttcactgagaggtcaagtcaggtggtttttaacaatatgggaggaagtctaatatagtagtaaagaccatagcttaggacttgtgtgggtttgtttgtttgtttggagacagggtccctgtcgcctagggtggagtgcggtggtacagtctgggctcactgcaacctctgccctttgggttcaagcaattctagtgcctcagcttctggagtagctgggattacaggcacacgtcaccacacccagctaatttttgttattttagtagagacagggtttcgccatgttggccaggctggtcctaaactccggacctcaagtgatccacccgccttggcctcccaaagtgctggaattacaggcatgagccaccaagcccagctggacttgtgggtttgttgttgtttttttgttttatttgggacctgtgttggttgtaactcttagtggtactggctgtgaccttggacaagtcatttagcctctctataaacatctttgaaaggaagtaataatggtatctattttatggagttgatctgaggataaaaataagataatgcactttaaaatgcttacttagcacaatgtctggcaaatagaaagcactctctaggccaggcgtgttagctcacacctgtaatcccagcactttgggaagccgaggtgggtggatcacctgaggtcaggagttcgagaccagcctggccaacatggtgaaaccccatctctactaaaaataataaattagccgggcgtggtggcacatgcctgtaattccagctactcgggaggctgaggcagaagaatagcgtgaaccggggaggcagagcttgcagtgagcagaggtcgcgccactgcactccagcgtgggtgacagggtgagactccgtctaaaaaaaaaaaaaaattatccgggtgtggtggtgggcacctgtaatcccagttgtttgggagtgaggcaggagaatggcttgaacccaggaggcagagcttgcagtgagcctagattgcgccactgcactccagcctgggcgacagagccagactccgtctcaaaaaaaaaaaaaaaaagaaaaaagaaagcactctataaaagctagctgctgatttttatattattactgacacagaagatagggattgggggcaaatggaatgtactggaagagcataaccttgttcagtaataacgttaatgctagattgggacactattccacatgaaaaggtgaatccttgttacatttgacaactaagtttcataatttttaaaagatttcaatgcatcacaggttatttcttcttgatgtgccattcatggtttatatatatgtaacagtagattaaataattagattttattagttctggagtattaacttcggctggaaatgaacttcccccttctctataccaataccgagtgaggccactttctctcagataccaatcagaaataaggggacaatgttacattttttccttctagaaacacacattatatagagagttgccttttgaggtctagaagtctgaaaacactgtaaattcttttttttttttgaattagtacaataaatgtaggggtcaactctaaaaaatcgacagtggtttctgggatttgatcttggcatgactttacccctgcatctctgccctcggcaggtagttttgtttatgggtgtcattggttgaacaaatatttttttagttgctacaataactaaaacatgatctgtcctctaaaggagtcaacaaatgagccagggggcatgagtaattgcctgtaatataattgtgctcacgctgtcatggaggaccgtacaaagtgtcagaagcacagcacctggaggcacagcaaagggtagtagaggtgacatttgagcccggccttgaaaactgtctagggtttctcagaatttcagcaaagtaaggcaatttctgtctaaaatatgtaggcaaacttttttttaaaattaaaaatatgagaaattaattaacagattatgactacagtgcgtatttaaaaaccaaggcatgatgagtgctgttgaccagttcatccgaacagttcagagaagagaacatccatgtagatcccttttgtgttacagaatacaaaggagcagaaaattttgtctcaataactgccaggtcattctaattagaatacctatacattgtaacataattactccgtcgaggtaataagctatcaggtggtccagagtttgccattcagtcaggaaattcactcccttaacctagactgtgctggaaattcattgacaaattttgttctttgattctccatttttcttcagaattcatgcagaccacttgacttccttagcagtttcttttgtgggcgtacattaatgtctttggttaagcttcagcttccctttgcatcaatcctgttgtaatcgtgcctcctgaggcatctttttgcttcccttgcatgagtttccaaaaccctttctgcttggtaaggggagtatccattttctttaaagtagtggttttcaaacttgccgcacatcagaatcatttggggagaaggataaaaatatagattactgagcttcacctggggttctgtgaatttgggttgcatttgagattacttttaacaatttaccagatgatttttgctgcacctccatttcagggcagcttttcaaacttcagtgaccatataaatcacctgaagatcgtgagaaactgcagatcctaatttagtaggcctgggcttgggcctgagattctgaatttctctcaaacatgataatgccagtcacttgtcgagtagcaagttttttgttttttattttttgtttgtttttccagtattttcatgacattcaatgaatagcaaggtttgaaggtaacttctggaatttcatctaatgtgtattaatttttacttatctggatcttagggaaaataacctatcaggatatagggaggtgtttctcagagtatggttcgccagaacagcacaacctgggaattgttagaaatgcaagttctcggctgggcgtggtggctcacacctgtaatcccataactttgggaggctaaggcgggtggatcacttgaggtgaggggtttgagaccagcctggccaacatggggaaaccccttctatactaaaaatacaaaaaaaattagccgggcatggtggtgggcacctgtagtcccagctactcgggaggctgaggcaggagaatcacttgaacctaggtgacagacgttgcagtgagctgagatcgtgccactgcactccagcctgggcaacagagcaagactccatctcagaaaaaaaaaaattcaggttctcagactctattctaggcctattgaatcagtgacatatgcactctgaagtttgagaaccactgttttaaggcttctcactgtagtcctgtatttacttacgtagaaatcaaaacacatttctaatgttgtcagataatgcaaggatatcattttcttgtgtaagtgcatgggctagcactttcaaaactactaattcttgtaataaatgtttatttaatagcttattatatgctagccactacttaacattggcaaacttaaaaaatccctgtcgttaaggagattatattctagtggtgatattaactactagttcatgtatgtattcatccgtaagtagtatataaactgtatttccatggttttatattgtaaaacttaacttttcttttgcctcatggtgtttttgtttgtttgtttgttttctgagacagagtctcgctctgttgcctaggctggcagtagcatgatctcggctcactgcaacctccgtctcctgggttcaagcggttcttctgcctcagcctcccaagtagctgggagtacaggtgtgtgccaccatgcccagctaatttttgtatttttcttagagacggggtttcaccatattggccaggctagtccggaactcctgacctcgtgatctgcccaccttggactcccaaagtgctaggattacgggcatgagccactgtacctggccctgtgtttttgtttttaagattgatccatgttgatatgcatagccctaaattactcaaaattgatctacagaattctatccaatgaataagccacaatttgactgttttcctgttgatggacattttggttgttttcagcttggttgattgtttctttgcttttataaacatattaaatgctctgcattgttctgtgtgggaaacatgctaggggagaagaaaagacacacacacaatacctttaagggtaaacaagctttatcccatgtaaatggcaatgcagatataataaacaaatgatataataagcaaattgatacaataagcaaattgtaatggaaagaggagaagggaaaagaggtatatatatttacactcaccagactatggaggattcatcaccagactgggaagcaacagcctgggctccagagtcggccacttatctgtgcacagacaaggagaggtctcatgaagcttcggcagagtctgggaccctagctctttttgtaacgagttgtttggcatgaggtccagtcacaaggggccttcgtgactgggctcaaggaacacaaaaaggtcaacttgtttttgcgattttctgcttttttttttttttttttaataaccaccatataggaatagactgaaatagagatttctctgaaacagtgctggatgaacgcctcaaggggctcacacaaccttttccaagacttggtgaccattgtttgtgtgcacgttcaattgagttcagatttaatatttaacttttcctccacatgcgtatgcataaggatagtttctctagagaagtgtttttctaattgtgagctgcaagcagcatgttttaaaagtagaaagagaatagaatagaaaatgttggtaggagagaagatattagtataaggcatgtagtgagaatagtgttttatagagcttttgttttcaggggtatgtgtactggataagatgtaaaatatatttcttactttggttgtgggcaaacaggtgtgcaggctgttcagttataagcagaaccttaaacttgacaatcctgaatttctctctgaagttgtgataccagtttacagtcccagtggtggtatactggtgtttccattgttttgcatccttcccaacagtttgtttggttaaactgttaaatttttttccattgaggagtctgagaacagttatctcattgtggttttactttgcctttccttgctaactagtgagattggggtccttttttttttttaatgcaggaaaattaatataattcacctggtagagagataccagattagtgttgaaattgataatgagtgtaatgctcagtggcatattctaaatacacttctgtgaagaagtgaaatgacttgacttgctaatactaatgattgacagttgaggggcttaagtggtttaatttaatgtcgttctctctttaaacactgtagtctatgttcaattctataaacttgaatctttgaatttagtataatgacgttgtatttatacaagactatgagtagtcattagtggcagcatcattttattgatttgagtattaatatttttatatttttatagatacctgtccaattttttcttttaaaattttataacgaaaatacatgtatgaattattttttaaagtataaaaaagtaaaaagaaattagtcttcttttcctgtcccccgactctccccagaagcaagtactataaaaagattcttatatgacctcttagatatatatataccttatcactatccccttgccctcctttttatttttagtttatttattcaaatgacattctattcattgttctgtagctgttcattccttctgcttaacactgtatcttaaagattgtttcattttaacacataggaattttaccactactgaatttgattccattctgtagatgcatcataattcatttgactatttatgtatatttagattaaaaagaaaacccacataaaaatttcagcttttgtaaactatattgaattaaatattttgtacttaaatgaatgtgtgactacaggataagttccaggaggtggaattacagggtcaaagggacatacattcagatagatgtttgccaaattaccttctaaaaatccaaccaatttatactctcccaaaaatagatcagaatgggccgggtgcggtggctcacgcctgtaatcctggcactttggcaggccgaggtgggtggaccacctgaggtcaggagttcgagaccagcctagccaatatggtgaaaccccatctctactaaaaaatacaaaaattagctggggtggtggcgcctgcctgtagtcccagctactcaggaggctgaggcaggagactcacttgaacttgagaggcggaggtcgcagtgagccgaggtcacgccaccatactccagcctaggcgacggctgtaggtgattaaatgagatagatacgtttgttaaaaacaaaactctcagttatttatattgatacatttatatacttacatatgtatatctggacatcacatctcataattggagaacaggtatctaaaaagttgtttaactgactgttaagaaatgtagtctgttgtctgtttcctaggtaagccacttttcttttcccccagcattggaattcttctcttttctcctcctctgcacttccttcctttctgtcttcaccttgagcccatgcttcgctgtggaactccacttaggaggtacttctgacaaaaaaagaggtctgcactgggaacttcgtgtctggttgttgacaggcatttctgtattgcagctgacagtgtgagatctattgcccctactttgtgctgtgtatcttatgtgtaaatgttttttctcatttatattcttgtcaaatcattcacaaatgcagttatttattattattattattattatttccttagagatccttgttctgacactgttattttttaatcatgattacctgtgagcctgttaatctctctaggtaattgagaactgattataatttataatttttttacttctggtttataatctaatgggaaaactttgcatttagattttctatagatttaaaaattagagctgaatcattgcttcttcgtattattttaacttgacaattattaaagaaatgtacttatgtattttaggggggtatatgttcaaataggaaatttgtagaaatgatgtaatgtattgatttgtaatgatgtcacgtctttatctacaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatgtaagtaaatctggtcttaattttttgtatgcatttaaaattagactagtttccttcgtgattgatgtagcagagctatgctgttgatgtggtataaacctttgtaacttaatagttatacagttaaataatttcttaattgaaggaatatgtgcattaaaatagcttttaagaaggtaaaggaaacatatatgaaagaagcaaaattccattgttttttgatgcctaggctaggaaatagaatgtttctagttgggactgggcacagcagctcacgcctgtaatcccagcactttgggaggccaaggtgggtggatcacctgaggttgagagttcgagaccagcctggccaatatggtgaaaccccacctctactgaaaatacaaaacttagccaggtgtggtggcgcacacctgtaatcccagctactcaggaggctgagacaggagaattgtttgaacctgggaggcaggggctgcagtgagctgagatcacaccactgcattccagcctgggtgacagagacagattctgtctcaaaaataaataaataaacaaaaagtttctaggtggaatgccactgtgggcctgtttttggttatgttcctctatagcctagctcagctcatccacccttaactttggtgttagggttgttttacttcttttttggttttaccatatctgtatgtaaaatggaacagcaagaaaatacctagttgtctaaggaaaggtcagttctgccattattggttggaatcccccaggagaagatgatcccaacagactgagggtcatagtctggcctcagtgttcctgagggtttcgagaagctcttctgggaagcctgtgggcgaggtcaggagacagtctcagggtttacctcagtcagggcatcaggcagggttatagtgtggactgagtatctgacatcctgtagatatatggtcagagggatgggctactttgtgtcttcagcttctgaagtcttcaaagccctcttccagttcttagaattaggtcaaatgaaaaaatctggtaggatgaaatgaatgtcagagcagggcatggaaaggagagttgaaactttatcagtgtgctgtcgagaggtctgaatccacaccgattcttgattctttgtggctggaagcttacggaatcttcgctgtctatggtgttctgcagttttacagtgatacgcccttgtgtgggctgctttcatccacgaggtatttttggtgggcattttcaatctggcaattacgttctttgattctgagaacttctcttgacaacttcctcttttccctcttgtatttatcttgagctatgattttattgaacgttggacttcctattttggtcttctgactttcttatcatttctctccagttttcctctttgtctctttttctctttggggtatttgtatgtgttcagttttttaagatttccttatcttggtcgtccaaccctgttatccagtttttcctttctgctaccatatttttattatctaagagctcttttgtttttagaatcttcctttaaaaaaaatagtaaaatcctgtttctgtgtcttggatatagtattttctcttacctttctgaggctattaatgacaggtttttttctctcctctgtgcatggtctgtttcttctaagttgctttttcctattctttgttttggtttttctatttcatattcagatgtttattaattcttaattttctgctcctcattaacattgtggtactatgtagccagttggaagctctgagcaagtgggtgggccttatcaattttgacttaaccattggatgattttcattgtcttttttattgggggaaatccctcttgtcagtatcttgaggtctgtcctcgagagtaagctctagaggagcaatggcatggaagggccttttcctgtgtcctgcttgaagcatgaaggtcttgctggtggtattctggtggctgagtggtggaagaaagcttcatttattgtgcacacagcatttactacttgtattgtcacttaaatcctcagttttttgtacagtacctttgttcacaactgagcgtggtttctgccagtccagggaacctcagtttacctcctctagagactagacctttggcagcttgaaggggagaatggtggtttaggaatctgctccagccagttccctattctagagacacccctccttgttatcattgcgttttgaggattgtgttctcaacttcaccttcctttttagtttgagatcaggctttcttgggtctgctgaatcagtaatcacttgttcatctactttaaaatctttttttgttgttaccatgtctcccctactttatccttatgagttcgtctttaacaatttttttttttttttttttttttttgagacagagtcttgctctgtcgcccaggctggagtgcgagtgcaatggcgtgatctcggcttactgcaagctccgcctcccgggttcacaccattctcctgcctcaacctccgagtagctgggactacaggtgcccgccaccgtgcccggttaattttttgtatttttagtagagacggggtttcaccgtgttagccaggatggtcttgatctcctgaccttgtgatctgtctgcctcggcctcccaaagtgctgggattacaggtgtgagccaccgtgcctggacagcagattttttttttttttttgaagacaagatctccctttgtcacccaggctctggagtgcagtgacactatgtcggctaactgcagcctcgacctcctgggctcaagcagtcctcctgcttcagcccaccaagtagctgggactacaggtgtgtgctaccatgcccggctaatttttgcattttttgtagagacagggtttcaccatgttactcaggctgatctcgaacttgtgagctcgagccatctgcccttctcggcctctcaaagtgctgggattataggcgtgagccactgcgtctagactaacaatatttctttcttttttttttttttttttttttgagacagcgtctcactctgttgccccggctagagtacagtggcgcgatccttggctcactgcaacctccatctcccaggttcaagcgattctcctgcctcagcctcccaagtagctgggactacaggcatgcgccaccacacccagctaatttttgtatttatagtagagatggggtttcaccatattggccaggctggtctcgaactcctgaccttgtgatccgcccacctcagcctcccaaagtgctgggattacaggcgtgagccaccgtgcccggctaacaatatttctttagcatggttttaagaaggtttcaggagggaacaaaatgaaatctgtcaccttaacccagaaactgctgtgagaaacaatacttaaggttttaaatgtatattctgtgtcttttggtttggatcagatattttaagaaatatgtgtaaaatatgtgtaacttttttcttttcttgctcccttacctcccaaacatctggtcatggtattcattgtgccattttttgtttttgtctttgttttgacattttgctgttgaggtggtaacacggaaacctttgtcagcaaggtcattccaaatggtgaaataactgaaccacatttttaaagtttaaagtttactgctctcaggaagctgaggcacaggaatcgcttgaacctaggaggcggaggttgcaatgagccgagatggcgccactgtactccagcctgggtgatggagtgagactctgtctccaaaaaaaaaaaaaaaaaaaaaaagttactgctgtgttgtcattgtaagtggaaattcagtgatgctgcctgtcagggagcccggtgcttgtactctgtatagacattcagcagttagcaggtcacgttcacgcagtctcaagtgccctcctgaaaggagctcatagtcatcaggatggctgggaacaaattaggaagtaagtgaaatttagtccatgctccaattctcccattcctgtgccttcctttctgtgctgcttgtccttaccctttggatattcactctcactgcctctttctttccctgtgctgccctttttggccagatacagaccaaaggtgtcttgtccacatacagaaaaaccttgacatctttaaggctcattacacagtaatcagtggtataggtcttagtttcagagacctgtaaaatgaagtagttgtgataagttagtaacagccaagagcaacatttattgagcacttcatgtgtgcctcacagtgtcctaagcattttatgtattttaaaattaatcctcccaacagcccaataatgtaggtactatattttttaattattattttatttttaattaattaattacttttggagacagggtctcactgtcgcccaggctagagtgcagtggcatgatcatggctcactgcagcgtcagtctcctaggctcaggccatcctctcacctcagcccccctaggagctgggactacaggcatgtgccaccgtgcccagctaatttttttattttttattttgaagaggtctcactgtgttggccaggctggtctcaaactcctgggttcaggcaatcctttcacttcagcctcccaaaatcatagggttacaggcctgagccaccatgccctgccttgcaggcactatttttgtctgcatcttatagataaagagactaaatctcaaagaggttaaataatttgcccttgatttgcccaagaccctgtggctcttaggaggtagaacctggaattttttttagaatgtgttttataagaatattttcaataccttattttatactgtagtctagttttcaaaccttcttgagaaatctgcaacttgcatcgttttagctgttaaaaccaatgcttataacttggggagaaagatactataatggtttctgttatatctgcagtgagtatttatgaaatctttaaagatttgaaataaaggcgtttttagaaaatctaaactaagtggcaatttcagaaaagttctgtttcctaatatatcagtatcagtctacgaaacagcattcagggaagcaaaatatatactattcgataattacataaatgcagacctttgaaatcacgtgactcagatgactttttaagtacctgtgggtgattttttgatacattgtcgaggaaatcaaatattttatttttcttagtggaacagtaaaatacttatgtttgtcaataaaactgttcatttaagtttatttgctttaaaagctatggtcgtcattcaaattgccttttttgatgcataataaactgcacagattttaaagatgatttcaggcaaataggattatctttttccatgctgtgatattttgagtatttttctatgtaaaatcaagtaggaaactttaaacatagtgatatgtgtcaacaattttgacaaatctgaaagattttacatcttttatgaaaatgagattaaaataatttcagtttaactgtacttttgtggtagattatatgtggactcctcatgatagttttaaagccatgtagaattttcacgcagtttatagtatgcagaggttttaattgtaatgttaccaatttatagaaattaagttttctgttattgcttttatttaataagtgcttaaaaatatgttatttgtatagattagtgaagcttataataaaaaaagcttcttatacatgaatttatagtccatctgagaagccaagacatattcagcatataactcagaggccagttttcattcattatgtaagtgggccaatctttcttaactattgcttttatcctgtcaatcctttgctctgaaattaggacctactaaaatagaaattaccagattagattagcatgtttttctgtcactctccattctaaatataattacgtgaacacagcattatatttcatttttttgcagagacagagtctcactatgttgccaggctggtctcgaactcctgggctcaagtgatcctccagccttggcctcccaaagcgctaggattacaacaggcgtggaccaccacacgcctttaaacagcattttaaaaatctgtattcattttccgaatcaactaaactatgcttttaaatctatacagctttctactccccattctaggtacaaaccacatattaacttactgacttcccgtgcctgaattccttctgtccacgttcagttctgtatgtccagcagactcctggacctgtccgcaaggcaggcacctcaaacgtgtttaaaaccaaactcatcgtttccccccattacctactcttcatccagcgttctcatcttagtaaatggaattactgtcccaccagctgctcaagctagaaatatgagaataaactttttcctttattgtttgctatgcctttaaaataaatattgaatcagtttctctccattcccactgtccctccgtgatacaagccagtgtcatcttcattagactagtcagtcacccctaaagtagtgtaaccccctaccccaaccttccaagattttttcttttttttttttttttgagatggagtctcactcaggctggactgcagtggcccagtctcagctcactgcaaccccctgcctcttggattcaagcgactcccgagtgggtgggattacgggcggccgccaccacacctggctaattttgtatttttagtagagacagggtttcaccatgttggccaggctgatattgaactcctgacctcaggtgatcagcccacctcagcctccaaatgtgctgggattacagatgtgagccaccatgcccagccatagctggatgatttttaaaacagcaattttgatcaagtctccttttcccctaagttgaaaaaccttttaattacaattacttccatttgcccttaaccaaaacttcagattctttagcacagatccctaactttgtacatttaattatcttgctttctaacacttaagacaacataaataaaaagcaaaccaaagcacctaaaaacctgttggctaactagctcattcttgaggtctcagcctatttatgctacttcctagggatttctttgcctgcacccctttctttccctgaacccctttttctcttgcatcgtgaaatactactttttaaaacacccatcctaccaatagtttttttgttttgttttgttttttgatacaagtctcactctgtcgcccaggctggagtgcagtggcacaaccttgcttcactgcaacctccgcctcccaggttcaagtgattcttctgcctcagcctcccaagtagctgggattacaggtgcctgccaccacacccggctaatttttgtatttttagtagagatggggtttcaccatgttggccagtctggttttggactcccgacctcaggtaatccacctgcctcggactccgaaagtgctgggattacaggcgtgagccatcgtgcccggcctagttacttgttttaaggtaaatattatacacttcataaggtgaggaaaatgatgacaactatgtatatgatacccatgaagtgctggtactactctaaacactttatatattttaattaatttaattctaacaacagcatcttccaggatatgtaccgtcaccctatttttcagatggagagactgaggcatagagagttttaagtaatttatccaagatcacacaactacaaagtggtgggatcgggatttgaacctaggcattctggctccagaatgtgtgctcctaagcactacttgggctgcttgaccaagagcttaggacctagcttttgtctttaattgctgaattgctagttttatcagtttcctgcagctgctataacaaagtactataccaaaaaaaagtactataaaactgggtagtttaaaacagtagaaattgattatttaacagttttggagaatagaagtctaaactcaaaggtgtcagcagggccatgctccctctgcaggctctaggaaaaaaatccttgcttttttttttttttttggccttttctagcttctagcaccccaagtgtccttggcttgctggcagcataattccaatctccctgtcactatcttttcaaggcagcttaggttttttctatcaagcacctaacagttcttcagcctcttcccattacccagttccaaaaccactttcacatttttgagtatgttagcagcagcaccccacttcccgtaccaaaagttgggagttttccagggccaccataacaaagtaccacaaatggggtggcttgaaaaaatatgaatttattgtctcacagtcctggaggccagaagtctgaaatcatgggtcagcagggttggtttttctggagactttcaaagagaatctgttccatgcctgtctcctagcttctggcagtccttagcatttcttggtttacaaacagacacatcactccagttgctgcctctatgctaccttcttttctttttcttttcatttttttgagacacggagtctctgttgcccaggctggagtgcagtggcacgaatctcggctcactgcaacctccacctcccaggttcaagtgattctcctgcctcagcctcccaagtagctgggactacaggcacatgccaccattcctggccaattttttgtatttttagtagagatggggtttcaccatgttggccaggatggtctccatctcctgaccttgtgatctgcccgccttggcctctcaaagttctagaattacaggcgtgagccaccacgcccggcccattaccttcttttctatgtgtcaccttgggtcctctccttttctaaggataccagtcatttgacttaggggccaccctaaatccaggatgatttttatctcaagatccttaactttacatctgcaaagaccctatttccaaataagatcacatcctgaggttgcaggtggacatgaactttggggacattattcaactcatttcactagtgttctttactcttcatttctatgggtttgtttagaaacgaaagttgaaacttactgtgagtcattaaccttctacttagctagcctaggtaaaagtcaaagaagctttaaaatgtagacatataatatgtatgtttgctcttaattatatttttagcaaaccttttcttgccagtctgtcttctctttgccaccctatgagtccttgagaatgtgtgcccagtggtaacttcagggaagcctggccagtttgggtgagcctgaggaacatggtaggccttgtaagaaccagagcttctacagaaccacattataactccaaaaccaaatatacatacataatgtatatttatgtggaaagctgttgtcacttttacaatgaggacaaataattttgattatataaactgtatataggccaagtaactaagtataaaaaaacaacttttcagcccggtgcggtggctcgtgcctgtaatcccagcactttggggaggttgaggcgggcggattgcttgaggccagacgttcaagactagcctggccaacatggcgaaaccctgtctctactaaaaatacaaaaattagctgggcgtggtggtgtgtgcctgtaaatcccagcttcttcagaggctgaggcatgagaagtgcttgaacccaggaggcagaggttgcagtgagccaagattgcgccactgcactccagcctgggcaacagagtgagactccatcacaaaaaaaaaaaaaaaaaaggaaaagaaaaaagttaaacaaaacaaaacagaccaaaaaaacccccaacttttctttgaatggattagcaggtattcactgttttgctgctttatgctttaatgaatttttctttctgtggcttcaagaagaaaaatgttaggtcagtgaatacggtataggttgagtatcccttatctaaaatgctgtggatcagaagtattatgggctttggaatatttgcattatacttaccagttgatcattccttatttatttatttttttgtttatttttgagacagagtctcgctctgtcacccaggctagagtgaactggcgcgaactcggctcactctaggctccacctcctgggttcacaccattctcctgcctcaggctcccgggtagctgagacgacaggcgcctgccaccatgcccggctaattttttttgtatttttagtagagaccgggtttcaccgtgttaaccgggatggtctcgatctcctgaccttgtgatccgcccgcctcagcctcccaaagtgctgggattacaggtgtgagccactgtgcccagccagttgatcattcctaatctgaaaatctgaaacgctccaatgagcatttcctttgaacggcatgttggcactcaaaaacttttggatcttggagcattttggatttcagattttcggattaagggaactccacccatatccttttatttatctgtgatttaatataggccttctttcttcagaattactgaatgacttattcctggaatgctgctaaatttttattcatttattaccttagtaataatatttaacatttattgatcactggtgtgcccaggcactgtggtagatgccttatcattatacctttaagtcttatagtggcctgcaggcaggttttattatatcttcattttacaagtgaggtaaatagaatggcttagagactcagagaggctgtgtcttgtccatgtccacatatcttacaagcaaatgagtgtatttaaagccagatctctcctaaagcccagttctttcagttccctcagtttgccattgagtaaacaggaaaatcaggctcactctcatcgagtgcctcacacatactcttgaattccttttgagtggggacagaaataccattatatgtgttcctctatgtctagtcctagacattaatttgcctgtttgttttaagttagtgaccatctctgttgaagtctttaactccattaaaagtgaatggaaccttaggagagttttaggcaggagaggaagctcctcttctctccagtttgggcttcgattgtccagaagtaaagaagagggatgagatattatttgagataactccttcaaaaaccagaacttagcaaagcatttacaccattttgttagaaatatttctaaactatattataaagttagctgggtatcgtggcacatgtctgtaagtcctaactacttgggaggctgaggcaggagaattgcttgagcctaggagtctgagtacgcagtgaaccacgatggtgccactgcactctagcccgggcgacagagtgagaccctgtctctaaaataaatttattttattctaaaataattctaaatacattcttctcatcatattgttacattgatgatcttaaagttggttgagatgtagctgaaactggcttccacaaagtactctcacgtggttctgaattttgaggtcatttttctttgtgtcatgttttttagatatcatttctcagagtaaatcaagtttgagtgagacctgcagggttttcttgtgagcgcctatattgagttttagtgcataagctttgttttaagttttcactgggtagatgaactgtcagataagtggcattatgtctaacatataaagtatttccccccatttttaaacagagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatggtgagaggggcattttctcattttatttttgttaagtctgagctaaaccgttggtatgaaatcactgcaaaatttgaaaatagattaaaattttcaagtacagtcgtgcattgcttaatgatggggatacattctgaaaaatgtgtcatttgacaatgtcatcattgtatgaacatcatagagtacacttacacaaaccatacacctaggttatacggcatagcctgttgctgctaggctgcaaacctgtacgtcatgtgactgtactgaatcccataagcagttgtagcacaatggcaggtatttgtgtatctaactatatctaaacatttaaaaaggtaatacgtataatcttatgtgatcaccatcacgtatgtggttcctggtggaccgaaacattgtgcagtgcatgactgtgtgtatattttactttagttctccatatttcattttcccaagagaaccttgttcattccactgtaaattagggatgctatacattttagtgttttatttctgccttgggtcattactgatattccccaacatgttagtttgtttctttaattcaagtatcttattaaacttttttggcattccagtttttaattttaagaaataatattctttttgaactttttgcctttttaaaaaaataaaactttaaattttagagtatttttagatttatacaaaagttgcaaagatagtagagggtttccatatatcctgcacttggttgcccctgttattaaagtcttagattagtgtgaaatatttgttacaactaatggaccagtattgatacactgttactaactcaagtccatacttcattccaatttccttagtttttacctgatgtcctttttctgcctcatgatcctgtaccacttgatatttagtcatcatgttttcctctgggttgtcggtttctcagactttccttgtttttgatggccttgacagttgggaggagtagtggttaggtattttgtagaaagccctcattatgggtttttctcatggttagcctaggtttatgcattttggggaggaagaccacagaagtgaagtgcaattctcatcttcttatcaagagtgcatggtgtcctcgtgacttaccactgatgatgttaaccttggtccctgggtgaggcagtgttcgtcaggtttctccacatcctcccccaacccctcaaacccccaatactgtactttctggaagcaagtcactataaacagccacacttagcgggtgaggagttatgttctaccttcttgaaggggcaatatctacataaattatttggaatttttctgcacaggagatgtgtttattttttcaggcatttatttctatgagtatacattcatggatattttatacttactgggttataatataattggatatttattaggttataattcaatgtcaccttatttattttgttactcaactctttatttttttaagttataaatacatatatatctcaaaagtttaaatagtataaagggtatgctgtgaaaaatgaatctctctccttcaaaatctccaatctgaccttcctttctccagaggcaatcattattgctgtatgtttttttgtcctgccagatgtattctgtgcatgtttaataaataccacctgtgttttctaatgtagccatccctcagtattctcagggattgcttccagagccctctgcagatagcaaaatccatggatgcccaagtcctgcagtcagccctgtggaacctgctgatatgaaaagttggcattccatattcaagggttctgcatcctgagaatactgtattttcaatttgagggtggttgaatccaaggatgcagaacctttggccacagagggctgactatagtgccttttaagttttagcttagataaaattattaggtaagattctgaaagtacacttttaagtgcctggttctgagttctgctcttctgcatacattatctgctatacatataatcctattaattttccccattctccatttgcttaaaaatagaatgtttatatttaataaagatacccggatagctgtatccaaccttgttctcacatattctacatcaatattcctgtgaattcatgcgtatttttggagaatgataggctctcacatataaatactgttgggcacaaatatactttgtcttcagaaaaaagcattcttagttaccatgaattatatttattcatatctggtagttggaagtatttctctattagatctgtttagaaaaatgtgtaatttttttattagaaaagttttagtgttcagaagtctttgggggataagtaattgcagtaacacaatctccgtcttactctccccccatatagatcaaatcataggaaattttattaatttcagccagcttacttccccccttaatttccttttatgaatcatggcattaaaatagacaaatccctttttgctctcctgtgttttagtacaacaacagagaaccatctttagtcctctaaaaggcaatgtgagataggattttataaagtacattgaattaaaatatttttcagaataaaaaatagaaaaaacaaaaaaatattttctgtgtgttagattatgtatacagtataatcataattaaagaacaaagtcaaaacaggaatgggtaatcaagtgttaagtgttgtgatttgggggaatgtaaaaacctaaaaatgttaatataggggaattgataaatttcattatgaattatcatgtgatagaacactgcgtattggagaattaagtaaagtaccttgcaaaaactgtgtgagatacttaaattcttcttcctctaaataaccaactggatcaggttttatcattaaaaaataaccaattagcatagtagaattgtagttggtttccttctcatattttttgcatttcctacaatgagcatgttatatagttcagtatgattcagcatgtaatgtacttttaaaaattagttaaaccggcagggcacagtggctcacgcctgtaatcccagcattttgggaggctgaggcgggcggatcacgaggtcaggagatcgagaccatcctggctaacatggtgaaaccccgtctctactaaaaatacaaaaaaaaaaaaaaaaaaaaaaaaattagccaggcgtggtggcaggcacctgtagtcccagctactcggcagcctgaggcaagagaatggcgtgaacccgggaggcagtagcttgcagtgagccgagtgagccactgcactccagcctgggcgacacagagcgagactccgtctcaaaaaaaaaaaaaaaaaaaaaaaattagcaaaaccttttgtagtaatggggaacaacaaagagaacattgagctttaggccacaatatgttcttagaaagttagatgactaaaatttgtgtgctgtgagattgccttgcaacctgcagttatcctcttagtactacatggagtacatggaaataaggtgagttgtaccttggatttaatggtgagatctggaccccaaaaatgacataaatatttttttctttctttcctttttttttttttttcggctaaggtacaacatcaacctggtactgtaggaggagggattcacaagaattgaaaattgttggggaagagaaggggacacggacatttttgggtgcctcctgtgggccaggtgctcaactaggtgttttacaattctttaatcctctcagcaactttttaaggagtgtattggtaatgaattgagcattcaaatagaagaattcccgattaaaacaccagttcaccactgttacctttatttgttctctctggtaactaaaatcttggctgtgatagtcagtttaggaccacccagtccaggtaaatacccaaaataatatctaatcatgttctttaacttggggttttatgagatgaaaacaatggaaactactggggttctgataatagccaagaataatttacagcataacaggaatttcagaattgtagcctgtctgatgactttgacttgatgttaacctctcaaagaaaatgcttcatttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttttagccaggatggtctcgatctcctgacctcgtgatccgcccgcctcggcctcccaaagtgctgggattacaggcgtgagccaccgcgcccggccgaaaatgcttcatttctaatgtataactctctggtttttatctacacacacacgtgtctactttaggagagtttaattctatttttgatagttaaatttttcttctccatttttcctcaatattttattaaaaatttcaaatgtacacaaaagttgaaagaattatacagttaccagcctgatcaacatggcaaaacctcgtctttactaaaaatacaaaaattagctgggcttggtggtgcacgcctgcaatcctagctactcgggaagctgaggcaggagaattgcttgaacccagaggcagaggttgcagtgagccgagatcgtgccactgccctccagcctgggcaacagagtgagactttgtctccaaaaaaaaaaaaaaaaaaaaattatacagtaaatactcatatattcatcgtatagatctgtactttatatttgtaactaaatatacagcttactatatttgctttatcctatgcctgtatggtaattatgaaatgctttattttgcttatttgagggaagtttatttttagaagaattttttctgagtagagatggcttctaaaacctggtaggttaattctttgtttagttttgaaatgttcatgcaaagtatagaatatacttgttgatagaatatgcatatttagtatagatcagatacaatgtaattttctttcatcctttaatgtttttctctctgctgaacattttgggtctctttttctttttgttgttgttgtttgttttgtttttgtttttttgagacagagtctcgctctgtcacccaggctggagtgcagtggcatgatctcggctcactgcaacctctgtctcctaggttcaagcaattatcatgtctcagcctcccaggtagctgggattacaggcgtgtgccaccacacctggctaatttttgtattttaggtagagacggggtttcaccatgttggtcagactggtctcaaacttctagcctcaagggattcacctgcctcggcctcctgaagtgctgggattacaggcgtgagccactgcgcccagccctgtttttnnnnnnnnnnnnnnnnnnnntcagagaactatggtcatgcaacctgtgcttttcaaccaatttaaatggtctaaacttagtaggcaactaaaacaatttttttggttttattttcattaaatggcactgggaaagtagggaggatgtacaatgatttggttaagaaaagctataggatgtagttgtgtttgaaaatggccgggcgtggtggctcacacctgtaatcctagcactttgagacaggtggatcacctgaggtcaggagtttgagaccagcatggccaacatagtgaaaccccatctttactaaaaacataaaaattagccaggtgtggtggtatgcgcctatagtctcagctacttgggaggctgaggtgtgagaatcgcttgaacccaggaggcagaggttgcagtgagtcgagatcacgccactgcactccagcctgggcaacagagtgagattctgtctcaaaaaaaaagaaagaaagaaaaaaggaaatctgtgcctctaagaaaaacagataatcggtaactacattttctttttccaaataaagtgttctttaaaatataggaattaagggctgggcactgctaacgcctgtaaccccagtgctttggtaggccaaggcacgggggagttcaagaccagtctgggcaacatagtgagactccatctctattttaaaaaggattaaaaaattagccaggcgtggtgacacatacctatagttccatctactcgggaggctgaggtgggaggatcacttgagtctaggagttcaaggttacagtgagctgtgatcacaccagtgtactcctgagcaagagtgagactctgtctctaaaaaagtaaaaaataaatttataaaaaaggaaacacaaacccaaaaatccaagaggagtactgtggatatacatggtattaagtgtttcttatggcccggtgcagtggctcacgcctgtaatcccaacactttgtgaggctgaggtgggcggatcacctgaggtcaggagttcaagaccagccgggccaacgtggtgaaaccccgtctctactaaaaatacaaaaattagccgggtgtggtggcaggcgcctgtaatcccagctacttgggaggctggggcaggagaattgcttgaacctgggaggcagaggttgcagtgagccaggagtgcgccattacactcctgcctgggtgacaagagcaaaactccatctcaaaaaaaaaaaaaaagaaaaagaaaaaccgtgtttcttcttattcacaaatagcgtactctagttgataaatttatttttatgaggaaacagtttagcaattccgaaactattttactgtgtgtactaggaatgaacaaataactagatatgttatagataatgtgagccagatttctcactgtcagagaagttacagataagcaagtgggcaatggtaaatgaaccctatacagacacataggcattcactcatatacatatgtgcccacacaaataaatacagaaataatatagatgtatatatttatgactacattttttagctctgttggctgagagactctagaatagtaacaccccaatagtaacaaacacaccaaccacttagattgtgacttctaacatcattctccaatttgttcttcaaaaaagaacaaaggctccttggagagatggtggattgtagggctggggcagggaaaatacaaggtgagcccggagcatcttgtaatagtggaaagtaagaaaatgctggatggatggatggatggatggatggatggatggatatgtgtcaaaaggacactggactcggaaaaagtccccagtggccaaagctgaaacaatttgtgcaacaaaattaaaagtgatagtattgcatgataacccaaagaatataattaatatccatgagtgcgtactgatataccgtgtgttctgtacactgtggtccttctgtatcccgtggtctataacatgccatagtatcactctgtctaagttgaaagagggtaggtgtactaagagacttagtgactttcagaacaattaagggacttcagaaagaaagttgtttccaaaagggcctctgttttctctttttacagttgaggaaatgatggcctggagaggttaggtagcttgcccagagtcacacagctaatccaagtcagatttgcagtgggttttgggtttctaggttttgatcactgcagtgtgctgcccagactgtgggtctatgtcagcttgcagtttttgtcatctgtcacagatatccgtgacagatagctatatcaaggctatattttaaaaagataggctcattttactttttttaaaaagtagagcccataattagcatgtattatctagaggtgaaggtacaccaaattgattgaattctgtaaacacaattttgtttgtaatcttgatttttatttcataggtctaatgctttaaaaatacttaatttttcctctttaatagcttgtattgaaactcgtaagtgacatttgtggtactgttctatttggttatatataggaataatttttttgtttgttttacacattatagaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgagggtaaaaaaattacttgattaaaaagaaatatttcattagtgttatttatgaaatctccagttttacttgcaaaatgaaagtgaaatattgcaagcagctacctaatttaatatttctaaagagatcaggataccgtcccctcttataacgtgtgtaacaattgtaatgagttttatgtattagtgaatttgctataatgttatattcatgtctctatttatacttcccattaagttgccatttccctatgaaaaagaactattctttaatattataccagagtatacacttttgtatgtgataaaatgttcatttttatattaattacttaagcattcttaatatattattaaatattcttaaatactctctgaattacctattgcagcaatatccgagaatctacttgctttaaaatggccgttcaatggaagcaggttttttgtgattatttagtagttgactgaatgtggccatttgccctgaagcaattttaaagaatatctttgaagttttgttgtgcattttgctgtagagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccaggtacagagggcagcgtatcaatgcctctgtaatggggggaatccttcccttttgtagtaaaagccgaatgtcacctaaaaccttaaactatgtgttcattcatgctgcttgcttacagtgccatccccatttgctaaattgtcacctaacatttggagtttgataaatgtcctcgcagttagtgcttgaaactcatcataattttcatgcttcttaaacttcatttagctgtttttgtttaatagatttatttttatattttatcaccagaccatagtggcagatattttggttttaattacttatgtactaatggctcaatgttgaatgatctgacctttccagttctgtagatactaacaaattaattttatgtttgcatgtgctcgtgtaatatttatagcatttcaaaccgtagtattatggtagaaaatcattatcacagaacattgttgtcagatgtattttgacataaaaatgtaagttgaccagtaattcacattttcagtttttaaaattaaagttatactccaagtaagttatagcacaccaagagtgtcctgttgcataacatgaaggattttgacaacctgcagttcttatggggacgacttccatttgagtactggtcagcagtgagctgtgttgctgaaaacaccagtttaacagggcgctacagatagggatgtaagtgtaagctccagaagaaccacagcaatcagcagtaagtccaccttactttatactgatgagagattgatcattaagatcaagaacagggccaggtgtggtggttcatgcctgtaatcccagcactttgggaggcctaggcgggcagatcacctgaggtcaggagttcgagaccagcctgaccaacatgttgaaaccccgtgtctactgaaaatgcaaaaattagctggacatgatatcatgcgcctgtaatcccagctacttgggtggctgaggcaggaggatcacttgaacccacgaggtagaggttgcagtgagctgagatcgtaccactgcactccagcctgggcgacagagcaagacttcatcttaaaaaagtaaaaaaagagaaaaagaaaatatatttatatgaaaacataagcaagaagtttcaaggaaactagaatgggagcaaatatagcaactgtcagtggccggcatcagaggggaatttgggtcattagcagggtgagagtgttggacagctgaagatgctgtacctacaaattcaaaaccttcccatttaataactcatagttctcttcttgagtagagtaaaaaacaaaacaatgatcaaacatgaaaagcattttaaaagactttattaaatatatcataccagattttaaagaggagtttggtacttttgtaaagtagataaacattttaataggtccctgacttcagaatatactaacggagatgtatcagtgaccaaaatagataaggtctgggcccttggtgacttacattctagtgggcagtagacggacttaatagagttctgaccttcacctgcttccttctgtttctgtggctctctatgcagttatttattcaacagctatttattgagtgccctacaatgtgcctggctatgtgctagacactttgtgatgtccctggaccaaactctgttaccactgtttactacctatggtcagtggatgagatgccttgttagaagaattggggtgggagaattgttaaaggcagactaagaacaatagccgtgatagaagacatcttacttggttttcttttctaaactttcagaatgtatttaggcacctaatttaatgattaaaacttatcgacaaaagataactgtcagattggaaagcattttggatgttaagatatttttggtaaagtttttttttgagagagagtctcactctcacccaggctggagtacagtgacgtgatcatggctcactgcaggcttgacctcccagggtcaagtgatcctcccacctcagccttccaagtagctgagactacaggtgtgcaccaccatgcccagcttatttatttatttatttagtaaacaagtaagtagagacaaggtctcactgtgttgcccaggccagtctcgaactcctgggctcaagccatcctcccgcctctgcctctcaaaagtgctgggattacaggcatgagctactgcacccagcaactttaaaaaattgaaatataacctgcagtaaagtttataaatattaagtgaataacttgatggatgtttacgaagttaacacatctgtgttaccatatcgtgcccccttttagctaccactacacctagcccaacaaaggtactgactattctgacttctatcaccactgattggtttgccttttttaaaaaaattactggaaccatacagtatatactctttgatgcctgatagcttttttcccacctcaacaaaacatcaatgagagccatccagatgttgctagtagtagcagcttattcttttttattgcagtatgatattccattatatagatatgtcatgattcttgttacattttggtggttattttaatgatttttggtttgggaccattatgaataatactattatgaatattttacatgtttcttgtgcacatacatgtgcatttctggaggtacaagcctagttgtggattttctaggtcatggagctggtttatgctcatctttggtagatactgctaaacagttttccacaggggttgtagaagtattcagttcaacagtgtatgagagttctagctcctctgcatccttgctaacactgggtatcatcagcatcactctttgtctttttggaggactgaggggacatgctagtgggcatgtagggatattttactgttctttgcacttgctagctcccttgtgactaaggatgttgagcgtctttatgtgttcgtgtgtgtgtgtgtgtgtgtgtcagtcgtttagatatcctcttttgggaggtacctgtctgcttctttgttcattttctataaatgttctgttttttgctttgtagttgtttcatgggagagggtaaatctggttcttccactttaccttgactagaagcagaagtatctacactgaattttgaatgttaacctaatctcatgttcctgggggtaaatataacttgttgtgatgtattttccttgttatatattatagcatccagtttattaatattttgtttaggatttttgcatttactttcatgagtaaaattggcttgcatttttcttctctgataatgtcagtctttagtatcaggaatattttgtcagtctttagtatcaggaatattttggcctcatatcatgagttggtactagaagagtttttgtggggctgttgttaattatttctttttttttttttttttctttttgagatggagtttcagtctttcgcccaggctggagtacagtggtgcgatctcggctcaccacaacctctgccttcctgtttcaagcgattctcctgcctcagcctcccaaatagctgggattacaggtgcccaccaccacgtctggctaatttttgtatttttagtagagacggggtttcaccatgttggccaggctggtcttgaactcctgacctcatgatccacccgcctcagcctcccaaagtgctgggattagaggcgtgagccaccgcgcccggctagggctggtgttatttcttaaatgtttgctggagtgatttggttctggagttttcactgtgagaaggttattatagatttcattcacttctttagtagataatggctatcttagtccatttgtgttgctgtaaaggagtatctaaggctggtggtttatttaaaaaaagagatttctttggctatgtggttttgcagactgtacaagaagcatggtactgacatctgcatctggtgagggccttatgatgcttccactaatgacggaaggggaaaggggagccagtgtatattgatacctcattgtgagagagcaaataggggaggcgggggtggcagatgacaggctctttttctaacagtcagctctagtgggaactaatagtgtgagaactcactcacccccaacacccaacccgagagcattaatctgctcttgagggatccgtccccagaatccaaacacctcccattaggccccacctccaacattgggatcaaatttcaacatgagatttttggcaggacaaacatctaaactatccaaactacagcagtgggctattcatattttctgttgttttcttaggttcattttctttaatcgcctttttttaaggaatctgctcattttggcaaatttttacaatttattagcataataacatcgtatcttttttatatatatagggtctatactcgctctatttttccaatctggaaattcgttacctgcccccgttaatcgtgttgtgaggctgttagcaattccattagtctttttttaaaaaaacacaactttgtctttgttgaccttctttattgtatgtttttctccaaattaatttctggtcttagtattttgtccttccttttattttctttgtacttttatggattttctttcctagcttctgaagatggttgctttgatggtttgtagtttagttttgtttttttatgacgtctactatcaaggctatcagctttcctctatgtcctgctatagctacatcccacaaacttattttatttttaaatgcatgaccagaacacaaccacaaactgtaataggtcatgttccctttatcatttagtttaaaatattgtctaatttctgttttaatatggtgtgtgatgaagtatattgcttaatattcaaacatttgtaggtttttgtttttggtttttggtttttggttttttgtgtgtgtgtaagacagggtcttgctctgttacccaggctggattgccgtaaagtggccataactctctgtagcctggaactcctgagctcaagtgattatcccacctcagcttcctaagtagctgaaactataggctaattatcttttttttttctagttgatttctagtttaaccctctatcagagaacattctatgcatgatttatgtcctttaaattttattgactcttgttttgtggcccaacatttaattaatgttgataaatgttccatgaacaattgaagagggtgtatgtatattatatatatatacacacacacacacacacacgtatatatattacatatatatatttcaggctttactttgaaataaaatcttgtcagaatactgtcattttcatataatttggtagaagttatgtgaaggagaaaatgacaaaattgtagtataaaaaatgataggagtgagaacataagaaaattgggcagatttcatgatacccattatattgagtattatcagtgatcagaaacattttgtgtggctcagattaaagattaaactgaaaaagttgggcaatatttggggaaagattgctactatcacttttaaaagttaaaaagttaatctcttaatacctattcagtttcaactgtctttggcaagaatactttataaagaatgtgctggttaattgatattgtatcccatcaaaaggctcatggtatatggtttttgtaccttcagagatgcctagattgatcaacgagtttaggtggtgagattgcaagattctctgttaacctctcactcattaataatctttccataatcaaggttttttttttttttttttttttgagagacagagtctcgctctgtcacccaggctggagtgcagtggtgcgatcttatggcttactgcaacctccgcctcccaggttcaagcgattctcctgccttagcctcccgagtagccaggactatagacgcgcgccaccacatctggctaatttttgtatttatagtagagatggggtttcacatgttggccaggctggtcttgaacttctgaccttgtgatctgcccacctcggcctcccaaagtgctgagactgcaggtgtgagccacccacctggcccagaatcagttatttatttggagactgtaatatggagttttggggattttgggtttttgttttttgttttttttttttttttttttgagacagggtcttgctctgtcacccaggctggagtgcagtggcacaatctcagctcactgcaacctccgcctcctgagtagctgggattacaggcgcccacaaccacacccagctaatttttgtatttttagtagagacaggatttcgccatgttggccaggctggtctcgaactcctgacctcaggtgatccgcccacttcagcctcccaaagtggtagaattacaggcgtgagctaccgtgctggccggacttcttgctttttagcagaataaaatgtttgaggcttatgttacacagtacctatcctgacttggaatcatttttttttcctccaagaagtcctggttcctttaatgggaaatgatatttagagaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaacccctgcctcaagtgatctgcctgcctcaacctcccaaattgctgggattacaggtgtgagccactgctcccagccttcataggcattttctttgtttctgggtcttttgccattttaaatactccaatgaatagctagctctatagataagtaatttagtatttttttttttagtgtattttgggctagatttctagacacaggattgctgtgttaagtaaatgcatgtgtaattttcccttcgtgtattgtgagacttggatttttgccagttgataactgagagtagtttcttcatatagttttattttacatttctcatagtttgaattgggcatatttccatatgcctaaaggccattttcttttcttttatgactgttcacatattttcccatattttatcaggttgtcaggtttttttcctgaaacccaaaattatacattaaagatagttactgcaatagactatcaaccaatttttaggtgatttgaagagtatcttgtcagtggcaaaaacaaaggcagagggagacttttaatttctgaactaccatggaaagacaggctttctgttcatggtagtggtaatttttatatgcttttaagaactatactcttagtgatactattaaattgtcctcagaagttagcaatcacagctgggcacagtggctcacgcctgtaatcccagccactttgggaggccaaggtgggtggatcacctgaggtcaggagttcgagcccagcctggccaacatggtgaaaccctatctctaccaaaaatataaaagaattatccaggtatggtggcgtgcacctgactgtagtcccagctactcaggaggctgaggcgggagaatctcttgaacctgggaggtggaggctacagtcagccgagattgtgccactgcactccagcctgcgcaacagagtgagactccatcttaaaaagaagttaacaatcgcatttaggcattacctttcagttaatttgggcatagtattcaggcagaagaccatagagttaaataatcctgcttaattctgtttctaatactatttgagtacttttgaaaagtaagactataagcttcagattttgaatactatctcagcaaactacctctgcaatatctggcgcactgtaagttttgagagatagtcatatcacttggttattctccagctctggggtatccaaaaaattgtctgccttgtactggagactaaggtgatacgagtcagtgagttagagttgggtcctcacccccccaaaaaaagtcagtgagttaatagcctggaagacttaaaaaaataaggtgttgcctaccactttcttttatacattgcattactgatacatgaacagattttcttttaaaaatacagcttcttaatgaaatcctaaaacaattgtcttttctgacaattcgtcatttttcatgtgatttccaatttaaaaatcagatattctatttttctagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagataggtaagaatatacttcatccattccattaaagggaagttttttcttttttttcttttttttgtgtgtgtgtgtgtggttttttgcttttgtttttgttttttagtttttaattttttaaatgaaagtttggtggggggtggaatttagatgttcttttcctttatttttcattttttttttaaacacagcacttgcactcaatgtttttgttttcaaaatctacaaaagcacacagagcagggaagaaagatccttttcatactcccctccccaaaggtaaccaccatgcatcaacagtttggtgtgtaacattttagatctttctgcagttacatttatgtatgtatgtttacaaaggttttggagagctttgggcgattttttagttttggggttttttgaaatataaacaggatcattctgcatgtattgttctgcatcctgctttttttactcagtgatacatggagagaatctttttgtgttatgaattgaattcatttttttttaaagctgctgcatggtactccagagtatggatgaaccataattcatctactatttctctattaatggacatttatgttgttaacagtttttcattattacaaatagtggtgcttttgaacatccttaacgtatatctttgtgtacttgtgcaggtatttctggcagtatagaaacagtaagtggacttgctggtcaaatggtagctacatttaaaaaacagtgatggctactgcttaattgtatatcaaaagagatttataccagtaactttcatacatttctgtttccttattctctcacttaaattcaacaacatcattcctcttaacatttttgccaatggtgaaaagtatttcgtatacaaatttacatattcttactcatgtggttaagtttcttacatgtatttgttgaacttcctgtgaattgcttattcatatctttttctcactttttcctaatgagttttgttatttttctttaatgaattttaggaatgctttatgtattgttgctattaatcttcaattttacgtatatttgcatagtaattgcctacttttagctcttcgttgtcatacagacatttttacatttttatttacttaaatttatcaatctttttctttagagtttctctggattttgtgttttattgaggagggttatccccatcccaagaatatatatatgttttatagtaattctttataatacttctataactttgttttcaacctatctgaagtaataattttcatttgatatgagttggaaatctgttttaattaggactttttcaattgcaagtgaccaaaccaacttaaactagcttaagtgaagagggaatttaattagctcatgtagttgggaagtccgagccatcatcaggtataactggaccctcaggtatcaaactctttgttttcctctctctctcaccttttaggtctacatatatttatgtgtgttaacctcattctctcccagtacagacaggctattcccatgtggcagggaagatggcaccagcaatttgtatttatatgtttccaaggtctgtgacccaaaggcaaggcccctacttctgctccaaatcagaagcccttgaggaaggaatttgagtggcttatcttggatcatattgtttctaaccctatggccagggcaggcaaggtactacgattgatgcctccagcaaaagttgggtaggaatggttttctaaggaaacagggacgctgcaaatattatagcatagtaaatatctacacttccatcctttggtagctcagcacgtgtgtgtactcacatttgttctcatacatacaattcaaaaatggttctgcctaatataatgcaaagatttcacccacaacttaaaactttttcaaaaacctctttcccacagttacatcctgtaattgtatctagacctaaatctagtatttctctgtgtgtatattaatttcagtagatctgggccgggctcggtggctcacacctgtaatcccagcactttgggaggccaaggcgggcggatcacgaggtcaggagttcgagaccagtctggccaacatagtgaaaccctgtctctactaaaaatacaaaaaatactagccgggcatggtggtgtgtgcctgtaatcccagctactggggaggctgaggcaggagaattgcttgaacccaggaggcagaggttgcagtgagccgagatcgtgccactgcactccagtctgggtgacagaacgagactccgtctcaaaaaaaaaaaaaaaaaaaaaaaattaaattccagtagatctcgaggtggcttatcttgatctcacaatccatgagccacattatgaatttaactgcctatgacactcataaacatagtagagggtgttctttaataaaactggatgccattgtttttctgggagaatggctgtgtttgagaggtgagaaacatataagaagattccccttctggaggccattctgttttacctgcctagttcctgctgtctgttactggggttgggttgctggggacttctataggattaaacaatcatataaccctatttggcaggtttggggttttttctgacagtagcactcacttgtagattcctaggttcccagctagtacttaatgcccagtaacttgctttaggatccatgaaggtgaacaccctccacttcctcagtttatctgtttagtaggccaatagtcctagtcctcaggtgaagagtttgtgtaggcttctgcctgctggtatcattaaacagtgagctgcagaggctgatgtagatctgtagcctgctgccaggctgcatcacaaggatccactgctttataataggaggaatatggcctttgggcagagggtgttcagtaaagacctctaccctcagtttagttctttttctccattcctttaagtcttacccctgtggtaattttctcctcctttcccttatttgcactaaatttagcaagtgataaaggattgactctgagcagtattggattgttggctctgaattaggaagctttttaaaagcactgtgtcattctctttctcttttcgggaaatctgacccagaccaaatgatgtctaaaaagtatctattacaggactttatagatggtcccaagaactaaccaccatagttcaacatcttggcataaaactccatgatctgaaggccaggcgcagtggctcacgcctgtaatcccagcactttgggaggctgagacgggtggatcactggaggtcaggggttcaagaccagcctgaccaacatggtgaaaccccgtctctactaaaaatacaaaaattagctgggcatggtggcgggcgcctgtaatcccagctacttgggaggctgaggcaggagaatcgcttgaacccaggaggcagaggttgcagtgagccgagatcgcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagggcaaagaggtgtgttctttctgtttaaaacaaaaatctgtggaatgtgagataattttaattaccataccttaaaaatcggggctggaaatttgtagaaatttctagacctacttttgaattgtattttctttatttccaaaactgtagtagtgtgatattttggagtcaaaatcttaaaatattctaccagattatttagaatttactggttttgatagaaatacatcaaacttgcttaaaaagggaattttattgacatacactattgagaagtccagtgttggtgacagcctcaggtgcattgttggatctagggagccaaatgaggttatcgaggctacttctgattttgccgtttcatatttttctgtttatttcttctttgtgatgggcttattgtttgctgttatcaacggttttctccatgttgtgggaataaaagtggccaacttctgatttacacccttcctgctcattagtacaaaaagcaaagaccccttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggagggcggtggtgagggaagtatctccccaaaggaaagaaggggtatggaacaggtaaaattaacagatgtttacaaaattgtcttaattattttccccaaaatgcatagccagttttcccaatcctagtttttctctatttacttaaaatgccatctttattatatatcatatagtaaattatctgtcttttcatttgccagtgccacagtgtcttcatttttttaaagctttaaattaaaaaggaaaaatcagagcttattcaactatctggtcaatggaaatttaacagtgatgcagtagttttagaatgtatacaaatttttccagcctgggcaatatggcgaaaccccatctctgcagaaaatacaaaaaattagtcaggtgtgctggtgcatgcctgtggttccagctacttggaaggctgagatgggagaatcacctgagcctgggggttgaggctgaggtgaactgagattgtgccactgcactccagcctgagcaacagaatgagaccctgtctcaaaaaaaagaaaaaaaaaattcagccaaagtgagattgatcagtatgtaaagcagaaatttgctcctgtggagtttagtgtgtccttaaaaatttactaggaaaatgttgagaggtctttattaggttataaaaaactaatttagttgattgttttatattgataagcctacacagataattatctaaattccctagtggaaaattcatgacatttatgtttataagctcaaaactatttggtatttaaacagaatttcagtggaaatctttcaaaaacttaaacctttttatacagaaatccatattgaatatataaggcaacactttgttagtttgctttttgagttattattatgtttgttacttgtaagtttgtagcagctcttcctgttttcaaacagatgagtttttaaacagataacccagcatgtttcaattttttgtggaataatagatgactcacagtaaagttacaacatattttcttttaagtaaaaaacttaaggaataatgatacttgctttgccattcaagggcctttttttatctgtttactttgtggatcttacacatacaccagatacgagttttggtgaaataaggtggttataattatttacttattgtcagcaattgctttgtggcctattcatttgacagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtgtgttctttctgtttaaaacaaaaatctgtggaatgtgagataattttaattaccacaccttaaaaataggggctggaaatttgtagaaatttgtagacctatttttgaattatattttctctgtttccgaaactgtagtagttaacaagactgaaagtattaggctttataagcatagttgcgtacccaaatttcagtcaaggcataaaaatgctataaatggctgatacactttcttactacatgaacagttttattctacatataattctaaagaattaaagccttctttacacatatgagtaggctattttgggttttatggtttattaaagaactgtagatgattcactgctcagttctagctatgatcacttcaggtgaacctgcagctaattagaggatgaggcttacccactgatagcagagtactgtggataggacagcatggcatcccagctctgatcatgaacaatgggatcagagctaggactcggtatctctgtgcttcagctagccgtggtgacaggacatggtcccaactttgtctcccatattcgagaattatttgcagggtagatatgcaagaataaaggacattcttaacattgcagcaattgcttaaaagcaatggctttcatacttctttttgactctgaccctcagtcacatacacattttttcatagcagcccagtacacatattcaaaagctttctgaaatactattttactttatgatgtgggaagcactctgatattttctgtgctagcctattgcattacattttattttttaaaaaagctgaataaggccactgtttatctgatagtccactaagagttgggatcaactgtttgaaaatactattttgaagtatccatggggtcttacactgtagctggaatgataaaaggacccgaaaggatgtttttaggaatatattttttgggggatagtacatgcgatgcccttctttttcccttaagtatatgttataaacttgaaaaaaatgataggtgagtaatttatatgtatggtttcatgggtatatttgaagtattaatacatgaaagcagtgaataatagtatctgacatgtaataggtacttaatatgtgttagttttctttctgcaggcatatcttggttgtttaattgtaaacaattagctttacttttaacttagcttttagacttcaaaagttctatcataagatttatcttaacttactttgaatgattaattttaattattgaaagacagttgattagatgaaattcacatctttgattgacataaataatgcagtctttttatttttttggtcaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaaggaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacataggtaaaggaaactaaggttaatttattgctgtaaatatactaaatgtttataaaatgattgttgtagttgtgcatttgaaacgtcattccaatgagttgaatgaagtcaatgtggtcagcagacaggacattagaggcatgagtgtacttctaacttactgaaccgacaccactaactatttggaggatttttaggagtcatcgtctttatacctggaatcagatggaggccaaagttacaactattgtgcttttaatttaaggtcaacctagtgaaataatttctctcatttcttctgaaatacagggcaaattggatcaaggcagttcagatgtgtagcaaacccagagaatttgcattggctttagccattttggagtgtgcagttaaaccagttgtgatgctaccaatatggcgagaatctttaggacataccaggtaaatgaattctgagccttgtaaatgatgagtattggactcccttttgaaatactagcctattaataatgaaagttaatatatttaagaggccatattgaagactttacttttggcctcattttcttcctatataagttgtaaacatgaatgaatattattagttctttcttttttttttgagacagagtcttgcactgttgcccaggctagcatgcagtggtgtagtctcggcttgctgtaacctctgcctcccatattcaagcgattctcttgtttcagcctcccaagtagctaggattacaggcacccgccactgtgcccagctaattatttgtatttttagtagagacatggtttcactgtgttggctaggctggtcttgaactcctgaccttgtgatctgccctcctcggcctcccaaagtgccgggattacaggtgtgagccaccgcacccaccatgaatattagttcttatttgccatacaggattgtgatgaagatcaaaagagatctggtatatgaaaatttaaaatattttctaaagtaaatagcatttttattgactagaaagagcactcacattttttagtattctggaatcttgtaggcactatgctaggaatctgatttacatctgtttttaaagttcattgtccaaccaaagatcatatagctcctgagtagacccagggctgtgcaacttcaacagatgattaaaaagaaagaaaattttgtgacttgaatctactttttagccctgatagacttgctttgtaactttagtctttaaaaagttattattacaaaactaaggttatggtaaataatagaatatttaagggcataaagcaaaaagtaagaaccattttatcttctctgccccaatcttttctacagagtccactccaaaggcatagccctatagtttttaaaatataaatacaagccaggcacatgggctcaacttctgtaatcccagcacctagggagaccgaggtactaaaaacacaaaaattagctgggtgtggtggcacatgcctgtagtcccaggtactcgggaggctgaggcaggagaatcactttaactcaggaggcggaggttacagtgaaccgagattgcaccactgcactccagcctgggtgacagagcaagacttcatctcaaaaaaaaaaaaaaaaaaaaaaaaggaatgtaatatatgtttttgagaaaagtacatttatgcctactaaatggttttcatttgctaaaggtatggctcccagttttctttggtgtttccaccacatacatttttttttttttttttttgacacaggatctcactgtcacccaggctggagtacagtggcgccatcacagctcactgcagccttgacctccctgggctaaggttatcctctcacctcagcctcctgagtagttgggactacagacgcattccactatgcctggctaatttttgtattttttatagacacggggtctcattatgttgcccaggctgttcttgaactctgggctcaagcaatctgcctgcctcagcctaccggagtgctgggattacagttgtgatacatttctgataagagtgcaattagtacagtggttgctataaccattttagagaatggtttgacaaaaacaaagttaaaaatgcaattcgactccttcctagtacagtagagagacttttaccctgtgtacatgagaagacattacagcagggtgttccttataatattatttcataatggtgaaatttggaaacaattccaaagtactcaatcaggctttttttttttttttttgagacggagtctcgnnnnnnnnnnnnnnnnnnnnctctgtcacccaggctggagtgcagtggcgtgatctcggctcactgcagctccgcctcccgggttcacgccattctcctgcctcagcctcccgagtaactgggactataggcacccaccactatgcccagctaattttttgtatttttag

SEQ ID NO: 15581 - DNA, 6836 bp, Human
agagccactgttgtagatagtctggaagagccctttcaacttggacatttccatgtttggagagcggactaaaggaaagtgttgcaggaattgtatggcaatccaggcatgagagttctcacaagaggctgagatcctatctgctagatatggcagaagtgcctttgtggagacaatgacatttgcaatgggtaggatgttcacagagtgagacagagaggtgggctctgcaggtggaggttacagcaggagcaaaatcccagagatagtacagcaagtggcagttacttgcaatcaggaattgcaattacccgaatgtgctggcctccactgaggcatgacatgaagaaccacaaacatccaggtgagtagctcggtgctccacccaattgatggtgtggagccactgcaggtttttgagctaaagactgcacaatcagagtagatcagtctagccatcactctatataatgcacacaggcttcatgatttcaatgcctagatttggctcagctactttttcttgagcacctactatgtgctctttattccgagtactgcatacatctttatgacccagtcttctctgtagctgtacagccacatctctctgcaaccactctctcactcctgtcactctccttggaccctacacttctgcttttcctgatgatttgaaatgaagtgtgctcccttatgccttgttgtcctcatagaagaccctgcctctacttagctttcccctctccacatcagcacacaggagatattgcttaaagaacattctcctagctggggtggtggctcacactggtaatcccagcactttgggaggccgaggcagaaggattgcttgaacctaggagttcaagaccagcctggggaacacagtgagactccatctctacgcaaataaaaaataaaaaaattatctgggcaaggtagtgcacacctatagttccacccactgtgaggctgaggcgggaggatcgcttgagcccaggagtttgaggctgcagtgagtttgcaccatggcactccagcctgggcaacagaatgagaccctagaaaagaaaaaacaaaaaggaaaaattccctggctgaggctggaggattgcttgagcccaggagtttgaggctgcagtgagtgtgtgccactgcactccagcctgggcgacagagtgagactctagaaaaaaaaaaacaaaaagggaaaattcccctggcaggactctcagatgctgctgagtagctctcagtcctctctgtaacccaaacataacacatctatctccgtgcttacactgggtggctttcacttgtttatctgtgaattgaagagaagttgcttgaggtcaggcagtgctcctcattggtaactgccttctctggggctaaccaaggacctagaacagaataagctattgaaaattgttgaggattgaaaaaaatagaaaaaatagaaatggcaaatatctaggccagtcactggacatagagaatgttatttaattcttatcgcacgtccttgagacatgtattgctatttgcattttgtgtgaatatgcatttgggtaagtttatgtaatccctcctctgcagaactgggattcaaatgcaggtgtatctctgttcaggtccagactcttctgccctgaagcagtagtacttggatggaatgacgtagggttggacaagccacacagaggccacttcctctcacttacttttctttgcttcccactcaaccaggacagttcccacgcactttttcaagattcttatctgctcccacacttggggaagttcccaatgcaacctatcaatccatcaccaccacgaataccagccaggagaggtggggaaaggagtttaccacatggtcgctgggtgtgagcaactgttccctgtccctatggcttcccacttgtggctcccaccatggcctggagttttgggtggagtttttcaaataaaagccctcagcattgcaggacggcacagtggtgagctcttagcttcaccaggctcatcaaagctgctccaggaaggcccaagccagaccagaagacatgcagatcatcaccacagccctggtgtgcttgctgctagctgggatgtggccggaagatgtggacagcaagagcagtgagtgtggcaggcatcattttgcttctctctggggagggcagaaacgtggtcagccactctggggttggagcaggcttctccttgaactcaccaactctatctcccctcttcctacctaaagaggaggaatggtgaacttggacaggctggggtgagggctagtaggagaaccatgagttggggcaaacacagagaactgaactgacagcttcagtacaagacccaaggaagggaacctgtgaggttactcgggtaaagctgggaggcccaaggtccaggggacagcctgggtgtagcttctacagtgtgacagacaccaagtagagtcagaaggcaagaccgggctctaacaattggtcactcttgggcaagtcactttagctctcaaactctactttctctatcagtgaaatggagttgatgatgtctgccctccaagactgtttggagaataccaacctagtaagaggcatgaaagggggtgcaaacagaaaaactaggaggaagaagctgggattggaatgcaggtctcttgcgggatgtggtgtgggaggagaatgcacaaatggacagagtgggggttgggggctgggaaagagctaaggaccagggcaggaggggattcaagagactgagtagggcagctagctagttcctgggagctcttcccttgtcatctcatcagtttggactcctcgaacaattcctaatcttccccagatcaggtctgtgaactgtggaccactgtgtcctgcatcagactaaccaggtccccagggtgtggggtccagagcccttggacatgaatactggggcagaaccatgcacatgtggtgaaataccaaaactggatgagcctttagaaaccaggctccaaaaagttttattttacagatgggaagtctggggccagggtgaaggcacatcttcctcagggccactcagctggggtgcggggagctcagatctgaaccccaatcttctgactctttacctagccccagaacaaggtggctgatgaggcagagctatgccggcaccgtctggatgtggtccccaagccagggcttgtcctgggaggcgtttttttgtttgttttttaaaaattgtgctacaggtgagaggttgagaaatggatgcaaaccatcgtctgtgttcctcttctagtgcaggtacccttctccagatgttgcttctcatttgcggagcaagagattcccctgagggcaatcctgtgttacagaaataccagctccatctgctccaatgagggcttaatgtaagtgatcacctgctcaatctctccctagagaacagaaccccgccagcctggaattacaagagtagacactagatgacagtattttaccggaataaggtttctaaacccagagctgccagcacctgggtgcaagccacacttgggcgctagagggagcgctgagcttcctagcaggtgtgaggaaggatgcatctgtgctcctgcagtggcttgtgtttcctgaaactccaaggtgccaagtattgtatcccagcattatgagctcagaggtttaacaaaagcatgaggggttattgtgcactggaaagagcaagggaaccaggatgagttcctgcccctggatttggaacccatagtcttgggtgaccgtggacaggtaactcctttgtactgaattgtctgtgtatccttctgtattccttatctgtgaagggtcataaacatagctgcatcacagggtctttacaaacttaattggagtagctttcacaaaccagtcagtattttaaggctttttcatgtatattctctctgtcgatcctcttggggcacatatttttgttatcatgaaaagtgaggttcaggaaggtagagatatttgtctaagatcaaccagatagtaagagatagagttggtctatagattggacaatagtccagtttaggaagtagacagatcagaagagaaaaatacacacacccacacacacacaaggcgcgcgcacacacacacacacaaacacatgagtccaacgcaacaagtaaggccccagatggacacagaaacattaaagttggtgcaaagagctattccaggatgggaatttctcatctcacctaatcgtcagaatgttttcaggctgttcagccccaccctgatacaccaaattgaaaccaggagaggggtccaggaaattcaattcataagctcctggtgctttggctgttccccagcgtgcaaaccacacatcctgtgcagcaacttcatttacagaggggagcccaaggcctagcaagagcagtttaggggacctggcagccggaggaggcggggcttgtgcgttgcccacccagtggtggcttgggtggctcagccttctctcttattctctgttcacagattcaagctgaagagaggcaaagaggcctgcgccttggacacagttggatgggttcagaggcacagaaaaatgctgaggcactgcccgtcaaaaagaaaatgagcagatttctttccattgtgggctctggaaaccacatggcttcacctgtccccgaaactaccagccctacaccattccttctgccctgcttttgctaggtcacagaggatctgcttggtcttgataagctatgttgttgcactttaaacatttaaattatacaatcatcaacccccaaccctctgggtctcttggatttcagagtgaaaacttgattggcattgagaggtgggagccaggggctgaaggatgggtcaggaggagggagacatgttgcacctggtgccaggggaactgggctaataagtgactcactagctctcagtgactgcctttgtcctggggtgtaagctttgagtcagggtggtggtgcagattctctgcctccagatttggctgccaggagtggtacagtggaacagaaagctggggttcacagctggatccacatttgggtgcaggactcttcttctccctgccctgcccagagggcttggggggtgatgttatcaccaaatcacaactgccctagctggaggggatcatgtgaggttgtctgcctgtaaaatgttgctaaacccattttatagatgaggtgactgagggctaaagagagatgcagcaattcaggggcagatctggcattagagcctagagctgttgcctcctaggacaactcctccaggtgtcccacattgccaagtgtactgcctgatgcagtgtggtaccagatctgggggacaggccctgctgttgtcagcagtgcccatctcttcttgaggaagatctcagtgggtgtccaggcatgggtaggttctgggtctgattgagatgcccacccagcttatctggaggagtgaggctgtcttgggaagagcaggataaacccttggtggacatataggaagaggagggccaacgctttaaaagggacaatcacaagcttcaatttgtacaacgtgtgattcaaggaagaatagccaaggaaggaagtatttctaggtcttggggttggcacgcctttaaagatcacttttagagggcaaaggtctcacgctgtgtttccctcattccccattcaacatgtcacacatctggcccagtcttcttaatctgcctcctcttctccacccccatgactgcccttcttcagcccctattttctcttgcttggactattgcagtaggctgttttccgccctcccttctcaactccatcttatccacagccaatagctagtcttcctggcatccattcttccctctggatgactcaaaaacctttgcaccttcctcctgccttcagaactgagtctaaactccccaccctgatattctaattcctctagaacctgccctcaactttcctttctacatgtctccaacttttacattctggaagcccatatctgaccgtttggggatattccccccaggccctctccccacattgctatcttggacctcccctaaaagaatctttgctatgaccacacttccccatcctctaaagtccattaggcccaagcaccctcttccctaccaatcctgaggctcactaggacttggtcatctggtttccctctgagtgtcaggtgcacatgaagtctgaatcacttgctgcttggagtggggaggcatagattggggtgggagactagagggggagggatgggtttacttttggcaggagtgtggttttaaagaaagaaatgaactgaatatgaaacggatgagttgcgagccaggagcgcccatgctggggactggagccattgttccagaacagcctgggctggtgaggcaggccctccttgaaactcagatgagccaggctagccccatggccagggcctctgtacatctgccttccactggcatgccatccacccacacctctgagagcccctactggttggcagttactcctgaagaaaacaccactgtgtaggagattttaaataaaatgtattttctgcaaaatgtcagcagtcctactattgcattcatctttccacaataacatatttagcaacacctcacattcacaaagagctctccttcctacattgcagcatcccttcatgtccatgactcccacaggcatgctctcaacccctgggaaccgaatacaaacccactgccagcagctcatagtggaagggaagggggcttagaga

SEQ ID NO: 15582 - DNA, 6022 bp, Human
tgccatattttctacaaccagcttatattgtttttaaattatttaaaagtttttacaacattctgcaacaattcagcagccttttatttttaccattcccaggtcttgtaggtgacaggtacaggtctttccatcataaatataagcaggcattttctctgggatcttaggcagggacatcttggggtacttcacttaaggattttctgaaggaaaaaggtttaaccaactggaacccatgagtacttccttgagctcctgacctgtctgggcaggacccccgtgttctactccaacttcatcgatcattcagcaggttatccatgatagttgtcttccaaaataaaagaaaaaagaaaaagaaagaaaagtcaaaggaaaggattctgctttttagaagcatcaggtggatggaacgtacaccctgggttagaaaatatgctgttctaatgtgttacattagagtgagctgggaagactccataaataaggagatagaaagtaggccaactcttcaccaatttctggagctgggagtaaaaacaatttgaaaaagagataatcgagagaatgagtagcctgagcaaagtcataggggtaagataaaacgacataaagctaaaaccagaatcaaagccttgcattgctcccaaattaatattcaaagttgtataatgctcaattcccccattgaataattttccttttttgcattccatgtccatgatccatggcccagttataggcatgaggaccccacccatggtctctcatcaaaccccttttcactgatatggaaggcgattagttggtgattttgtaatgtgtatgtgagatgaggagctagttgtatgtgagatgaggagctagattagtggtttccaaaatttattctttgtatttctgagatatgtgtgtgggaagaatgacaagaagtctcttgtctctgattcaaactgaaggtctctgattttgtcgataaatttgccttccctatattcttttacttggaaaaatattttcacagctcattagatgttttagaaacacagtattttaagatcttgatatgctgtgcagttccgatagcctataaaacaaatagtggttttaaaacatatcctcaaattattttacactcttcccattaagaggtatgactatgttccctaaccttgcacctgggatccttaagccatcatgcaaaatatctagccatgtggagggaccactggaaagatcacacacacacacacacacacacacacacacacacatacagagagagagagagacacctgagaaattccatctggtccaactgctggctgttgaagtcctcccagcccagaccccagacactgaatgaaggccttgtgatatagtcaagagcaaaaaaacccagaagattgttattgttttaagtcactgttttcagatagattgctatgcagcaatagattattgaaatagacactacaattttaggtactattattctaagaatattgaattttatttttctgctaatgttctattattttacttttctctgggttttagaaagccaccaggatttaagacagtgaagaatctttgagtcctttgtagagttgaaccaaagtttgaatgtctctttgtggactcgtgtcctagggataccactccaaagggaaaaggggaatatcccttacatatctttgactttggtatccctgattccttcctttttctatagaatgtgtctcatttcagagaaactggtctcttgataatagccatagattacatactgtggtcttcctctacatagaccctacctcacctaccactcctggtcttagctgaaaaacaggctagcctcgactcatactgtcatttcctatcctcccactgaagtgcactggctcagcagatttattactccatagatttattactccattctatgattcatcctctctgcttcctataaaaggcagagacagagcttccagaggagcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccaggtaaggtccctctctccttctccttgaagcacattgccccctctctgggttatcctggaccaatcaagaagacctgatacccacagtctcactttaacagctacttttccaagataaggtaacttagaaaaaggataaggggtgagcccaaccacacagctgctgttgggtagagcctgaactagaattccagctgtgaaccccaaatccagctccttctaggattccagctctgggaacaccctcagtgcagttaccactccagctgcttccagcagaatttgggatcagggtgatcaaagacaggaggcttctggggatgggtgtgcgggctgtttccagataccgggagacccagaatctggtctgtggaagcccagcttccagaaacagcagctctgcagaggtggtacgtatcagggaaactcatgaccaagcattgaatgctcagagcctaaaaggggatccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccacctcttcctttctttctgattccttcttcttaccattccctgttttacaaacagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatcagaatgagttggagtcaaatactgtgatgcatacagcatctctaaccttatcccagacatttgccagtgagaaacaatacaagtaaagaaagtggcttctcactctcagctccctttccagctatcattttacatctcagttcgttccttcatcctggaaccaagagagattcacttgggctaccaaaaagagctgcttctctgagtccccttcctttgttttatcttcttccttcatccctgaggcatccccatcagctaggctgatgggctagacagatttcccatagacttggtcacactcccaggctgaaccctcaaggtgttccatctgactgtctcctttctgctccacagcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacagctgccattcatggttttttaaaaggataaagtaataaagctggtgggggtaacagggtgacaaggtgaagggcgtggttgcagaggttgggctcacattgtggagaaatgagcgcgtaatggactctgggctttcccccaggccaggctcacctgcatgttagggagaggcagccacaggctggggccagatgaacccaccccccagctccagatctgacatctgcttcagccacttgttcaaatacctttcttttttcccaaactcattctttttctcaccatcccacgctctacccaaaagcctgtcccctcttctattctatcagccttgtgactggctggttttcccccttctaatcaatcctctagtctagtaaatacaaatgtcactttcattaaaaaatcaagtaggagaccaacagatgatttggcaagtgcctgccatcattgatttctgccaccattggtgttcagaccaagtccaacatccctttctaccccttcttcagcccaccagttctcacccccaaacaccaaagtcaaccttaaacaatgagattcagaaaatgtgaataagtattcagttcattcaaggacaaagcttgagggtggccacttggaaaagcatcaactccaaacaaccggaaaagtttcagttacataagtaaagacagaagttccagccagattacaacatttttcatactagacaaggtgcatacaccacagtgatttgattggttataggttgctatgttctaaggaagattatttgctattccttaaggagaggtaatgatctgaggggtcttacctctgccatggctcagtcttcttaattgtttacaggaaacagcaaaaatgcagaagttgtaggtgcatgccgcacaactcagattgcatagccacattcctctcaaggctcagaataattaaagtcctaatagctttaagtttaaattatttgaagtttgacttatttaatttaatttcacaccaataaggagggtaatcttaaattccaggagagaacaaccagcaggcagaccaggagtagaggtgaatgaatagatactgtgagacacagtatttgatacatgcaaatattaagcagagtgtttgatggtaggacaggaaaggagagaagggctacatgtgctcaaggtcaaacagaatctgctgaaacttcattttcaaaaaattataaaatcatgtgttttcatgcaggccttgtactcttgggcacagagaattagaaagaacaggaacagagaggctggtatataactgggcattgagttcaatgggattcaaagattaggctagttacaccagcaatgtgcctagtaaatttaggcaagttactttacctgagcaagcctccatagattgagatgtagagtaggtcaatgagtcgtattcacatcaacatcacttagatgctaataaaaaaacacagatttccagataccatcagcaaagactctgatatggagtgttgggtggggaaggtgtcacttacacatttttaactatttctcagtcatgtcttgggaccagtgagtttccctgacactctctttttcagatcaatgtagtctccaggcttgatctgtgacctctggcttaggcgtaaggagtgttttttgctggaactttcccacctcctagactttgctgctggacatgtgccagtcataagtagcagagactgcaaatgtcccccagatatctgtgggctcttctatattctccagcccaaattgcatttacccaggggctgtgtgattgaattctaaccagttgggtgagggctaaaatgatatgagccactttcagaccttgtccctataaacagctctctcttcctctgttgtggtaatgttaggggtaatgtgttccatatagctcaatttcaagatggaagcagtccatatccacaagtcactggtcacctggcctaccttgaactgtgacatgagaaagaaataaacatt

SEQ ID NO: 15583 - DNA, 49189 bp, Human
catttaggtaaaatttttaacagtggtagagttctaatcttccagtgaataaagatagcttatagagttgtcaaataacacttcattaatgttggtatttgaagattgttcaacatttgtcatttttatgaacttatgcgtaagacattctctgtattaatagtactaaagtcacaatatagaaacatactaaatatagaattaaattcaaggttctttctagtgtcgaaccttatcagggataatagtttttatcagtatataattccatcacatgaaatgaatatgactaatttgaattttgtttggcagttttgtttctatttaatatatatctgtatttaagtttaagtttatatctagattatttcagtatagttagcaaactttataatttggattttatgagattttttttcttaagaagatcactgtggtttaagaaagagatatcacaagaattattaaataaaatatagcacactgaaccttggcagtatattaaaataataatataccatgatcatatagcctttattccaataatataaagatgtaaccatgcttatatgtgtaataaaagaatccattatatcagtatgttagaggggagatatatattatttcagtgtttccccataaggcatgcctgatagatcctcttaaactcagaaggataccttaccttttgatacaaaacatctatctcaaacttatttttattttcatgtttttaaggccatggcaatgaatttactttttaaaaatatgaatcattagagatataattcattgattgcagacatcagaaaccatccctggctgacttaagcaaaaccataatttattggaagaatgtaaggtagttcataagatgagtagagaaatggaagaactgggaattgagcaagtcaaggatataggcattatttactaccttgtccaaaattcttcctttggaatttaatgtgcctttttttccctttctccttaagattcagagttatagaggagataattctgatagtgtagttgagtcttgtgacctacttaagctaggagagagtgagccactttaggtctcattaagactacaggatgggaaggatgtaattccccaaagatgactgggtacagttagggcagggaaatgggtcctaggcagccaagtcccaccttccacaaaattaaccaacagatatccagtaaatacagaatttggctttttaactaattgtagctcatcatttaaagtataagatgtatcagtcattgagattataaatttcttcttatttatttattttttgagacagagtctcgctctgtcactcaagctaaagtgcagtggcatgatctcagctcacttcaacctccgtctcccaggttcaagcgattcttgagcgtcagcctccaggagtagctgggagtacaggggcgtgctactgcacccagctaattttggtatttttagtagagatggggttttgccatgttggccaggctgatctcgaactcctggccccaagtgatcctccagccttctaaagtgctgggattacaggtgtgagccactgcacccagccaatattaaatgacttctaactcaaatacctgagtttttttttttcttcttcttcttttttttgagatgcagtctcgctctgtcgcccaggcctggagtgcactggcgccacctcggcttgctgcatccccccgcctcccgggttcaagcagttctcctgcctcagtctcccatgtagctgagattacaggtgcctgccaccaagcccggctaattttttttgtatttttagtagagactaggtttcgccatgttggccaagctggttttgaactcctgacctcaagtgatctgcccgcctcggcctcccaaagtgctaggattataggcatgagccactgcacccagctgagatctttatatactagcagtgtccgtattttgatacatctgtaatctttgtttttcttttctagacaatgcgaagacatagaaatgaagtgacagtggaactgcggaaggtaaggttgatttacatttaaagaaaagtaattagatttttctgatgttaaaattctgtgtatcttgaataatgaaaatactgtggcaaattagtggtcatccctaaaaccacacatcactggatactttatcatggtacttattcataatagctttcatttactgagggtactaggccctgtgtgaagcactttaccatcactgaaattctcataacatctgatgaagttagatacattttctttgacatcctctttctgtgggcttcctctccctttgcttatgtaaaagttacacatccttgttaaagatactttacagaagtaaataaaagtagaaaagtagaaaaaccttgtgttttcccaactgaaagcaactgctattaaaatttattgtattttcttccattatttttggaggattttagagttaccttcatcagattgtgttttcttttttctctttctttttttgagacagcgtttcactctgtccaggttggagtgaagtggtgtgatcttggctcactgcagccttgacctcccgggctcaagtgatcctcccacctcagctggctgagtagctatgaatgcaggcacaccaccacacccagctgtgaatacaggcacaccaccacacccagctaatttttgtttattttttgtagagactaggtctcactatgttgcccaggctggccttgaattcctggactcaaacaatcgtccttctgttgggattacgggcgtgagctgccatgcctggcccaaattgtgttttcatgtgaacacattttatttgaaacaaatatttaaattgctaatccagaaaataatagtgaattctctttctttacacgtttcttttttttttttttttttttctgatgcagagtctcgctctgtcgcccaagctggagtgcagtactgtgatctcgactcactgcaacctccgcctcccgggttcatgccattcttctgcctcagcctcccaagtagctgggactacaggcgtccaccacctcgtccggctaattttttgtatttttagtagagatggggtttcaccgtgttagccaggatggtctcgatctcctgacctcgtgatctgcccgcctcagcctcccaaagtgctgggattacaggcgtgagccaccgtgcccggcctatacatatatcttttaaaaaataaatttaaaacttatttcagatctttggtgtttgtcttaggttagacttttcctcatgtaattcactcctaaaactccttcctatattgaattaccatcttgggctgggtgcggtggctcatgccgtcattccagcactttgggaggccaaggtggacagatcacctgaggtcaagagttcgagaccagcctggccaacatggtgaaaccctgtctactaaaaatacaaaaattagttgggtgtggtggcacacacctgtagttccagctactcgggaggctgaggctggagaattgcttgaaccctggaggcaggggctgcagtgagccagggtcacgccactacactccagcctaggtgacagagcgagactctgtctcaaaaaaaaaaaaaaattaccgtcttgaaacttttcagttgtagggagaaggaaggaggtcttgattctgaaagtacacattttcttagagtcactagaaatagacttgtgcatttattatttaagaattattttaaatacacactttgtttcatacacgggctaggtagctcttcaaatctgtagttttacaacaatattgccagaagctcattttaactacattcataaggtcttcatcagaaatgcatttagttattcaaccaagcattaccatttgagcaattgtctcatggaggtgaacactagataaataatcacataaccaaatatatccttacaaattgtggatgatgctatggaggaaaaatagccatgaaagttaacagagtgaggttttttttaaaattgggcattcaaaggtgacttgtctgaagaaataacatttaagctgaaacctgaaggataaattgaaattagcttattttttctaagtgtttaaataaccatattttgaatttttgcaaatcagtgtcatgctcattggtatagtatatagttcctgacatccattctcctgtaccctttccccgccccctttttaaaagtaaattttgaaaatacttgctaagagttgtagtatatatttactaaatttcaaaaaattcacctgaggtcaagagttcgagaccatcctggccaacatggtgaatccctgtctctactaaaaatacaaaaattagttgggtgtggtggcacgcacctgtagttccagctactcacaacatagaatattttctatgtaattagtccagtagctccaaaattaggaaattaacaaggaagatcatttttttgtttcaatcatcaatggattaacaactaatgatagaattattttgtctattatctattaatcatcaatcattttgtatattaataaacattagcataataaacattaacataagcataaaaatacttgctaattcccattccctgtcaactcctttatggacacaacaatactttggtaatcatatttgcaagttctttcagatctttgggtcatttagaccagagaaatgagctaagccttagcttaataaagtaaggtgttttttccagtcttaacactttaaactttttttctttttcacattttgttgacatacaccatacatacaaaaagtccacacgtcgtaagtatccagcttgatgaatatttgtaatgtgaacacatttgtgtaaccaccagctcctggatcaaaaaagagaataccccagggcctctttctaggtattggttatccccaaaggtaaccattattctgatttctaacagattattttgcatatttagaactctatataggtagaatagtgtgcgtccttttttgtctggattttcattcaccaaatgaagattactttctttaatagatgcaatagaagtaaaattggaattaagtaattagtaattattgccatctgttaacattacaccatctgccaccagatatgggcccttacttttccttaacttttcacgcttgcaattcaactttaaaacttttgtattagttcagaagcctcctcttgtttaatcattttagcccttctaatgtgcttataaatctaagctactaatttatatattatatttggttacttgatcctcctcctgttgttgtgctgccttctctaatttatagaactaaaaattcttgcatgtcacagcatatctttttaaatattcaccttagttgccttagagacccctttcttttttttttttttggctaacattatttcctttccagttactaaggttcaatttctgaaaatacttgtagtaggaccaaaaatgaaattaactaaagaaatctcaagcaatttcttatttcaagtttaagaattccccaagtaagcagtagaaagcaaacttttcctgaaacaacgcctgaagtttattcagacaaaacttaattgattttgatgtgattttacagagatgtggagagctcttcaagagaagattcttccactctttatggtcagagtatctgtccctgattccaggccttgctctctctattgctccattgaggagagaatcacattgtttttatttagtgacattgagattcttgaaaacaaaagagagctagtccccagagtttcactgagaaattaaactagtggatatcatctgtcaattgtaactcactttactccatgggattttgctttgaatatttcattttcccttagattgtaagcttctaaagtgcagataataaccacattcactatccatctacatccctccaccccagcctcccaaataactcctaagtctctttcttagcccatctcaaaatgcctaatcacattgtggctatgtagtcgattaagtgctgatattcacgaattaaatttaattatgatctctaaaaatatgcacttatatttaagtcatgtattgaagttttaagacaaatacttcagatataggccgtgctactcaaaagtcctgatctgtgacaagttagggagcttgtgccaaaatgtaaaagaaggcactgcttccttcaagagagtctttctgacagaagtaaattgaaagatatcccatgttcacggatttggaagaattagtattattaaaatatcagtactacccaaagtgatgtacagattcagtgcaatctctatcaaacctctaatgtcatttttcacagaaatagaaaaaaaaaaactaaaatttatatgaaaccacagaagaccccaaatagccaaagcaatcttaaaagaatgaacccagaagcatcacactacctgatatgaaaatctactgcaaagccataataatcaaaacagcatgatagagacataaaaacacacacacagaacagtggaacagaaaagtttgctttctacggcttacttggggaatgcttaaatttgaaataagaaattacttgagatttctttagttaatttcatttttggtcctactacaagtattttcagaaatcgaaccatagtaactggaaaggaaataatgttatacagaaaaaaagaaaggggtgtctaaggcaactaaggtgaatatttgaaaagatatgctctgacacgcaagaatttatttcaccagaagtaaatccacaaatttgtagttggttgatttttgacaaaggtgccaagaacatgccacaggaaaggacagtcttttcaataaatggtcttggaaaaactggctatctacatgcagatgaatgagaccaggcccttatttcacaccatatacaaaaatcaactcaaaatagattaaaatgcaaacataagatgtgaaactgtaaaactactggaagaaaacacaggggaaaatctccatgatactggtctgggcaatgttttcctggatatgaccccaaaaacacagccaacaaaacaaaaatagacagatgcaattatatcaaatttaaaaggttctgcacagcaaaagagactattaataaagagagaacctatagaaaatatttgcaaaccatacatctgataaggggttatatataatgaactcaatagcaagaaaactaacaattaaaaaatgggcaaggattgggcacggtggctcacgcctataatcccagcactttgggaggccgaggcgggcggatcacaaggtcaggaaatcaagaccatcctgggtaacacgggtgaaaccccatctctaccaaaaatacaaaaaattagctgggcgtggtggcatttgcctgtagtcccagctactcgggaggctgaggcaggagaatggcgtgaacctgggaggcggagtttgcagtgagccgagatcacgccactgcactccagcctgggtgacagaacaagactccatctcaaaaaaaaaaaaaaagggcaaaagagcagaataaacattctcaaaacatagaactggctaataggtatactaaaaattgttcaacattactaatcagagaaataaaattaaaactactgtgagatatcatcttacacctgttagaataaccattatcaaaaagatgaaagataacgcatgttggtgaggatgtggagaaaaggaaactcttgtacactcttggtcagaatgtaaattagtatagacattatagaaagcagtatggggaagttcctaaaaatagaactaccatgtgatcaagcaatcccactactgtgtatatatccaaaggaaaaatgaagccagtatgttgaagagatacctgcactcccatgtttattgcatcacaatacccgagataaggaatcagcccaaatgtccaccagtagacaaatagaaaaagaaaatgtggtatgtatacatagtggaatactttttagccttaaaagaaagaaaccctctcttttgcaacaacgtggatgaacttggaggacattacattaccagaaataagccaggcaaacaaggcaagtatcacatgctctcacttatgcatggagtctaaaaaagctagactcatgtaggatggtggttaccaggggctggggccaggggtggggggtacagggatttggggagatattgattcaaagtataaaaaatttcagttagataggagggataagttcaagacctttactgtagaacatggtatattggtcagttttcacgttgctgataaagacatacctgaaactgggcaatttacaaaagaaagaggtttattggactcacacttccatgtggctggggaggtctcacaatcatggcagaaggtgaaaggcacatcccatatgacagcagacaagagagcttgtgcaggcaaacttgtttttaaagccatcagatcttgtgacactcattcactatcatgagaacagcgcaggaaagacccacccccataatttaatcacctcccacggcacacgggaattgtgggagttacaattcaagatgagatttgggtgggaatacagccaaaccatatcacatggttatgaactatagttaataacaatgtgttatattcttgaaaaatcactgacagtagattttaagtgttttcaccacacacacaaaaatgaaatgtaaggtaatgcgtgtgttaatttttttttttttttctgagatggggtctcattctgtcacccaagttggagtgcagtggcacaatcttggctcgctgcaacttctgcctcccaggctcaagcaattctcctaccctcctgggtagctgagaccacaggtgctcaccagtttgctcagctaattttttgtatttttggtagatacgggatttcgccgtgttgcccaggctggtcttgaacttctgagctcaagcaatctgcccgcctcagcctcccaaagttctgggattacaggcatgagccactgcactcagctgtgtttattaactcatagctattattccacagcttatacatatttcagatcatcatgttttactcaatacatatatagaatttttgtcaactttttaaaaataatatgtttaaagcaggtctttctgtctaaataaagagctgaactaaacagtgtgcttagtttcacagttggtttacattctggcacaagctcacctccccacctttttttgttactttagaggcttatcaccctgaaggtaaaagctccttatcttgtagcagaactgtaacaaacagtttgagaattattaactagtgtaaggatcacacttcaaataacagatactgatccgtcaaaattgaggatgacagatgacatctgtttattaataggtactgtttacctggcctctgactcctttcgtgtgaattgttttttcttttacctccttgctctctttcttcccaatttagagaggcttttatgcatcaacacttaaacacacatctgtacctcttttttttcatcacattgtagacagagttatgtaggaattaagtaacttgcatagtcacaagctaataaatggcagagctcttaccattatgctataatgcctctcaaaatacatgtgtgttggttgaataatgcttcgtgggttgagaatgagcccaaaacctgttacttatattttcaacttttggcacattatattaaatttgacctaatcttttcttgatgattggtcagtcaggccataggcccttattttcattagatttggaggtgaggcaagtttaagatcctacataaagaaaaaatccacccaagtgccccacttgcttgataagatccagtacttgtttagttaattgtttgaaagatcttttaaaaatactctaaattcccccatattaataagccaaaaaagaaaaatatgatcatatcagttactcatttctgataaaaggaatagaaaggaattgcctcatcttggtaaagagcaccacaaaaacctcacagctaacatcacacttaatggtgaaagactaaatgctttcccctgagattcagaagcaaggtgaggaagtccatcataactgctcttattcagtataatgctggaagttctagccagtgccatataaggcaagaaaaagaaatgaaaggtatgtagtttgtaaaggaagaactaaaactgtccgtatttgcagataatgtgattatctatgtagaacatcccaaggaatctatcagaaagctcctggaactaacaggtgagtttagcaaggtcacagaataaagaaatcagtcgcatttatatatgctgaacatgcagaaaccaaaattaaaaacaatacaatttttagacaattcaaagaaaataaaatacttcagtatatattaacaaacatgtacaggatttatacagtgaatattacaaaatgctggtgaaagacatgaaacaagacaagtaaatggagagatgtatactgtgttcttggattggaagcctcaacgtaataatgacattgattctccctaaattgatctgttggtttaatgcatttcctattgaaattcaaccaagatattttgtggacatagatagacatttaaaaatgtgtatggaaagacacagtctctagaatagctaaaacaatcttgacaagaaaaaaggggaaattacttcacgcaatatgaaagcttatagtatatagctatagtaatcaatactgtgtgttattggtagaaggaaagacatagaccatggaacagaaaatataacccagaaatacacctgcacaaatacctccagctgatttttagcagttacaaaaccaattcaatggagggaaggacagctttttcaaaaatgatgagcctaaacttcacaccttatgcaaaaatacaaaatggattatagaattaaatgtaaagcacaaagctataaaagttttaggaaaaaacatagagaattttctggatctggagacaaagagctatatttggccacgaaagcctaatccataaaagaaacaattgataaattggacctgattaaattaaaaattttgctgtgtgagagcccatatgaaaagatagaaaagacaagttagatattggaagaaaatatctgttaaaccacgtattcagtaaaagactagtatccagcacatacaatgaactctcagaactcagcagtaagagccaggtgcagtggcataacacctgtattcccagctactcaggaggctgaggcaaaaacaactcttgagcccgggagttggaggctgcagtatgctatgatgttgcctatggacagtcactgcactctagcctgggcaacatagtgagacccctggctcttacacacacacacacacacacacacacacacacagacacacacacttaatagtaagaaaaaacaaaacagtctaatttaaaaagatgtgaagagtcatttcattgaaaggaggacatacagatattaaataagcacatgaaaagatgttcagcatcgttagctattagggaaatagagattaaagccacaactacacatctatcagaacagctaaaataaacagtagtgacaacaccaaatgctggcgaagatgtggagaaactgatcactcatgttagtggtggaaatgtaaaatggtacagtcactccggaaaacagtttgtcagttttttgtctaaacatgcaacctctgtataacccagtgcttacaatcctggacattgatctcagagaaaggaagatttgtattcatatgaaatctgtacatgcatgtctatatagcaactttattttttaatagccaaaacttagaaacaacacagatggcctttaatgggtaaatagacatactgtaatatgtctacagtatatctatatgatgaaatactatttggcaataaaaatgaacaattatataagcaacaattgttgatacaagcaacaatttatataaatctccagacaattatactgagcctataattctgtcataaaaaggttatataccatacgatcccatttatataaaatttttgaaatgataaaattttagaaatggaagacaggttagtagttgccaagggttatatacggtgtcagatgagaaggagttgattttgcttataaaaggaggaatgcatcttgtgtttttggaagtgtttaccatcttgactgtggtggtagataacatgaatctatacaggtgataaaattgtatgggatgtaatacacacacacacatgcaaatacatgtaaaacgagaagtctgaataaaataagtggattgtatcaatgtcagtatcccagttgtgatactgtactatagttttgcaaagtgttacctttggggtaacctgggcaaagcatacaagggatctctccatattcttataactgcatgtgaatatacaattatctcaataaaaatttcagttaccaaaaaaagtctaagttagtatcgaaaaaagcagctatttgataagatgaattaaatgatcctgcagggaaaaaagaaacatgcattagattgtcagttcttaacatgattcatgaaccagtagtgttattttaaaaaatttgttttaatcaaagcataacacactgaacagagtgcccaaaacataaatataacttataaaacttgtgggtgaatatccatgtagtcacccagcagtaatatcatttcataaatgttaatattgaggggaattttcattgagtatattttcctacctcattaaaagcatttagatgcaaccagggttggactatttcttaaaaaacaaaacaaaacccaaggaactaaaacctaaactagatgaagatttaaagtgagggtattattggataaaaacagatttaattacttatttcaagcttgaaagggggctgataaataatgtaattatccttttcataagatttaaaagaattggcatcaaacttgctccacaagtttaggtatagaattgcaagccagtttttcaaggtggaaagaggaatttgggaatgaaaaggaagtactttatatagagtttaataacatacagaacttactaactcaaacaatatattaagttgggttataagaaatcgcccatagttaactgctttgacctacaaagcagttcatgtggttcaacctagtaaaaaacagaagatccaaaagggctaggtagatacatgcatacgtggataatagattaataatggatttttaaaggaatttaagaaatccatttaatccatatgtgtgtttaaggattggttgggtgttgaaattaggtaagttcccataacccctgagctgctttctcacctgacaaaagaaaagtataccctttacggatgctgaatttattgtagtgcagttttcaggagggtaaaaatctctaggtatcaactgaagggacagtttaagttactggttttaatgattaatctgaccattagaaacctgcccagtgattatttttccttggcttgtacatatttttgttaagagtaaagtatggggcgggcgcggtggctcacgactgtaaccctaccacttttggaggctgaggtgggcggatcacctgaggtcaggagttcgagaccagcctgaccaacatggagaaaccccgtctctactaaaaatacaaaattagccgggtatggaggcgcatgcctgtaatcccagctattcaggaggctgaggcaggagaatcacttgaacccgggaggtggaggttgcagtgagctgagatcgcaccattgcactgcagcctgggcaacaagagcaaaaactccatctaaaaaataaaaaataagtaaatatggttcttgtgccatagatattttggtctatgttaggatgttttcaatttaaatgcaggggttgttacccaatgtttgataaaagaaataatttacaaagaagctataatagctctaaactagtatatgcctaatagaatgcttttctctctctctctctctctctatctatctctctctctatatatatatatatatgtgtgtgtatatatatatatataaagtcaaaatttgcaaaattagaaggggaaattcatcaaagatataatcattgtgggagattttcttagtaatgaataaacacaagaagagatagaaaatttgaataatttaattcacaaattttaactaatagacacatgtaaaaccacatatgtgtttggaaactggttttatgatagaataagatgtagtttccaaactctgcgctgaggtaacatggggctccacagtgacctgaaagggtctttgggatatttcagttttgagagaaatacagtgacatctttcagacaccacagaactattagatctcgaggtagtccacagtttaaacacttaaataacactacattcctttctacaattattttatctaagagtgaaataattttttcttttagtttatttgtttttcttttctttttcccaaatgactactttggcgtacactgtggactgagaaagtttgggaacttctggtataaagcagatgtcagctaatttcagtgtattgtacatacatgttctctgacttcaatgtaattaaattagaaatcactgaataagacagttacaaaaacctcatagttgtgaacgttttaaagtatgtctgaatatattgaatatattgagtataaaagaaatcttaatggattctaggaatacctaaaaatgaacagtaggaaaactattatatgtcagaacctgtagaatacagttaaagtggtaattcaggagacaaatttatagcaagtagagagaaggaacaacaacaaaataccaggaattttagaagtcttattaatttaaatacagcataaatttaaaaacatgagtgcatcatctagttttttgcttcataatacaccactccaaactatgtagcttaaaacaatagccattttattgagctaacaattttgtgggttggcagagtgggttttctggcacaggccagttcaactgttttctgcaggcttcccttactgtctctggtcagctgacagggttggttggtgactagatgatctaacatggtctcaggtaacttggctgggacttgtttgttgtccacacagtcttattctccatggctcagtgttcacaaggtgatttcaggaaaaaagttgcaaaagagaacctgtccctgatgtgtaagcacttttcaagtctgtttgcttaatgtcccattgccaaagcaagtcacacagccatgcctacagtcagtgcgggactggatatgggaaggggaattactgccatttttgcaaacaatctacaatttaagtatgagcaaacttacgcaaataggcaaggcacagtggctcacgcttgtaatcccagcactttgggaggccgcggcaagcggatcacttgaggccaggagtttgagatcagcctggccaacacggcaaaaacacatctctactaaaaatataaaaattagccaggtgtggtggcgcacgactgtaatcccagctactcaggagtttgaggcacgagaatcacctgaacccaggaagcagaggttggaagtgagctgagattgtgccactgcactccagactgggtgacagagcaagactcttgtctccaaaaaaaaaaaaaaaaaaaaacaccacagtgggtgcttaatgaagtgtgtgtgtgtaaaagccagccaggaaattttgttaccgaagccagaatgtgacccttgtcattggtttgcagtatgcacatttaattcatattatccttatgtgttcagtatttgtttcataattgcctaataaagttgaagtagttttaatggatttttcattaacagtagtccttatgacttcttaagcatttattggttgcctttcagaacaaaagagatgaacacttattgaaaaagagaaatgttccccaagaagaaagtctagaagattcagatgttgatgctgattttaaagcagtaagttaccatgttttaatagtgattttaaaataatttttatagtaactgtgagaacttcatttttaatataagaccaactttataatgataatgaaagtatattaactcaggtacactgtttaatgaatgtaattttgttaataaactctgctgaactattttttttttctttttaagcaaaatgtaaccctagaagctatattgcaggtatgttactaaattaatactctcgttttgaagtattttgaaattgattttttttttttcatttctgaaatttacatttggtattgcagaatgccacaagtgataacccagtggtccaattgagtgctgtccaggcagcaaggtaaatactaatttgtctagagagagaattatgtcattcctcagttgtgttacctggtagtctagaagttaatatgttgttatttcttttcacagtttgaaaattatagcaattaatttctcatatttattttcctagaaaactgttatccagtgacagaaatccaccgattgatgacttaataaaatctgggattttaccaattctagtcaaatgtctagaaagggatgataagtaagtatggattttactccctattcagtttttttcagttaacttaaaagtttggattattacttaaccagtgagttcagtttggttttgtacttatgatgtttttcaatcgtcatatattttaatttaattttcttattctgtgatcatatttagcagacccagagtgcttctcgttttcatttctgaaggatgtgtatgttttctaggaaatttttatctcctgtttattgcctgttttaacttatctcaaatatttatagtctttattaggattttttattagtaatattttaaaacaacccaaataatgtttgagtcactctttgcttatgagcctatatatagattaacctcatgactaagtcaacatggatggtttccagaactaagtggctctttcttaccctgggaatcttccagctgattactgatcctctgtgttgtctttaacagaacttcatccatgataagttgtccaatgtcagactttttgtttgctgcaaattaagaataaggggacaggttatatttacccaggagagaaggagtaaaactccactggatatcttttgaggaactggccctatttccatttttgtttagtgatatctcagtgctgtgccttaaactttgttaatttggattaactggggagaatataagtttgaactccaaaacatattaaaacaaatgctttttttttgcatttaagagcatctagactgaaacttgggatattttgctaaatgttgtccaaggaattttcagttggctagataagaatagtggtatataaatgttgccactaagggtttttagtatttaaaaataccatttgctttcgttgtgtgccacaacctctcccactttccacccccaggcctgtaacactttttaaaatactatcatgtttgttttctgtaacagtgttacttaagtaaaggtaagttttattttagctgttgaaaaaataaattctggctggacgcagtggctcacgcctgtaatcccagcactttgggaggccgaggtaggtggatcgcttgagtccaggagttcgagagcagcctgggcaacatggtaacatcccagctctacaaaaaaaaaaaaaaaaaaaacacgaaaattagccaggcatggtggcacatgcctatagtcccagctacttgggaggctgaggtaggaggatcgtttgagcctggaatgtggaggttgtcctgagccaatatcatgccattgcactccagcctgggtaacagagcaagaccctgactcaaaaaataaattcggctgggtgcagtggctcacacctgtagtctcagcactttgggaggctgaggcaggtgggtcatgaggtcaggagatcgagaccatcctggctaacgtggtgaaaccctgtctctattaaaaaatattaaaaaaaatcagccgggcgtggtggcaggcgcatgtagtcccagctacttgggaggctgaggcaggagaatggtgtgaacctgggaggcggaggttgcggtgagccgagatcgcaccactgcactccagcctgggcgacagagcaagactccgtctcaaaataaatgaataaataggggggaggggggagggatagcattaggagatatacctaatgctgaatgacgagttaatgggtgcagcacaccagcatggcacatgtatacatatgtaactaacctgcacattgtgcacatgtaccctaaaacttaaagtataataataataaaaataaaataaaataaataaataaataagttctattctacttctacctttaggaccctccagttgttcttttttttttttttttttttttttttttttttttttgagacagagtctcgctctgttgcccagggtagagtgcagtggtgcaatcttggctcactgcaatgtctgcctcccgggttcaagcgattctcatgcctcagcctctttgagtagctgggattacaggtgtggctaatttttgtatttttagtatagatggggtttcaccatgttggccaggctggtcttgaactcttgacatcaggtgatcctcctgccttagcctcccaaagtgcagacattacaggcatgagccactgggcccggcctagggccccttgtttgtggccaacttctcttcttctttttttccttttctttccagtcttttatatgtagactcatttgtgtgtctgtgtctatgaaacataacatataatacagaaaaatatgctaaaatatatacagcttaatgaataattatgaaactcagacctctgtaaccaccacccaaagcaaaaacagaaaattttccgtgatttggatctgactttatggatttgtcatgggaagttgtgttataatgtaaaaggccatatactttggagccagattgactgtggttcaaatccagggtttgctgttgataaaaatccacgtggcttttgaacctcagctatctcatctataaaaattaggtgatggtaaggaatggaaataatacatacaaagcactctacacaatgtcaaacttatgataaatgtccatttattttttatttttatttatttatttttttgagaccgagtctcgctctgttgcccaggctggagtgcagtggcacaatcttggctcactgcaagctccgcttcctgggttcacgccattctcctgcctcagcctcccgagtagctggggctacaggcgcctgccaccacgcccagctaatttttttatttctagtagagatggggtttcaccattcacaggatggtctcgatctcctgaccttgtgatccacccacctcggcctctcaaagtgctgggattacaggcgtgagccaccgcactcggccataaatgtccatttgttattgcactcgttttttctatatcttttctcatttttttttatttttccacatgacatcttgaaagactttctttggctttataattttattttttacatttatccattttctcatttaagtcccccattcccagtattttgccaaaccacctaaccagcttaataactttctccttccagtctgaggcaacatatactgtcttactgtttttgatcttactgttttttttacttcttccctgcctctgatataccatcttatttcctgccttctgctagaattcatcatatacaggggaaattttaaaagtttgtggaaaagtggaatcaaaagacaataaaatatatgaaagataataaatatataaacttgatttctcaacataagctccatcaaggtcaagacacttttgtaagtgatactaccagccattgtctatccctaaagaactgagggtcctgggaatttaaccatgtcagcgcagtctttttcatgatattaactgaagaaaactagatgccctttacaggttgtttttttaagattaggaaacaaaaagaagtcacaagatggccaaatcagaactgtaaggtggatacctaatgatttcctattgattctcttgcaaaattgctcttgtttgatgagcagaatgaacagaaacattgtggtggagaaagactctctggtaaagctctctcaggcttttttctgctaaagctttggctgactttctcaaaacactctcataataagcaggtgttatcattctttggccctctagaaggtcaacaagaataataccttgagcatccccaaaaactttttagtcattacctttcctcctgaccagtccacttttgcttcgattgtactttgtctttaggatcatactgggaaagccatgtttcatctccttttacaattccttgaagaaatacttcaggatcttgatccctctggtttaaaattttcattggaagctctgctgttgtctacggcttatctgggcacaatggttttgacacctatcaaggggaaagtttgctcaactttaatttttcagtcataattttgtaagctgaaccaatcaagatgtctggtattggttattgtttctgctgttaatcagcaatcatcttctgttagggcacgaccaagattaatcttttcctcagatattgttgttgattgtttgccgctgtggatttcatcttcaacatcgacttgtcctttttttttttttttttgagacagagtctcgctctgtcgcccaggctggagtgcagtggcacgatatcagctcactgcaagctccgcctcctgggttcacaccattctcctgcctcagcctcccgagtagctgggtctacaggtgcctgccaccacgcccggctgactttttgtatttttaatagagatggggtttcaccgtgttagccaggatggtctcgatctccttacctcgtgatccgcctgcctcagcctcctaaagtgctgggattacaggcgtgagccaccatgcccggccgacttgtcccttcttaaaaggagttaaccatttgtaaaccgctgatttctttgggggcattttccccgtaaagttttaagtacatcagtgagttcaccattatttcacccaagcttcaccataaatttgatgtttgtttttgctttaattttagcaggattcatgttgctcttctaggggctcttttcagattgatgacttaccccttacccctcttagtgcctcaaactagatcatgttcagacgtgtatagaaagttagtatgagtttattttggtgcaaaaaaattgaaatccatggagtttttttcataatacacatttttaatgagttttttaaagtcccctcatagttcttctctgctacttcattttctcatatgttccatctttttaacctgtatatcactatttgctatatctctgacatctattctccttaaaaccttttgttcttggatctcttcaaccttttttctcttttttctttcttttttttttttttttgagatggaatctctctctgtcgcccaggctggagtgcagtggtgcaatctcagctcaccacaacctccgcctcctgggttcaagggattctcctgcctcagcctcccgagcagctgggattataggcacgcaccatcatgtccagctaatttttgtatttttagtagagagggggttttgccatgttggccaggctggtttcaaactcccgacctcaggtgatccatctgccttggcctcccaaagtgctggggttacaggtgtgaaccaccttgcccggacttctttaaccttttgatactaacaaccttgcttgctctcttccctgtttataggcttttcttcaaactccctaacctttgtctaatcttaatttttgctgactaaatccccccaatccttggtattccacttaagggaatttgtactctttcagctatcctaacttaatatctatcatttccttttaacaggtctttcctttatgtcttttttgtgacagggtttcactctgtcacccaggctggagtgcagtgacacaatcacagctcattgaatcctcaaactcctaggctcaagcaatccccccatcccacccccgcccagcatcccaagtagctgggactacaggtgtgtaccaccacatctggctgatttttttattttttgtaaaaatggggtctcaccgtgttgcccaggctggtttcgaactttttggctcaagcgatctgcctgcctcagcctcccaaagtgctgggactacaggtgtaagccccaacatgtcttttaataggtctctcctatatcagcctttaaccttttttagccattctgcataccattgatttgaacattattttctttcctccctttttcaatgccccatccttagcatatctgtagaatacactcctcactcccatcctgaaacacacacacacatgcacaaacaccctgttacttgcttcttagttagtttcagctctcttgatctaatccttgtcgttcctacacatcatgatccttccatgcatgatacctgttttatttcccactgtcactgcctttctttttaaatccatctttgaaaagctagttcagttgtcactttctttgtgaggtcttccattactattcgaaaatataatgatcttgttttttcaacaaaattatacagccttgtaatatccctagtatgtaaagcagatggtgtaatggagacagatggggttctagctttaagaccagcctagagcgtgtgatagtggttaaagtgagatgatgagggcctcaactagcacttgatattaggggtgattatataaatgtaagaaatgtttaagaggtaaaatcgacatgatatattgattagatgtgtctgtggagaggaagtcgaagtcaagggaaataatgactggctaaatgttgtaataccagtggacataaagaagcaagttcatagtgactggctttgggagccaaagagattttttaagtagagatggctgctgggtgcagtggctcatgcctataatcccagcactttgggaagccgaggtgggcagatcacctgaagtcaggggttcaggaccagcctggccaacatagtgaaaccctatctctactaaaagtacaaaaatgagccaggtgtggtgatgtgcacctgtaatcccagctacttgggaggtggagacgagaatcacttgaaccccagaggcagagattgcaatgagtcaagatggcgccactgcactcccgcctgggtgatggagggagactccatctcaaaaaaaaaaaaaaagtagggttggctagcaggcaattggattataacaaggtgaaattcaaggacaaggcaaagaatagccatatcttatcagtcttaagattcattaatttaagtggtagttatgtgtctaaaaagatgtgttattgtttttttacagtccttcattacagtttgaagctgcttgggcattaactaacatagcatcaggaacttctgcacagactcaagctgttgtgcagtctagtaagtaaattccttactgtctgaactttttgtgttttaatgatggcaaggaagtagagttttgtaataaagaaattttatcttgtaacattttttaaatgatgacttttataagttacttttgatgaccgatatctttttcatagccgtcattaatttatcatgaaaaatttttaattgtggttattaaaagaagagtagagttttatcttttggagtagacatcatgctgtgataacaggattttaaattccgtttctgatatcttcaagatgctgaatggcttctgccttttagcttatgacatattttaaattttactttcctcaagatgggctaataattattgttaaatgacactgacacaagctctttagaaaagtactagatatcaccacgtacgttattatagtatgggacacttagctaattttaggtgtggtaatcaaggtgattttaagtagcatgtgatatggcagtaagttacattgaatcatgtattgagaatactattctcaccagacccacaggtggctcatgcctctaatcccagcactttgggaggctaaggcaagcagatcacttgagttcaggagttcaagaacagcctaggtgacatgacaaaatcgtgtctctacaaaatatttaaaaattagcattgcatggtggcgcatgcctatagtcgcacctactcaggagacagaggcgagaggatcgcttgagccagggaggcagaggttgcagtgagccgagactgcacactgcattccagccccggcgacagagtgagaccctatctcaaaaacaaaggctgggtgcagtggctcaagcctgtaatcccagcactttgggaggccgaggcgggtggatcacgaggtcaggagatcaagaccatccttgctaacatggtgaaaccctgtctctactaaaaatacaaaaacaaaattagccgggcatggtggcgggcgcctgtagtcccagctgcttgggaggctgaggcgggagaatggcgtgaacccgggaggcggagcttgcagtgagccgagatcgtgccgctgcactccagcctgggtgacaaagcgagactccacctcaaaaaaaaaaaaaaagttatcatgtgacccagcagttctactcctaggtgaaaccaagagatatgaaaacatattcatacaaacacttgtacataaatattcacagcaatgttattcataactaacccaaatgttcattaaccgaggagtggataaagtgaatgtggtgtatacaatggaatacaattcagcagtaaaaaagaatgaagtaccaatacctgttaccacatggatgaacctgaagaatgttaagtgaagtcagaccccccaaaaaacacagtatgatttcatttgtatgaaatgtccagaataggcaaatctgtaaagacagaaagcagatatttaatggttgcctgccgcttggggaatgtgtggcagaggaacaaatgtggaatgactgccttaagtatgagatttcttttttcttttttcttttcttttttttttttttttaagacggagtctcgctctgtcgccaggctggagtgcagtggcgtgatctcagctcactgcaacttccgtctcctgggttcaagcaattctcctgcctcaccctcccaagtagctgggactacaggcacacaccaccatgtccagctaatttttgtatttttagtagagacggggtttcactatgttggccaggatggtctcaacctcttgacctcgtgatctgcccgcctcgcttcccaaagtgctgagattataggtgtgagccactgtgcccggctgagtatgatattttttttttttgagacggagtcttgctctgtcacccaggctggagtgcagtggcacgatcttggctcactgcaacctccgtctccctggttcaagcagttctctgcctcagcctccaaagtagctgggattacaggcgcccaccaccacgcccggctaatttttatatttttagtagagacagggtttcaccatcttggccaggctggtcttgaactcctgacctggtgatccatctgcctcggcctcccagagtgttaggattacaggcatgagccatcatacccagccaagatttcttttgaggtcctggaaatgttataaaattagattgtggcgatgtcctcacaactctgtataaatatgaaatgtcattgaattacacacttaaatgtaaatttattgtaattatatctccgtaaagttgttaaaactgaattaatttaaattttaagtaaataatacaagtaatacacagatacagcaaaaaaaaaaaatgaggtagtgcacagttgattgaaatttttaaaaagtgatctagcttatgctggaaatgggtataatgtatacattctgtaaagagtaaggattatgagaaattattttaaagtataagatagacctgatatgagattaatcagttctttggttaatccccgtatcaggaattgagattttgtagactaaagcattacattttaaggttacatgtttggggtaggaactctttttttttttttttttttttttaatggattataggaaggatttcatgctgttgctttcttttagttaatggtatgatagcaacctttagatactgccagttggttacggtacttgactattactaggggaaaatactgaaattgattctttttagggtaaagatatttgccacatttgttcttccagctacaatatgccaggctgtgtatttgatcaatttctttgatctgaaatctgtaaactcttcaacatgttgctagtataaatattagtttttctttattacagatgcagtacctctttttctgagacttcttcgttcaccacatcagaatgtttgtgaacaagcagtatgggctttgggaaacattataggtaagtggtttgaaaggaatcctcttaagaatctaaattaacttttttcctacattggcatagccattacatactatgtttcctctgaatttaatgtgtgttgactctcttcttgcctcataagtactgacttaagatgatgctctttgaaaaggatatacagtttgctgttagcattggtaggttaaatttacgttccccagatcaaaatctggagaaacaacacttgatgcctttgactaatggtgaggaaacatagaacgtcagtgttcccacatgagccattgcatacatttcagactttctcatcctgaatgtaagttttttttaaatataattttcatttctgtaggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggaggtaaatgaagaattgtaaaggccagatggtatattttccctatgtttgtacttcaggaattcatgtacaggggacaaaataatacatatactgatttcattgcaggtgtgagttttttgtttgtttgttcgtttgataacggagtcttgctctgtcgcccaggctggagtgcagtggcgcgatcttggctcacggcaagctccacttcctgggttcacgccattctcctgcctcagcctcctgagtagctgggactacaggcacccgccaccacgcctggctaatttttttgtatttttagtacagacggggtttcaccatgttagccaggatggtctcgacctcctgacctcgtgatctgcccgcctcggcctcccaaagtgctgggatgacaggcctgagccaccacgcccagccacaggtgtaagattttaaaagtaacgtaccatatttaattactcctatgaaataaaagttgagtgtcttactgtacctgaaagaatgtcagttcatcctaatgcctatttttttgattatctgcataaaaagaaaatataaaaattcagagagaaaaatacaaaaggaaaacaatctcaaagttttattactgtattgcattgttggtttaaagctataaaagggggttgctacaggcaaaactagtatacttacatgcaaatgttcttgaatgagtttgctttaagtccaattgattttttttcttcttcttcttcttttgagacagtcttgttctattgcccaggctggagtgcagtggcatgatctcagctcactgcagcctctgcctcctgggttcaagcgagtctcgtgcctcagcctcctgagtagctgggattacaggccagcgccaccacacccggctagtttttgtatttttagtagagatggggtttcactgtgtaggccaggctggtctcaaactcctgacctgaagtgatctgctcacctcagtatcccaaagtgctgggattacaggtgtgagccactgcccccacggcctaactccaatttattactgacaaaattggagttcttaaaagtgtgacatattttttgttaaatctactaattaaaacaaagtaaaaacttttttatttacatttgatatgtaaatagatccttgtgctttgcattttaaaaaaaaatcctacataacctttattcactgttgactgtgttatctcttttttttttttttttttttgagacagtctcgctctgtttcccaggctggagtgcagtggcacaatctttgcccactgcagcctccacatccggggttcaagcgattctcatgtctcaggcatgtgccaccatgccaggctaatttttgtatttttagtagaaatgggttttcaccatgttggccagctggtcttgaactcctggcatcaagcagtccacccacctcaccctcccaaagtggtgggattacaagcatgagccaccacacttggccaactgtgtatctttataatggacatctttctctagtacctgctactttttgttgctatgcaaaggtattttgtgtgatttcctacaaccccctgctccctttctcccatattttaaaaagagatctctggggcctgaatttaacaagcaaagctttgtactttgtactggttcgaattttcttgactaaaggtgaagttgaaaactttaatttgacttaagtagcttattaagtaaaatcgtatttttacgttaagcaggtaagtgagacaattacggcagttttaagtgtagcttttcttaaatagctgtaactgtatatttgcatctccattttttccacttgacattttatgccataaagaaggttattaaaaacaaatgtttttattttaaggtacattaacttctgccagatttatttggatattttaacttgttaattgaacatatttcagtttaacatttgagatatgtttttggtttttttagattgaatttatcaggttttcattttcctaaaagatattcagacaaatttaacattgtctttctcgccctacaaaccatatttaccgctttttatgtcaaagttgttcatttttacagacatattaattaactaatgttaagtattgtttattttctttcctcagattttgccagctttatgtgtcctcatataccatacagatataaacgtaagttaagaagcagcttaaatgtgggattttgctcttgatgggacagaaagggtttttatgtaagtgtcagcatacattttatcaacttgtcaagtttctacaacgtatttacagttttcagaaataggattaagcttaaattaggtttatagcttaaatctgtaagcagtaacagccagacagcaaaaatgctcacttttgagaaattactgcatatgtagtttatttctgtcattattaagtagtgtttttaaaccttaatatttgtaaagcggtaaaacctcatgaaacaccttactttttaaaaaaaatctcactggttcttacaacagataggctagatattattccccccattttatagaataagaagaaacggactctcagagagagattaaatgacttatctaaagtggaagagctagtaagggtcagagtcaatattcaaattaaagtcttctcataacaggtcttgggtacttgtcacaaaaccatgctgcctttttatgctacagtctttttagatatagtatagaagaatatatagttttaaatgcaaggcatttttaggtgattttttttcattatattcagatttagtgaagcatttactgtcaacgttctggcaagtttgatactatctaggcaatctgaaaattctcctaaatgcagtaaggtaaattgttacttttccatggagtaaaacagtggataaatttcggtgactagtgttgatccagtttcttttattctaactaacatctctttctgatttgttgtatatttgtgtttttgtaatcttatctttatctacatacacataacatgtacatacatatgtgtatatgtgtggcagaattgtgaattgtgtgtaatttatcattgggacaaagaaatacatctttgcttacctttctcacaaggcaatataatttgtatataaaaattgtatcacattactctagctcatttgcagattttaagctctcaggatggaatcttttaaaggtagctaaagtcacttcgtgtttgacacagcctaaaatgtcattaaaatgaagtaaaacatgtttatatgccgtcttatttccaaaatggatataaagtgacttaacaaaagacatataagataatatctgtaaaggaaaaagtaaaatttatacagaagtttagttgttgctgttgaaaggtaagtttagttgtaagctttctgacagcaaagattaaaaggggaataagcaaaatatctgctgtttgcctcaggactttcccccagaacattatagaattaattataggcaaataaaagctttcaccatctgttggttgtgtttatgtgaaagctggggtattaaagtggcagtgtactgtagttacaggtatattagtcaagtttagcaaacactcacaaattattccacttaaagccagaattgtgccatgaattgtacactcagtgataagacataaagagaccatgccttctaagaccttaacattaaagatgtaaaaagagttaaaaggaaagaacttatgtcaagaaattgctgtgctggatctctctgtagactccttttatcttaccagtatccttgtaagataagttttattcttctattttacaaatacagagattgaaactcggtaaagttaaataatctttctaaggtcatgcaatgaatgagagccatacctgagaactgaagccaggtccaaggcctgtgctttttcataccatgatcacatattcagtataatccataggctcacagtgaaaaaaaaaatcataccataagcacataaacataaaacatggtatgaaagccaacaagaaaaaaggtaagatagagcagtgaccaaagtgctttattatggaagcacagataattttgctagcgaagcagaaagcttcgttgacaaagtaacatttgagacgagcattataaggagacagaagtggggacagagtcaaagattatagtgttcatagttaccatttattgagtttaaaatctgccaggcactgttttaagcacttttgctatgttaacccatttaattcttacaaaagtcttgtgagattggtactctcattatctccatcatctacaaacgttgtaaaagaagcagaggtacttaagtaatttgtctcatgtcatataactaggatgaataggattttcacaggttgagagaaagtcatttcaagaacacgggggaagatattaagaactcaagaatacatggaggtttaagagaatacatgtagataataacctaatacgttcgctaaggagttaatttgcagagtctttgattcttttttttttttttttcttttttttccgagatggagtcttgctctgtcacccaggctggagtgcagtggcgcgatctaggctcactgcaacctccgcctcccgagttgaaggaattctcctgcctcagcctctccagtagctgggattacagtgcatgccaccactccctgctaattttttatatgagtttttgattctatattaaagagttttaagtttatcttgtaatgactgcagagtcattgtagattttttaaatcgagaaatgatatttgttttatacagataaaattatctgtaacagacaaataacacaaatatggaaggtttgaagtagggaaagtttgactgtaggtagatgtattttgctatcataataggtttagggaagttgatgaaggcatggactattactaaattgcaataataggaatcgttaagggagaaaaaactttgagtgttaggaaataaagtgagtagaacttggaacttgttgttcctcagtggcggtattttccaaaagcaaaagacaatacagattttggattcgtcagtatttaagggattgatgaaaacctgggcattgaatgagatcacctggaggaggctgtatttcggaaggagggctaaaaatgtaacttaggaattcctggcgtttcaggaatggcagcaagggaagaagaaccaacaaaggagtttttaaaagtagtatgatgatggctgggcacggtggctcatatttgtaatcctagcactttggaaggctgaggacagtggatcacttgaggtcaggagttgagaccagcctggccaacatagcaaaaccccgtctctactaaaaatacaaaaattagctgggcatcatgatgcgtgcctgtaatcccagctacttgggaggctggggcaggagaatcgcttgagtcggggaggtggaggttgcaatgaaccgagatcacgccactgcactcccacgtgggcaacagagcgagatgctgtgttaaaaaaaaataattaaataaaattaaagtgtgatagaagcataaaatgtggaacaaatagtggggaaaaaataaggcagagatttaataggttctagatcatatagtcttgtctaaagaactacataccctttttatgtagtagataaggagccagagaataaatggtcaaatttttattttaggttgatagctcaaaggctaatatagatcaaaggcaagaaaatcgcttgagcccaggagttcaagcccagcctaggcaacatactgggacctcatctctaaaaataaaaaattagagactacaagtatttgcagtttcagggtgcctaacacccagctgtagcttatcttctcccagcctttgagatattgtcatggagaccccactgaaaaccattagttgagctcagtctacaatttcattattatattagttagaaaaaaaaaatagttttctgctaatagtagtgaccatgtaatggagaaacatcttaaggcatcatgttgttttgcacaggattctgttttgtggacacagtttatttaaacacactattatggataggcatttaggccatttcctgaattttgcaaatgtaaaagtattataccaatgactattgtgtgttttcatattattggaggtatatcttcagggtatattcttagaagcaggattgctgggtcaaagagtaaatgcatttgtaatttcgttgcatactgccaaattccctgctgtaagggttgtgccattttgccttggtatctgggaaggtttgtattcttgttctagtggttgcctttattgtggttgcccttattcttatatcttttcttttttactgttttgatagttttaaatgacatttttcgactcctttatctattatgtagtgtatgcagtatgcattcaaaagtgaaagtgactttctcagtatccttgccaatagagtgtgttgtcacatttaaaatttttgctcatctgataggtgagaaacagtatctcagttttaatttgcattttactttttatgaatgacgttgaacattatttcatttgtttaagggccattttaatttgtatctttgcgaacagactagtcatatttaatgtctgtttttctgtaggatttttggtctttttcttaggttttaagagttctttatatattaaggatattagttctgccatacttaaaatacttccctagtttgtcttttgtctttgactatgatgttttgccatgtgaactttttgtatataatcaaattcatcaattttttttaattgtatctacattttgtctgaactatagatgttttatgttagagaaatatctatacattccttttttgggtgttctatcaaggacactgaaaaaatgtaatgaatttttcagtgtctgtagagaaaattctattattttctccttaaatctattaataaaacttatattaatgatatttttaaaaattgaaccatccttgcattctttgaatcatctcacttgatcattatatgttagtttctcaatgtagtatgtgattctgttaataatattttatttcagatttttacatcagcattcacgtaagtgatattggtttgcagtttagcttttgttcaatttattaggcaataatttacattaattacaaatattaatattaaatttaattatgttaataccattagttaatggtgctataatcatgatgtattaagttttatacttctattgttttattaaagttgaggtgttaatgttatgcttccttcattttctgtactctggaacaatttatatagcatcaagtctgtctgacctttgaagatttgatagtttccctcttaaatcctttggggatttggtacttttttgtggagttagtttcatgataattttctttatttttgatatggaagttggcttgtttaagcactctttctaaagaaggtcagtttttataaactattgttctagtaaattattcattgcatctatgtttacttgcattaaagtgtgcagggtagttttttgttctaatttattattttaagggttattttatcatttctgattttgtgtatttgtgccccctccctgctcttttctaattaagttaggtaggactttttcttagttgtttttttgtttgttttttgtttttttcagagaaccagggtttcagtttattagttagatctatgatttttctattctttatctcattacttttgtatttttcattgactcatcataatcacccaaaatccgtagtttacactgttgttcactcactcttgctgttgtgcattctatgggttcagacaaatttgtataaatttttaaggctatgaattttcctttaatcactgttttaaataaatgtcatagattctgatgtgtggcatttttgttttaactttttagaaattttgttgagtttaggccaggcgttttggctcatgcctgtaatcccagcactttgggaggctgaggcgggtggatcacctgaggtcaggagtttgagaccagcctggccaacatggtgaaaccccatttctactaaaaacacaaaaattagctgactgtgatggcacgcgcctgtaatcccagctacatggggcactgaggcaggagaatcacttgaacttaggaggcagagattgcagagagccaagattgtgctactacaccccagccggggtgacagagtgagactctgtctcaaaaagaaaagaaaaatagaaattttgttgttgggtttttctgttttgtgtgtgtgtgtgtgtgtgtgtgtgtgtgtgtgtgtttcacctaagagctgtttaatataaggctattaaatttctatatagaaaagcctttttggttttcattttattaatgtataagttttttgccttgtgataggcttataatgtttctgacttaggtaatttattgatgttttctttgaacctaatatgatatttgtacatgtgcaagttgtagttgccattatcagggtataaagttcaatatatattcataagagttatacctttattttttgcctatttgacttccctcatatgacagtagtatgttaaaacctcctattattagtatgtttttacatatatttgtgtgtgtgtgtgtgtgtgtttattctctgctttaaaacagtgattgcagggctatttggttaatagatgtttataactgttgtattttcatgataaattgtgggatttaactttgtaaagtatccttttttctttgtaattctttttagattaaattctactggtcgtcttttaacagggttacaacctcagctttctttttatcatttacttggcatacttttgctcatccctttatttttagcctttccaaattctttgttttatgtgtgtctcttgtatacagcgtggaattgggttttgttttgagagccagggccaatttgaaaatctttttttttttttaataggttagttaggcccattcacataggttgatagattgatttgaactgtcattttgtgaaataatgtccctgtgtttttttttttctctgctaagcatacttttgtctttctcaattttcttttggtatttggggaagtttgtatttttgttctagtggttacctttattcttacacctttttaatgctctcttactatctgttttgacagttttaaatgatatatttttttacttctgtctcttacctgtgcaatgatgcatgagcttattctattttctcttcttgcctcaacctcccattttttaatctgattctagacttatctattttgccaaatttggaacatatttcttcatatttttttcagctccgcctttccttgtagggtctctgaagacacaaatattagatctattgttattgtgctggaagttcctgagagttaatttctgtttaatctttttttttttctgttattcagtttggatgatttctattgatgtatctttgggttcatttatttttttttcccccttctatcatgtcgggtttttttgctgagaattcccactttaaatttgtttcaaatgtgttcataattgttcaccagtgcatttttatgatagttactttaaaatcttatcaagtccttgtcagataattccaatatgtgtgtcatctcaatattggcatctgttgactgtcttttctcttttgagaatttcctggatcttggtatgaagggttattttccattgtagcctacacatattggtgttatgctttgagacccctgtttctaggtaaatctagttactgttactgccagggtgggcagtagccagactttgttctcagacccagcatctgcagacacctccagcggggaggcctcctcacttccagagtgggaaatgggctggtaggtgggctcagctcttaggcccagcttctgtcctctcttttacacagtcttgaggcaagaggtccagacaaaagctagaatttaattttttctcctcttacagataatggaaatttttagtgttctctgactcttagtaatgctgaaggggtgtgggttatatgtgtagttctattttatttattcatctatatccttttttgaagggtatgtgaattcaggtgcctgctattattttagggcaaaaagatgtgatgtcttcaatttggatgacctaataggaaacatcttgattttgcataagctacaaccagtgcttatattcctctgtgacgacaccaagcaatgccacatacaagatctttgaccttgaatgaatcaccagatcgctaagcctgttttcttctatgtagttgcaaagttaggataggcctagggcatggtttatactccaggtttatacttcagttggggacacatttcaggagattttcaaacagttttttccccagatgaagttaaagtgccaagtcatttcttttattggtttactttagtagcctgaaaaattgtattgctaaatatgttggaaaaccagtagagtaaatagatgacctttctgttctcttctgaacttgaaacagtatggtgtgttggcctcattcttgtaaatagtgtttttctgtgggattattaggtagctaatttgtgagggcagggagaattacttttctgcctgtttttaaattcatctgtctgatacataaatgcagaagttggaatagaagttttcccagacttctgtgtctcattttctgtgaagaatgatctgaggtaggcactgaaagaaagataaggtactttctacttaatagattaatcagctaagcagatatttttgccactaagctaaaacttgaaatttggttactttttctgtcactactcctgaggtgtgttgaacaagtaaagcattcaaacaaatatgtaaaatggtttttcttttgtgtttcctgtagattcttgtagacactgtttgggctctgtcatacttgacagatggaggtaatgaacagatacagatggttattgattcaggagttgtgccctttcttgtgccccttctgagccatcaggaagtcaaagttcaagtaagtatttttaaatttttcttatttgtatacagttgtgtttgctataaccagttaacttgtacagctaggctttaattctatctgtaagtgcttatcttccacatttcttctgctagtccctgagcctgattttgttgatttccaaatctttatctcacccagtttctttgctgagttccacacttgtatagccaattgttcttgaccctttatacatatcatctaagaactccttcaagctttccgtggttaactagacagaaatgaaacgatcatctcccacaaacctgctcttcttccttgtctaccttcagtgaacagcctggcctaagctagaaattttgattcctccttgcaattcccattccattacaaaatcatttcaattcttcttatataggttcaaatctgtctctccttatctatctagaacaacagatttagttcaagactctatctttcccccaaataattgcaataacctaattgcatttcttctttctctctcccactctaattaggggtaggcacttattagatctgttcatcctgctttaccaaagtgactttctaggtggaagtgtgtgcccattccaggcgtttattaaaatattatatatatttttgagatggagtcttgttctgtcgcccaagctggagtatggtggcgcgatctctgctcaccgcagcctctgcctctcaggttcaagtgattctcctgcctcagccttcagagtagctgggattacaggcatgcaccatcacaccagctaatttttgtatttctagtagagatggagtttcactatgttgcccaggctggtcttaaactcctgacctcaggtgatcccccccgcctcggcctcccaaaatgctgggattataggcatgagccaccatgcccagccttaagaaactggacttcttctaaaattttaatttccttttattttttgaatctttttccaaccaattttcacacaatttttttttttcataaagtttcagtttttcacaagagactatttaaaattcagaatagctctcagactgcttggtgctttgtgaaaggatgaaataagtgttatttatgccttgcatttttactttttctcaggattatgaaaaatatagaattagtcttataagcaaataaatttatagaaaacattttatccccaccctagacagcagccctcagagcagttggcaacatagtgactggcaccgacgagcagacccaggttgttctcaattgtgatgtcctgtcacacttcccaaatctcttatcacacccaaaagagaagataaataaggtaaggcatataatgtcctcattatgctatttctttctgtgtctcatttttaactgtctccttgtttctattgctacttgtatgtttttcttaaaagccactgcagcgaagatgagaattattttaaatcacctctgcaaatgtttttcttcaactttttttttttttttttttttgagacagagtctgtctgttgcctaggctggagtgcagtggcacgatctcggctcactgcaacctctgcctcctgggttcaagcgattctcctgcctcagcctcccgagaagctgggactacaggtgcccgccaccacgcccagctaatttttgtatttttagtagagatggggtttcaccatattggccaggctggtctcgaactcctgaccttgtgatccgcctgcttcagccccacaaagtgctgagattacaggcgtgagccaccgcgcccagccttttccaacttttaatcgcttctggtaggtgctgccctggtcatcacagagtaaaaaacatttttagactacctgtgtttctatttaagtagactgagcatagcaacaatcattaaattagtagccgcttgaaagtgcagacaaaatctgccatttgaatgggctggtatttttttaaacaaaccgatcataaaaattttgatctcccagcaaaattagtttggacccaaagacgaggtgcctaaattcaaggatcataaaaaattactctttttaagatttcaagcttcatagacaagtttattattaattgtgtaatatgtacttactagtatgtaataagtcttcatgcctggcttatttcatctagcatgttttcaaggttcattcattttgcagcatgtgtcagaactttattctttctatggctgaataaatattccattgtatgtatacaccacattttgtttttacattcttctgttgatggacacttcggttgtttccaccttttcactattacgaagaatgctgcagtgaacattggcatacaaatacctatttgagttcccgctttcaatttctttggatatataactgcaagtagaattgctcgatcatatgttaattctgggtttagctttttgaggaaccaccaaaccgttttccattgcagctgcactgttttacattcccaccagcagtgttactagaattctaatttctccacatcctagccaacgtttattttctgttaaaaaaaattactgacaatcctagtagatgtgaagtggtgtctcattgtggtttaaatttacgtttagttggccaggcatggtggctcatgcctgtaatcccagcactttgggaggccgaggcgggcagatcacgaggtcaggagattgagaccatcctggctaacacagtgaaaccccgtctctactaaaattacaaaaaattagccgggtgtggtggcagacgcctgtagtcccaactactcaggaggctgaggcaggagaatggcatgaacccaggaggtggagtttgcagtgagccaagtttgtgccactgcactccagcctgggcgacagagcaagactctgtctcaaaaaaaaaaaaaaaggaaaaaagaaaaagaaataaatttacatttagtttactaaagttttatctgcctaatatactaccatcacccaaacccagcagaactgatcatttcttcttcgtcatcataactatatttgtatagttgcttgagtataatttgactgttgggttcttatagaaaagtatggtgtcaaaaaacacattttatagatacatttgttccagtgaagacaaagaagccagagactttcagactctgggccagttacttttactaaagaaatttttaacaatataggtgatttttttttttttagctaaatgaatatattccataattggaaacaactgagaagtgaggaagctgggcagaagtcagcagagaaaggttccggcctgtgatgtagtatgcttttaagtgagggtatcgtgggggtagaggaaaatttcatagaaatgccatctcaacttcagcaagcaattagttacttcaaaaattttttgccttgaaaatttgttacttgcattttgagactatcataggaccctggaagtagaagttaccaacttgattttcttccctcagcatttctgtttgaaactttttaaatctacaaaaaatgtgcaagaatagtatagtgaacacccatgtactctaaacacagattcagcaattattaacaacttaccacagttggatggcaaaacaaattcatttgtggaagaggaagatacacatgtgatactaacctgtaaacagctcacagacgtgtttatgacttataaatcccttagttttagaatatttatgttatatagacccatgctagactagttagatggttaatttttatggaatacttgaatgactatatcttgtgagtaaatattttttaaaattaaaaaagaaatcacctttattagaagtagtttttaagtagttttagaaattcagttgtatagtggctgggcgcggtggctcatgcctgtaatctcagcactttgggaggcctaggcgggtggatcacgaggtcaggagatcgagaccatcctggctaacacggtgaaaccccgtctctactaaaaatagaagaaaattagctgggcgtggtgacaggtgcctgtagtcccagctactcgggagactgaggcaggagaatggcgtgaacccgggaggcggagcttgcagtgagccgagatcacgccactgcactccaacctgggcgacagagcaagactccgtctcaaaaaaaaaagaaaagaaaaaagaaattcagttgtatatttatttctgtcttttagaggaagctaatgcacagacatgtaagctccatgaataaagatttctgttttgttcatttctataaaatcaccatttcctagaataatgcctagcttatagtaggcctatatattaatgaatggataaatgccaggttattggagcccaaatataattaatggaaatttccttataacttgtttaaaatggaagattttgtatacctaatcactttttaggtgcagtctctttaacgtaattcaggtgattttgttattgtctatataaaatatattagaaagacattaaaggtattatttttcaaataaaggtgccctatattttgttcaattataggaagcagtgtggttcctttccaacataacagcaggcaaccagcaacaagttcaagctgtaatagatgctggattaattcctatgataattcatcagcttgctaaggttggtcatattatgagttcaccgtgtctgttaatctgttaataaccaagactttttggataaagagtccattttatgatctcatttttaaccttcagggggactttggaacacaaaaagaagctgcttgggcaatcagcaacttaacaataagtggcagaaaagatcaggtgagtttgaaaacctgtaactgtcatgattgttaatactggaaagcatgctgctctcttatgtttcgtagttgctgactgtattgtgttctttttggggaaaagataattattattattttaagagatggagtctcactatgttgcccaggctagagtgcagttgctattcacaggcatgaccataacgcactacagcctccaactcctgggctcaagatagcctcctgcctcagccttccatgtagcacgacaccctactgggaaatagataattatataaataaaaatatttcttctcttttgttgtctaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtaagagtggattgatggaagaagagtatttgagcactggaactctgaaacataagttctttaaagtcaacttactagacagaaaattactaggatacgttgtttttaaatgatcacagtatgttgcttttctttattcactatatttgcattccaagaggattttccagaagacagtagtccatactttgcaaaatcaggttgtgaaagtcactgtatagccttctagagattgacaacatagcttttttttttttttttggagacagaatcttgctctgtcgcccaggctggagtgcagtggcacaatctcagctcattgcaacctctgcctcccgagttcaagcaattctcacacctcagcctcccaggtagccgggattacaggcgcacaccaccacacccagtggatttttgtgtttttaatagagacgaggtttcaccatgttggccaggctggtctcgaactcctgacctcaagtgatccacctgcctcagcgtcccaaagtgctgggattacaggcatgagccactgcgcctggcctgacattgcattttaggaaacactaatacttctcttgaagtcacagtgcatgacagcaaatttaagagcccttacaacactacataaattttaaagctttatttaatccagcatttcttaaacttcttaacaatgaaacactttttttgtgtgttattaccatgtaattctgtggaccccactttaggaaatattatttcatatagttggaaaaggttactgacttctgagtcacctagatattttgtttcaatcttgtaatgattcttaggatttccacaactacatcctgaagttattactgtggcagttactttgaaattttaatgagaaataattgtgatttgacatactgtattattctttaatgacatgtgaaacatatgttaaaattctgtttttaaatgtacatgttcaatatgtactaacatgtttaaaccttaaattagtttatcataatgtcatgttttagattttacatttcattgactactttatatgaatattctattgtttatttatttatttattttaagagaaaacaaatgcagtagtaccgtagaatattcagactgggaggatttctttctttctatttatttatttatttatttatttatttatttatttatttatttattttttatttatttattttttttttgagacagagtttcgctcttgttgcccaggctggagtgtaatggctcaccgcaacctccgtctcccgggtttaagcaattctcctacctcagcctccctagtagctgggattataggcatgcaccaccacgcccggctaaatttttgtatttttagtagaggcagggtttctccgtgttggtcaggctggtcttaaactcccaacctcgggtgatctgcccgcctcggcttcccaaagtgctgggattacaggcgtgagccactgcacccagccgggagggtttcttgagaagaaattatcccacagattttaaggagtcttgtccaaggtgacagaagtaggttgtgatagaagcaaagttaaaatccagatcttcttactattaagataattaaaaattagcattgtagtcaggttcataacacagtaagtttgagcaacttagagaattactactcttcagctttttatcaatatagttacttttgtctataggagtaataggatacatattaatattttataattgtataaagcactttggcaacgatttcccccattcttttggtttattagtatataagaaaaaattgcaactattttaaaataaccttcaaaaagacatttcaaggaagaatattaaggtgtgaaattgataaacatgtatatgatgtgtggagtaaatatattggaaatataaatgaaggcattctatgatatctgttctggaaatattttctcccaggttcattgtggctataggacataagacctctattcattttttaaagaaagtttttcaaaatttaaatctttatatcttttataccaattataaggttctaaaaactcattttgtggttatataaaggtaataacatttggaaaacaaagagaaagatacaaattactttatgaggcagtaagattaataagattggccgggtgcagtggctcactcctgtaatcccagcactttgggaggccaaggcgggcgaatcacgaggtcaggagttcgagaccagcctggccaacatggtgaaaccccgtctctactaaaaacacaaaaaattagctgggcatagtggtgggcacctgtaatcccagctacttgggaggctgaggcaggagacacttgaacccaggaggtggaggttgcagtgagccgagacgtgccactgcactccagccctggctacagagtgagactccgtctcaaaaaaaaaaaaaaaaaagaaagaaagaaaaaatgcccaggcgcagtggctcacgcctgtaatcccagcactttgggaggccgaggtgggcagatcacgaggtcaggagatcaagatcatcctggctaacatagtgaaaccccgtctctgctaaaaatagaaaaacttagccgggtgtggtggcgggcgcctgtagtcccagctacttgggaggcttaggcgggagaatggcatgaacccaggaggcggagcttgcagtgagccgagatcacacctctgcactctgcactccagcctgggtgacagagcgagactccgtctcaaaaaaaaaatagattagtaaatttatattaaagcactgtgggggagttggttctagtactgtcacaaacttgccatataacttgaaataagtctctttacatatttatgccacagcttccctctgtcaaatggattgtttgggtgtttttttagactgtctgcctcagggatccgggtacctcaagggcttctaagaaggaaaaaattagtgggattctggtcctccaactagaagcagccccgtgttttgtctgttttttagacaaaccactatcttagatgggggagcagtgtgttctgagttccttaggatttctccatgattaaaatgagtgtggttttgattagtatctccttatcaattaaccagttattttgattattttatttttaccaggtttggagaaaattgaagttttacagcaacatgaaaatgaagacatatataaattagcatttgaaatcatagatcagtatttctctggtgatgatgtaagtagatattaaaatagcgtgtatcttcatgtaaatgaaaacctatacatgatgtaaatttactaagagttttccttttattattaggatgacataagtttgtactgtatttctattagacattccatcagtcactttctcttaaatactttgaaacttcattataaggtaaagttgtaaaaacagttcttgtttcatttctaatctattaactaggaagaaatagtaattatataagtgatatatgttcagataggttaaataaatctaggtcccagatacagaaacttaacaatgcagtttcgaaacgtgttaaattttaaattgttaaatttcttaataaaattattgatttactcgaatatttttagttggttaaagcattcacatagaattatttgctaagaggtaaaaagtcaattccacttacatcataatgtatagtatcataacctaataaggatttttttcttgttttttacagattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaac

SEQ ID NO: 15584 - DNA, 194915 bp, Human
  misc_feature (1)...(194915): n = A,T,C or G
aaatataaatgcaagaaaatttccaaacttgaaggaaaaacagtcagcatggggaagtcgtgccagcaggcatcaaagcatactatcatgttactgcattttaagcaatatggcattagcttaggaatccacaagtcaatgtttggaacagagtagatgccataactaaatcaatgtatataggaaaacttaatgtatgctaaaggtggcttgtctttctggtaaggaaaatatcattaagtaaatgatttgggggcaattaggtgtccatctggggcaatattccatttggattagattccatttgaagtaagagctaatattaaagatggacccataaagctatcaagagaaaatatgggagaatacatgtataacatcaggttagggggagctctctttcataatccatcttccaaaaaggaaaaattgcaagatagtaaatttataatccataaaggaaaaattggcagatttgactgtgtaaaaatttaaaatgtctatgacaagacacaataaataaaggcaaaagaagaataatacttgcaacctctaggacagagctaatgtttaaaatactaagaggtctcacaaattgtttataaaagaaagataaaacagcccagtataaaaatagtcaaagggcatgaactggaattgtaaatcaccaataaacctgtgaaaagaatcagccccgttagtagtgagagaaggcgaattaaaaccagagatgcctatcaggtgagcaaacacttttaaagatggcgaacaccagtgctgatcagtgtgtcaataagcagacactcaccatgcacatttgggctgattgcttcaacctttgcaccggaaagaaatgtagcaatagtcattcaaatagttaacatgcttattatgtttggccccacagttattccacttctaggattctttcccacaaaaataaaagtactagaacattaaagatgtttgaataagactgtttattcctgctctggttaaggtagccaaatttggaaacagtctgcatgttcatccacagaagagtgattggttaaacaatggtatgtccatcttgtgaatatatgcagttatttttaaatgagatagatatatagatttttaaaatattttgataagagcaagtggcagaaataaatgtgtgtgtgaaaaagcatagggaagattttgaaaggctataaaacaaacagactgtttatattggctatcgcacggtgggggagataagacctcattctttttttttttttttttttttttttaagagacagagtctcactacgttgcccaggctggtctcaaattcctggcctcaagcaacccttctaccttagcctcccaaagtgctacgattacaggcgtgagccaccatgcctagcctaattcctttttactttatacctctctacatttttaaattgattacaataagcaagtatctcttctgtataaaacataattatagcacaacagcttttttgaacttttctttgaagttgtgtcatctaatcaacccttatggaaatcacaggtagtttatcatagggataatattgaaaaattgtccacatgtcacatggtgtcacctctgtgaagatccataggagaaatttccactccagcttgaatctccagatacctgtggttcatttgagcaactgctttgcttttatcttttgcgcattgtgcatctggtaactgatcgtattttcctttcctctggaaaccaggaatctcagagtcaagttgtagactgtaaagtttattcaacaaccataccagactctgtggcttatgttctatgcacagcccttgctgatggaatcatcttgctctccatgtttattttccctcacccacattccttcctttgttttaattttaactgcttatgttgcatgtatccctatagctacctctgatcttttttgggagatgtagtagggatatgaataaatgatgaccagaaatttctattttaacagaaacctggcaaagaaaacggtctcgacaatgagtaggccacccatcactactaactacagatgacttgccatttcatttacaaaggtaaggaaataaagtctgtatttttaattaattctgatcaaatcagtatagagcccttacctttttattgtaaatatttttacaaatattctaaaacatatatctagctcataacctttaactctgacatcaaatttgaataaaacatcaagcaaacagaaacaagaaattttatgaattttggcatgccagaagggttaaaaaaaaaaccgagatgtggtctctgttgttaattactatgtgtgttaaatttttaaatagtattttccttatttttaagtgtagcagtgttcactgtagaatacttggagaatctaacaaaatataaaaatgaaaacctaaagcatttataatcccatcatctgtagataatcaccagaacttctgagaatgtctttcctccttccttttatgtgtacatggaaaatacacatgattataacttcaaaaaaaatttttagagacgatgtctcgctgtgtctttcaggtgaaattcatataacataaaattagccatttaaaaatgaacaattcagtgttcatttttagtacagtttagtacatttacaatgttatgcaaccactacctctatgcagttccaaaacatctgcatcaccccaaaaggaaactcagtgcagtcagcccttggtatctgcgggagattgattccaggacctgtggataccaaaatatactcaagtcccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctgggaaaataggtgcaagacattgaacctggctaattttttattttttatagagatgagttctcactgtttttcccaggctggtctcatactactggcctaaagcaatcatcccatcctggcgtcccaaagtgctgtgattacgggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccctttgcagtttaccagtacatccccaagcatcttatttgtccctgctacatggcctctccgactccaatgcccctggttaataggtttatgtgacctttgttaaacatcactctacaggaaaaataaatgaataactcttgaatccagatgatagttcatggccttcgtttatcattattttatgttttgtgctgcttaaaaggaagtgttttaaaaaaaaatagaagtttacctgtttttctcctcctcttccctactgtcaagtcagggatgattcacaaagtaataaaaagtactttaagaccatctcatcctccgtccttcattcatgccagttagttaacctctcattaaggttgtttttttaagcacccttcagagttgctcttgtagttttttggttttaaaagctgcaaagtcttaaaagtgaaattactggaatggcattctttagggaggtcttcattctgttggctctgttaaacagttgaaggcctgtattttaccctgagcctgatacataaaccattttaattcttctggcatttttattcaaaactgacctaatatgattataaagagactagaaaaatgaattattctttaagtcaatttaagctgatacagcatggaaaacaatagtttgtgaaacatctgtcctggaagactctattctaacacggacagattaaatagatgcaaatagaattgcaaaattatgtaagagggtggtttgattggtgggcagtactagatctagtgaggttggctcaccgtgattcttgcgtttattttcctggatggtttttagtcatatcaagctcatggcagtgtgggtaaactcagtcacttagttccaaggcacagaaatggttgatgaatccctaggtttagcatatgccgtgtttattaaaagcccagaatttaaagcatgcttcaaaagcgtaaaagaaagtcagaaattttacccttccttggtgtattaaatgttctgcatgcagtttaaggtaagacccttaaattatggttccctaattatgaagttatccttgtttaccacagaagtagcataactggctttaaaaattcagatgaattataggtcacatgtgaaaatcttatcattaggaagagagagaaacacatttgaagatcagatctcccaatgaaaaaacatattttatcttaaggcattagaattcacaaagatacgcaatagttttgagtgtgtaaaaatgtaaacttctctatatcataattatgaaacaagttaaaaggacacggtaagctgggcacagtgcctcatgcctataatcccagcactttgggaggccaaggcaggaggattgcttgagcttaggagttcgagaccagcctgggcagcatggcaaaaccctgtctctaacaaaataattacaaaaaattagtcccagctacttgggaggctgaggtgggaggattgtctgagcctgggaggtcgaggctgcagtgagctgtgatggcaccactgtactccagcctgagtgataaagtgagaccctgtctcaaaaacaaacaaaaaggcagatactaacacagaagaatattaataatgcacttggcaagcaattaatgaccttaaaacataaaaataagcaaaccactagtatgaataaccataataggtaaaaatcaatatcagaaacattaagacctccatagataaatggacgaaacaatggaagactcgaagaaatacaaagaactaaaactgatgtgaaaacaatgttaaccttcaccagtaattttcacagatgcaaattaaaaccaggagatgatttcttttacctgtcagattagcaaagctgtttaagatgataacagtcattactaaatgtgtaatgaaacaagcccccactcactgctgatagcagtgtgaatgagtatactcttctggaaataaatttaccaatatgtagtaaaagctttaaattttttaataccctagtatgccctagcagttccaagaattgagtccaagaaaacattgaagttagataaagatataagcataaaataattattgtactatttgcaggagcaaaactctttgagctgcctcaactatccttcaatattagcattgactaaagtattaacacacagtggtgtccacacagtggtatatcttgcaactagaaaaaaattattcttacaaagatatttttgtaatcaaatgggaaaatgtttattacataaatgttcagtgaaaaatactgggtaagatagtattgtaagttttttcatatgaaaatacacataataaaaggtagaaataaatatgacaaaatgtgaatagaggagttgcccaagggtagtagaattgagtaatttttttgttctgactcatattttttggtacttcccagataattttacagtgagcatgcataaccagaagaaaagttttttaaaaggctatgtagcctgggcacggtggcaaatgcctataatctcagttactcgagaggctgagatgggaggactgcttgaactgaagagtttgaggctgcagtgagccatgatcacaccactgcattccaattccagcctgggtgatagagtgaaaccccatctctaaaaaaaaaaagctttgtagaaagaaacttatacacatgtacatgctttcttagagcatatgggataaaatatattacgaaaatgttttagatttatttttgaaagattaaggaatgcagatttcttttttagtattctgaaatgtttctgtcttccttaggaacaacagcaatagcaataacaaaaacatacttaactaaaatagatcctttggttagcaatattattaatatattgtatttcagagtaacattgaagttcaaagggcagtgtgtttctcttgtagatgtcttctgctgctgaaaatggagaggcagcacctggaaaacaaaatgaagaaaaaacctataaaaaggtgagtgtgcattttattttctaaagaggaacaccgttttgctgtttggcacgtgaatattatcaaaggcctttccttctcccaagcagttgtaagttactatcttagtttccagttgctgctataactaattactgcaaatttagtggcttagacaacatacatgcattatcttatagttcagtgagtcagaagcctgacatgggtctccctgggctgagatccatgtgtttgcagagctgtattccttcctggacactccaggggagagtccacttccttgtcttttccggcttctagaggctccctgcgtgccctgtgtcatggctccctgccatcttcaaagccagcaatggccggtggcgtctttcccaggctgtatcactctgacactttaaagggcctgtgtgattgcattgagccctcctaggctcacagaaatatgggaaaatattaataaaaattaatattctttatctaaaaggtcagctgattagcaacgttaatttcctctgcaacttgaattcatttttgccttagaaggtgacatattcacaggtcccaaggattagagcatgggaatctttgggggtcaattcaccataatatagaatattgagtgaagagagttgtttgaagacccttcttattcctaagaagaaggctcctgagggcatgcagtgttctgtgtataatatatgaatcctttaatggactcactactttccaccaacatttaaaacatttcctacctttgtattttaaaacttttaaaatgtgagatgctcctcttccccaccttttctaagccgctcagattttatgtcttcagcccatttcacaaaaagtctttttccagacttcctaatgtatcttaacttaccagtctttgataaattctcgactcccagctaccaagctaatgttcaaacacgttactgggtaaaatatgttcccaagcacctctactcctgattataaattgactatacattttagcttttcaaagttcttgctattttgccctcttaagagtaggaggtttgtgtattgaaggtttattatttcttaatttttccttttatactttgatggacagcctgcaagacgtttagtcataaagtacatgagctatgggctctgaccacatattcaggtcatggaactagcatgatgtattttctattccattttcatatgggagaatgtgccctttttcctggcatatcttctttatctgatttttccactcagccaaaccttgaaatacaaactgggaggttgtcattcaaagtgatggtgtggttggaaaagagttgggtaaagattcaagagctcagaagtgccgcagtatattttataaaatttgtacattgggccagaggcaacaatacactattatttatttttagacacaagtgaaaaaccaaatcctgtctcgtttacccaagattccgtgtacattcattcaagcatggaccaacacagagatgattacgttgctagcctgttattacttcagatcagtttcaggtggtattctcaatcagcatcaagatgcactgaaattcttgaccaaattctgactcacaggagatcctttgtcgctgcaaaagttatagaaaaaatgtgaccatgacatctcagagtttgctaagtgtaccctgcccaagaatttatttagtcaagcaggttttcaataattagtataggtaattctatgattaatgtctccagtaggatatttaattcagcaatgttttttaggttgtaaaaactaaaaatcaaattctatggtaggagaaataaggaaagacacagaaaacctaaggggaccagaaattttttttaatgaacaattttttatgtgtaataatatcaggatcttattaatgatttctggttttaaaaagtataagcaatggaaggagatgtacgtagcctctcttaaaaagcaccaagaagaccagcacagcacttagaacttcagcccttaataaatatggtattgatatgaatagcaagaagaaggaatcgcttagagagagtgttgttttactggcaggtaaaagctcagctgaattattcggtttagttctctgatcttcaaactagagaaggtgttcatggtggacttacgagttagctattgcaaatgtgtttatctccaggtccagataaaccatttcccagatgaaagaacttaaagctagaataggaaaacctctgaatgtgagctttaaatgaatttcagaatgggaaaattgtcagaaaacaggacataagcaaatattattcttattttcaaaaatgaggaagagtacattctggaaaccagattataagtgagacattattccccagtataatttgagcattattattaaacatatggtttatacatatttagagaagaaacatatcttttacaaacctggagaaattcataaagatgtagtttatttcaaactaactgcatttcctattttgagagagtcattaaattactcataaagagtatgttcaaatttaatgagtcttgatttaaaggtgtctaaaagattcgctagtctcctttcagacaaggtggataagtatgggttaaatattatgtttattgtgtttgtatctggttggaccgatggtctcgaaaactggcaattttgctccctgttcactcggtttccaccagcatgatgcatgagttggccctgggtagcttaccatgttcacccatgaccttaatgaaagcataaaagcagtgctttgcaaatgcaaatgacaaaaaaattgtaaatgatagcaaacagactacacaagtgttgtcaaggccaccatacatcttattccctttacaaataccttaaatttctttcccagtcctgaagccctgatcataaggtatgcacagatttactaagaagctttgatgacccattgtgtttttgcattgactgaagccagtccatggatcccaggttaaggcccctggtcctttatgctaggagtgagaaatataccacaggagtttataagtagctcacagtggagtgggagaggcaagacatgaaaacagttttagaacacagtagtctataatgaggagttcaaaagggaagaaaccaatgttgttagaattaagcagcaggtttaggctttctgtatggagccccagatttactgggcagctgccagtaacattcagcgtcatgagtgctatgatttccacgtgttattagggaacactcagtgttcatgggacaactttacactttgcgtctcagctatttgcatgtgattattgaggctggctgccttttgtcttgcagttgaccatttcctgaatccattctcagttcttggcaagcccgggaagaacagctaacattggtccgtgaggttaataatgtcttcagctaatggctaaaataagaagtttgattttagctgcataaaacaaacaagttgcccattaagacaggcattaaaggctgcctggctatatttacagagtggagtatttccattatcagttaatttattgagtgctttccgcaagagttgtaaatgcagaagcctactggggccaggcagcaaagaagggagtgagaaaacgaggggaccatggtaaacagaacccacgccttccttaaaaggggcagcaggcagtcagctctagccaacagagctatgaatgaatgctcgcccagggttgccagatactctgatgtttttcaagaaaagagagatgaagattttgatatgaaatctgccatttttaaataacagcaactaattcaaatgtttttaaaaatacactctgggcaaaacagtttgcctgcggaccctatctgtcccgtaggcagtggccagtttacaacctctgacctccctgttggtgtaaaaaagtgagaagaaaaaaggaggatgcaaaagaagtgtaagaacttgtctctgcctcccctgaccttacaacttatttgggagaaaaaagagggacccacatgaaaaaattaaatcttgacccaaatcggtgttgagtaagtgccaagacaagtggtatttctcttttatttttatttttttgagatggagtctcactctatcgcccaggctggagtgcagtggcacaatcttggctcactgcaacctctgcctcccgggttcaagcgattctcctgcctcagcctcccgagtagctgggactacaggtgcatgccgccacgcctggctaattttttgtattttagttgagatgggggtttcaccatgttgcccagactgatctcgaactcctgagctcaggcaatcgacccacctcggcctcccagagtgctgggattacaggtgtgagccactgggcccggccaaaaattccactttttaagtgactgtgcattctgatttacctacgtgtttgtcttgatgtcagggagtccaatgagcacaggcacagaaacagggaggagcatgatttgttggcattacaggagaggctggcctggacaaagctaagtggtggtgtctggggaaagtagtaggcagttttggaagtatgggctggctctaaatgacagctacccttgggtgctggtttgaggtgtttggattttatgttctaggccagtgttgttcaacggaacttcccgcaatgatggaaatgttctataatttgcaccaatgcggtagccacaagctatgtgtggctatagggcatttgaaatgtggccagtgtgtctgagaactgtaatttttaatcttaattttagttaaatttaaacttaaataagcacacgtggctgatgactgccatgctggggagtgcagttttcaggcggtgatgtactgtaacattgttgtaggggctagtgacaaatgaaaggcctgtgcaaagccagtggcagagcacaagttgtacagggttgagggagatgacacgggaaggcttttgtgttagttgagcaacaaagttgggtgcaaagttgagtaggaaaagatgtggggaatatttttgaaaagaaaattacatttccaatcagtgcgactaccagaagttttctgccattggtggaactagggaagtttgggaaagagtattgtgttattttgggattttgtttgtttgttgtttaaaaaggcaagagacctaaaaggaagcagaaggcgcagggcacgagtttacttgaaagaggatggtctcaatgcaagtcaaatactgatgctagacattcaagttttgtctgttttatatgtgaagaaatgacccagccccacctctccaaaacaaacagatgtcagggtggttcagtgacatatgccaggttaccttgcagttctttgttaggaagatgattagaagctccagtcacatgatgtcccatgttgtcatttgtccgttggactgggtcagtgtttcccaacaccagggccttgactgtcatgggaaacgtgcactgccatttgcctttcttcttgtctcacctcttcaccctgaggttgtcgttctaggcccctcaccccttcctcttctgtttctcctgcctttctgggcctgcccacaataggcctccactgggagattctggttttgatgaccgcaggctgccgtggggtcagaggccacctgcctgtggcaccgaggcctcgcctacagtgtgcagagtctttttagctggttttcactgtgacgggcacacgtgctcacagcattcagaaagctccattgggaaactgaccagaccaggacacctacaggatccttgacccaaatgcccagtttttttcactttgttttatctttgaagaccttggttgttgcttcattccagtgtctgagacagtttcctatcagtggaggcaggcagcggtgaggaaggaggaaatagtacctgaccgtgaccacattccaaggaaagatgccttttattgctttttcaccatgagtaagataatagctcagagacactttgatctaaaaggaagtatttctttaaatacagggtcttttataaaatgtttctgacagctggtaacactgtctgtctccagggagaaccgggtagtagggtccttagttggtgggaaacttctctgtgtaaacctttctgtggccgagcatggtggctcggtggctctatggctgggcacggtggattatgcctgtaatcccagcacttcgggaggccgagatgggtggatcacctgaggtcagaagttggagaccagcctggccaacatggtgaaaccccatctctactaaaaatacaaaaatttgctgggcacggtggtgcaagcctgtgatcccagctgcttgggaggctgacacaggagaatcacttgagcctggaaggcagaggttgcagtgagccgagatcacgccactgcactccagcctgggcgacagagcaagactctggctcaaaaaataagtaaataatacatctttctatgcatatttaattttgaactatgtgaaggtaataccagttcaaaaattgaacaaataacgtttcaggattttggagggaagaggggctggagtgtgttctctgtcctgaccattcttcttttccttcagattctggaaagccgccacttccataaaacaagcaaactcgtttgtgctaagcagcagttgtcatgaatagcagctatgctggtctctaggatgaatgaccctttggtattctaagtgtgattcctaatccaccttaatccaaaataccctaacctgctggttctcaaccagcaattctgcctccaccccccaggaagatttggcaatatctggacatatttttagttgttacaaagtgagggctggcgctactggcttctaggagatagaggtcaaggatgctgcgtcttatgatgcagaggatggacccccaaaacaaagaattatctaaacgttgttagtgccaaggctgagaagccttgttcaaatcaaactaccctttttaagaggagggcggatgtgagtccagctcttccagatactggttgataactgtaggcatttttcctagttgttgtgaaccttaatttttctcattgataaaatgtaattaattaatatctacccaagctggcttatagtgctgtgaggatcaaacagtttaacagacttgagcaaatactgggaaaagtagcatactaatgagtgaagtcactgttttgatgagcaagaatgcagtccctgagcctctgatttccagattagttctatggggacggagcactggattcccggggagaagggttacttagtctcctgggggtagctgcagtcaagcctgggcatgggaggtgagctgacagtactggggcatgatgctgtatgcgtcccaacagcaacaggtgtttaaaatcagagagaaagatgtgctcttactagtaaacgggtgccgctgtgctgaagcctaggcaacagagcaagaccccatctcaaaaaaaaaaatagtaaactgctgttgtgtttttaaaaattaagcagcaaggaggtgagctgcatcatttacagagggaacattttttaaataattccgttacacttagaagcatgtgtaatcatatcacgttaccatgcaccccccgccctgtcagatcacccctccaaacacttgtgcttctgtctccttcctcactaagtactaaagcaggtgattgcaagtctgcctttatgagttttaagcaggacattacagataattaagcaaaaagaattggcagcttcagattaaaacagctgagcgagccaacccctctcattattagcctgttgccctgaatggttcattctgaagtgacctctttcagcattcgctttggagggggcctccatatgttaagttacccaggtttgttgtacttctgccttctgattaactgtagactctctgtgttttggtccctaataccaataaacgtcacattgctgtctctaaaacgcgaactataggaaatcgtattctacacccaaaacttcctgcacggcttccttcactggcaaaaaaaccccacagtgttgttgagtttggtgtgaatggcaggcgaggaggttggggtgttcagtgttactgcagccagtggggccgtctgaactgtggcccgtgttctcagggcacaacgatgcttttgtttttcaattaaaaggcttaatataagcaggtgttcactcgcttccctgcacagctcagccaacctggttccgatctggccagcaggccccctttccctgaggcctgtggctcatccactttcaccactcactacctgccctcctttgcctgagcacataaaagagattttttttaaggtggctcttaagaagttgcaaaaggacatgaaaatttaaaattctaaagttctctgttctgaatttgggaaaagataacagcaatgtaatttaggttctagtcttacatctactcaatagtcgtagggaacataccttgtgcttattcagagtttttgctgttttatggagttagaatcattggctgatggaagaatgttatcaaatatattgagtttattttaaccagaagcctactaattcagtgaattgaagcctaattattaccaatcaaaagcaattttaaaagcaatgctaataatagagttaacataagtgcttagtgcatgcccgctatcattctaagcactttagaaaatacatttaatcttcctaacaaccttatgaggttatactattacgaccattttacagatgagaaaacaggtacagagaggttaattaaatgctccagggcataaagcaagtatgtggcagaataagtctgggattttaaccccaactgcctttcttcaggatctgtaagaccctacccactgcattattgtctgaatgctgtggtgtctggagggcagtgctgctcaagacattaaaacagtgattctcaattatctgcaatagtagcaggggtcagtaagataaactcagacagctttggaatgggaacaaattaatagaatttaactttttttttttgacggagttttgctcttgttgcccaggctggagtgcagtggtgtgatctcagctcactgcaacctccgctgcccgggttcaagccactctcctgcctcagcctcctgagtagctgggattacaggtgcccaccaccacgcccagctaattttttttatttttagtagagacagagtttcgccatgttgtccagcctggtctcgaactcctgacctcaggtgatccacctgccttggcctcccaaactgctaagattacaggcgtgagccacgccccaactagaatttaacaattttaaaatgttttccctgattcattggttccaaagccatttttctcatcaaagtgtatctcacttctgaacacagaatctgaactgtagcctcaagaataactttttctagaaagtatgtagtgattttaaagtgaaaaacaaaaaaatcccttgggcactgtgcataacactagaaatgggaagatgactaaagtgatcatttcaaaaattatccctgagtgcagaactcaaaattgacagtaaaggatgagatccacttgacagtggtgacatatcttggattgtcaagttaggagaagaacacattttaaaacctaactggcagttctgtagactgtcacagaaagagtcacaactcaataataatcttctcaatcacttaaaaacatctggtaaagaaagcattagctaggaggatgactattttgaaagtcattttcctctatgggaatccagttctcccaaatggtacactgtattttctggcaagttctgtttactgtctggtcctgtgtcagctgcttttattatgccagagaaaggaatatgtggcagctcagtcctctgcatgaaagaggcaacccttcaacatatcattaaggaaggaaaagaagatgggccgtgggctctgtgggggctgtgaaattaagattctcagtcctctatctgttctgcccaacttctgacatgcacgtacacccagacacccagagacagaaattgggttcaattactaggagacttctaaactattcatgaggtcttgctgcagttctttccagcagagttgatgagctactcttcctcttaaatcagtgttttctgctcatccaagatgcactgctgtctacttcattgcagatcaggaatcgtttggttattgagcacagggctgaaatgtagactgtctgggtaacattctaattttcctgagctaagttttcatattgtgaccttgccatttttatgggtgtgcttagtgcctagaatgtatgacatacatttgacttacgtccatgtactcattcatttctccagttgacaagtatttatttagcttggcatggtgctaggccttaaggggtggaacagaggccaagacagacatagtccctgcccctaataatgctttcattgtcatggtacagacagatgagaaagagtatgcacaatcaaataattactaacttttaaagtactatgaagaaaataaagataggcaaaggtactgctgccttttagataaggtattcaggggaccctccctaaggaggcagcacaggggctgggatcgcgagtgtgtgaaggaggcagtcaagataagagtggacgaaagagtgtgcttggcagagagaatggcctttgccaagccctgaggcaggaaggagcttggtggattcaaggaactgaggtggaggccagtgtgatgcaaggttctgagcagggaagagtggccgagtagcgtgacagcagcggttcccaatgggggcagatttgtcccccaggagacattagacagtgctgtcagaactgaggggagtaggtgctactggtaggaggccagggacactgcccccccaccccccgacaacaaatactcatcagccccaagtgtcaatagtgctaagttgagaagccctgagttagagaaataggcagcagcctagacaaaggttgtggactagaggagaaagaagaaaacaagtttgagattcatttcagagttgatattgactggacggggccatggttggatgtgggggtgagggcatggtaggaatgattgatcccaggattctaatttgagcacctgggtggatgctgtgaccatctgttgagacagagatgaatggtaggggggaaacaagtcttccaatttggacatgtgagtttgagaatgtcagagaggcaagtgggtggctggacatggacttgggactcaaggaagaggtctggggctcagcttcaatttgtcaaattgcagatgcataggcattggtgaaatagatggagaagagaggcctcaggaagggggaacatccatattttgatgttgcctcctaagatccttttccacagttatattcctaaaatacacaaagctggccaagtcactgccttattatcttccattggccttctggtaccttcagaaaatatccatgctccatagcgtggcatgtgagtccttcacagccatccccattgggtgggtcttgaccatctcctgccattatcttggacacgcacctaactgcggccgcactgaatgctgcaccttcctcttttccatccccattccttcccacgcaagctgatcactctgtgatgtcttcattccagaaacagctctatcattgcctttgtccaccctcccaggcagtggctgtcagtcaccctccccagcctccctcagcaccctgcacttaaccctgttatgtcacaggtgactttgttttgtaataattgttggcagttatgtcctgccaactgcactgtgagtggctggggagcaggagccttgcccaattattttgacatccagagggtcccacgcagcgtctggtacagcatccaaaggatgtatcacttttttcttcttaattctaagattgttatagattttccaaagagatatgttcttgagcctacagttctggaggtgcaattagaggtgaaatatggggcggggctggggggctgaagagggatagaatttgtactgtggatgttcacagaaagaacactttgaaggtgctcagttccattcccttggctttttctgtttcaaaatggtagtgattacctgagttgtgggtcactgtacaggcatttgaaagttggctcttaatgatgtggcatcctgaagtcccctcatctgtagtctacagatggcttgtgatcagctgttcctggaagaacttcagcaatgaattttaaaaggcagtctttttccaacactgtcacttaaaggttctattctttccagatgttggctcaattaaaggcagcccttagatgacagtaacttgtcaggggaggtcaggatttgggatcgtttggcagcccatttctccagaacaaacatcatagtcaatgcccttttctttgtaacatgaaagaaacaagatcaatgattgttcaggtttgctatttcaaagagagtgagagggaacaatagcctagcagttttaaaatcaactgtatccctctcaaaatcatagaggagtgtagactttatagctgcacttaggacccagaaacaggcattgatgagaacagacagaacattggaccttactctccgtcttccttcctcaccagcagtggactgagaagggagtgtgtggccagggccatcaggctggctgtgccattgatgagctcatccttgtgcaagacaatggctgagcatagaaatattatagtatggcttgagtattaaatctaacactgtatgagaaggtaccaggaagatggtaattggctgtacaaatatcaaattgctactattgatgctggctccccacctactcccaatggaatttaagccctatgagaatggggacttggcagtccaggtattactagaattcaatacttagtgaaggccccaataatactgccacctactccatattgggatactgttcaaagtatggaattggaaatttcaaacccattccaattgcagattgggaccccattctccttctgtggtagtccttattattgactattgaaggtggaaggttgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggcagaagcaagtgccaccctcttgaaggacagagagtacagtagaatggggtgagggtgtatggttgaagacagtagggtaagggaaggtgggagtgggcagacaacatctaaaacccgttcatgggttttaaagaaaatcatgaacaaactaagctgcacaatcagcatagtccctcgccccaggttatttctttatttttaacttatttattaattattctaatcttggagacaagtctgttctcccattcctgacccccaacccagtgttctttggaatatttgatttggatataactttaagattacaaattagaggggttttaaagttgtaaatacaaaagagatttaaagcggtaaagtttcatttgagaacaaaatcaaaggatggagtcttctgagattctgcttcataaaaaacaaaacaagaccctgttttccaaggaagtattcaatgtaataaaaacatcaaacgtttccatttcctttggaatttggggtatgccaactcaagctgcattgatgtttatctctatgctttttattcattttttggagaaattttgtttttagcatatgggatatgtacacacatacatctacacacacacacacatatgtatagcttatttttaagtgtgcattttttttgtttttttttattatgagggtcctgaattgcttcagatgagttaatagatgggtgggaagaaactacactttatgataaagctcctgatttacctggtcaagggaaggctgtcttaccagaagccaggtggccatgccgagcagatgcagcatgtctcaggcatcccttggccctcagagtccctagtggggacacacagtggctggtatacaaagcagagtctggtcaaatctggggcaccaggccgaagccctttcccctcaggcttccatttccatgagagaggaatttaaacccacagtctactcctggaataggaaatgttacagacatccatgcccttcctgcttattgacccaaattcagccttagcgaggtcacttgggccggaaagcgttcagcacccagatggcctggaacagtatctttgtttccagctttccagcctcagaatgcctgtctccccacatgttctccctcagtagataaatctgggcacctgtttgtgttaggcagggatacagcagtgaacacaaggaacttggcccatgacctcaggaaaccaagttaaggggttctgtgcattttagcactttactaaattacctttaaaaatggttatcccatcttagacgtccccccgctaattaggggagccctgtttttccgagtcctcaagagtactaagcactgctcctttaaaaatgttttaacagctagataggtgaaaatgccttagttttcactttaatttgcattattattgtaagttagactttttcagatgatttttattgatttatgtgtattattatttatgaataccctttgctgtctgatttgtaagcactaatatatttagggccttgcatttttgttgcagatgcttttccattcttaaattagacttttacttttccttactttgtgtttttttttgttttttttttgacccaagcttttatatagtcaaatttgttaatagttcccttaaggcttttatctttgctcttattttgtaattttgtgctagtaatgccttgctttaattttaataatttgtaatgcaagacttcccatggtattcttaattttcaaaaatttcttagtgatgtttttacattttttccctctaattgaactttagaattataaggtcactatctctaaaaaaatttctattgtgatttttgttgaaattatattaaattaatgaattcagaaagaagcatctttaaacttgtatttttccttccaagaatgaaatgtttatgtatttattgtcttttatgctcctcagtaaacttttattttcttcatagattttatacctatttttagttgaatatatgtctgtgtaacttatatggggttttttgttattaatgttttgaggttttttttttcttttgcgcatgggatttttttttccattacattttctgactggggatacgttagatcttgatttatgtgagtttattttgtaaactgacaacctgttttttttttaactattctactcggttcatgactgattcttgggtattctaggtagcaatcatataatgtgtaaattatcatttttctccttctaaccaatattttgtaattggcttgtcttattaatttgatattcaaaaacagtatcaaagaattcttgtgataacagcacagccttgtcttacttgtgttttaaaaaacaaatggctcttgtactgtttccaagagtgcattctttgtacacacaagttattaatagatacataaataaaaatcccttggtcacgtacatttgggaagtgtcactctagtgcttccattagtatactgttgtcttttagcttgaaaaattattttctgcattaagaaagtttttttctgcctccaattttactaaaacttttttaaaaatcataattgaagggagaggaagggaggggagcaagggttgaaaaaactattgaatactgtactcagtaatggggtgacaggattgattgcaccccaaacctcagcatcgcacattatacctggtaacaaacctgcacttgtacccctgaatctaaaataaaacttgaaataaattttttaattaattaactaaaatctttattgaatattggctttttcatataatttaagctgaccatggaaaggcaattattgtaaacacagttagctttttgagatactccaagtactagcaaataataaaatcatgtttctcttaaaatattatttaattcagattttatatcagtttagatgaatgggatcattttatttccttatagtttggagaatgtcttaaaatttcttcctatgggtctactgatcacttccccataccagagtaatgtgtggaaattatcttaagagttagtgctttttgcaagttattttggggtgggcagtttgttgaaatcattgagaaattttggttttggcagaggggaaaaagcttgtgtttcttttgcctgaaagtctgtgctttttcatctctgttttccttttattgagaattttaatgtaatttcatgttatatttgggcctatgcttcttcatttgcaaaatttggggtgtggttgactgctaaatgccattgaagtctcttgatttcttggtggtggtggttttgtttgttttattctgtgatcatctcttgcagcagtcattttatgaaggccaggcaggatgccttgggacggggaaagagaagaaggtaaagagtggggagaaggttacatctcctttcgagaaaacctgagttggtttccctttggtgcaaaggcaataatatcttgcatattttcccaccctcccttaaacaccctgtggattaggaactcaaatgactctataggtttaggaagattaatcctctgtgggaaaaagtagagattttctcccccttttctatgttcttggcaaagtgaatacaacagaaaattatcaaaatctgtcatgagagtttgaatttaggaaaattaacttgaatgtgtataaaacatgacactgtgctgccatcccaccggcccttcaagcctaggggagccctgatgtaaccagagcctgagatggagacgtcttgcagaaagaggaggagaaatgccagggtgctgtattcctgttaggtccagccatggtcgtctccattccagagaggtcatgacaagaccattttctacccagatggccaagtgtgtactcttccttgttataaactcatcacccattcatttattcaacaaattgtcctctaggaccactttctgggaccacacagatgcaagccagtctccttcatttcaacccagtgccaattagcatcaactcttggggctagtgggataaagagtgaaaatgttcgggtgcctcaagtaaacaggacctaaaagtattgaaagtatttcacggcccggcacagtggcacatgcctgtaatcccagcacgttgggaggccaaggcgggcagatcacctgaggtcaggagtttgagactagcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaagaaaatatttcacacttgctatatgtattagtttcttattgctgcagtcgcaaattactgcaaacttagggacttaaaaacatttattatgttatagttctgtagaacagacatttagtattcttctggctgggctaaaatcaaggtgtcagtgtggctgtgttccttatggaggctctaggagagaagccttttccacaggggccacttacatttcttggctcatggccgcttccttcacctttaaagccaacaatggcagattgagtccctcttacattatgtctcactcacccgctcctttgcctcttctttttttaactcttaacaacccatattattacattaggcccacctggacagtctaggacactctccctaactcaagatcagctgttcatcaaccttgatcgtatttgcaaccttgtaaagtaacattatattttgccttctaaggttacatatttgctggctctagaggttaggatgtggacatctttgggagacattgttctgtctgccaccatataatttcacaatgtcctcctctgtgcatctgcagctctttgttatgcctttgtcattactgtcagtctgtctggtactctcagtagataccaactgtgatcctgaggtgtagacatcactgtctcaggtctgtatttccttctcctcttctctttcccttttctacttcactccctccataaaatcgatgtgctcaataaatgtaccttcaatacctaagtctccctgtaatcaacttacataaataagaaatcactttctgggacataaacatgaacctggcttcaaatgcaacacgttgtgactgaaaagcaaatgtggctcaggttactactgttaacatgaagcaattcatgtttgaacagaattttcaaaatcaaattttgaactcactgctggagacgatgtggcccccttcatttcctggattattatgcatctcccacagaaccatttgctatattatttctttggtgtttacagaagcagatcatgtttatgaagcatgtccagaagaaggaaatgatatatggaaaatctctacatggggtatagagtcaagtgatccctaggttacagttgagagctataaataggccagtgacttcatgtgtaccatgggactggtattttccatctttcggcccacagtttggataaacttagatggattttttaatagttctttgaaaatggaacattagctatccacagagatttaacttgggacaaaaaaagggaataaaagtcatcatttctgatgacaggattagacagaccttttttcttgaaagtaattgaatattctgtgtgttttttgcagtttctgttgaattgagaatagtgaccatcatttgaggtggaaatagcagaaatgattaatttagaaagaagaaggattgtagggtgggtggaagtggcattttctgcattgtattcttagaaacttagactgttagagttggaagtgctctgataaaaccgttctttaacatacgagaaaacagaggcccaaataccttaagtcccttgtccaagagtatgctgagtgcagaaagccacactgtggctcaggtcctgggccctggccctcagcgtttctcagcccactgcactcatctccagcacttctgatggactcactggggtgacaccatcaaaccatgtgccccaaagatgccttcatgttggtttccacttgggcatttctcatgcttggatggctaatatactccctgcctggtttactcttgagaacccggctttcatctgctgtgggacacagtagcctttgcgtgagtgcctacgtgcacatgtgtccatggaggcagggagggtggacaggcagggagggtggacagtggtacacacactgcaccagcagcacttttaaagacaaggatcatgacaaaagcaacagcaagtgcactttcttttccaaattacccaaggttgttttttaaaaatagtaatatcacttcaagtgttttgcacttggcttggtgaaacaaaatgtgagttaaaactgtggagtattaaagcattattcttgacacacctacaatatgagacactccattgatgtggatagcatatatgcagacaacaagcattgatgttgtacttccacctatagatagaagggggatgtaccttggtatgggagttttgcacttagacaaagtcttagttctcaaccagagctgattttgctcaccacccctccagagggcatttattactgtctgcaggtatttttggtttttgtgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgctactgggctttgaaggccatatagacagttgattaatttagaaacagcttggcttgtggaataaacatacctggtatagtctgtgaactgaagtgagccaaggtggtcccagtattgcttccacacttgctgtctcagatctctgttctcagtgaccagagttaaaaaccagcttccctctgcccttcacgtctgtgggtcctatggttgaggatttttatgtattgtttttctttggggtcctgataaagcttagataaccaaacatagaatttttaaaggtgattgtgaatacaaagaactaaggagtgccttaccctgatccattctttacacaagcagccccagtcagggaaccctatgccaggggaggaattgggcctcagcatggacaagtcttggcaaagaccactatggcagcagtgtctgaaaaaggaaaagagtccaaggagggaggaaatgactaggaggctgctagagccttccctcagcgccatgttctactcacagaccaatgtagtaaaaatgatttgtatttccttgttcctttttaaatttttgaaaaaaaatttccatatttgggggttttccccattgccaggtggttacattccaaagaaattatatcatgggatacagacacaagtatttccagtcatgcttattgtgtagggctgatggcaaggtgattcccctccatggccacacatcataaccaggcaagcccgttaagtatcagcaactggaagtccagcatcaggaccacccatccctctgtcaggcagccccggttggtggtggtaaatggaggagactgaggcctctttcactcacttaaattcggagagtgagccactctactcctgttgggaaaacctatttccttacccaacgagactgtagaaaattcccctcagccatataccatgccaggtttcttttacaagccaacctgtttccaagcaacccttcttgtaaccttctggagccaagtatctgatattcgtactgggagaaagatgaacggattctgcacagacacgggccctgccaacatgggcctgggaagaggggaagctggatgtgtggctcaggagacaggcagaggttgttagaggaagcacagaatactggaggtgaagataaagtcagtagttggccaggccttttgtgcaacggactcaagaaacatgtaagagaacaaaacatttttagactgataactgattacttgtgtacatcttgaaagttggctgctgcagggcctaaacaagagagaggccttacagtaggggttatgtgtccataggctcatggaagcttggcattgagatgatcttcattcattcaatatcatctactcagtcattcagccaacactgagttaagctctgagcaaggcattgtagttagatggcagataggttagcgttgttggaaagagtgtggggtcagaggtctgggctgcagaaacccaccacagtttcctctaatcatgcctgggaagggggaaccaagggggaaggaagcagccctctattgagcaatcaactatgcatcgggcacttccacttgtgttgtagcagcaggagccaataatcgtgcatttgggactgggccactagaagactggcttgttgggatcaagtcaaggggttcttggaaacctgctgagaacaggcccatcacctgacagcccagaaagatgtccgagtctggtggccagatccaatgggggagatccagtgggggagatccaatgggggagatctaatgggggagagccaaaggtgtttgttggtagctctgacgccaacttttatgacctgggcaacaaccaaaacaatttaataacgctctctcagagttcaagagaaaaggactaaacagaaataagcagcagcccagcctctacccagctggtactcctggaaattgcacatgggtgaagcaaggctgcttcctcctgctccacttgtgagaaaaatgactgcctgttctcctttctcagtatcggtctctaagagttgtaatccaaagaaggcaaaatacaattactttctgttgcatttttagagcagcaactgtaagtgggagggaaaaaaaaacagacatctagaaaatggtggaatgaaatatgttaaatcatacaaaacaagtggcttccagtgaccacctatactgaaaaataaatgaaatcagaaagtcgtatatcgtgtagaattttagaggaggaagaaattttggcaattctctaagccagctgccttcattttctagaggaggaaagtgagcccccgtgctataatgaagctgtctcagagtctcacagccccctggtggcagaaggagcctgaaactgattgtgctgcgtgttggtgatcccaaatgtctgtccatgtttgtaaattaatatggtggggcttatgaaatcaggaccacagtcattgtctgtgaatacttctctttttctacctttggtcaaaaagttggttggtagaagaagagctagaagcctagagccagagccgtggagccgtgggggttctctttcatcctatctgcagcttgggtagccagctgggttttggaggagagtgcatctcttccgaagaccttagttgctttccttgcagaagggctgatcctggcctccgggaacgggagaaacatagtaattttaaaggttatgaggaaaggaggatagggatcccgaaggccagggaggaaaagccagtgagtttggagcgtgggagctgcaggcaggtgggagaagctgaaggcctaacgtggctgttttatttgtttaaatgtacagggctcagaaatagaggattttggaaactgtattccactgttctaaaagagaaagtgtgtaggggggaaaatagcatcttgactacaatgtaatcctagatcttgaaacgtgaggttacatggacaaaaaatgcttaatcccaacttgaaagtatgcataatattcaaaattatcccccaccttcagtgctttacccaggttatggagattcttgaaaaacatgtaaatgaactttgtgtatgttagtctatgtacacatttaggaagagttccatttaatagtctttttgtaaaacatgatctaggatttatctttcatatgtacaatccatctgaatttaagtttcctcatctgtgggggtaatatacgggttatggtgagaaataaatgttgcaaataacttaatcttacacaaaataagcacttaacacaataaaatatatgtgtattaaaatatctcaatggaagtcattgcattagagtcttcaaatactcaaaaccagtctttttctacccaggaaacacctacattctaaattttaaagcccctttaggtaaatactgatattaatgtttcagattgttttgtttaaaattctcttggcattgttcttctgtggttttccagaaatatggccagaactacaaagcacatggtactgtaaacaattgctatgccagtcatttaaaataactcaattattaaaggagggatgtcttcacccccactctttcagaaaagacagcttggcctctaaattcttatgaatttagagagaagccattttcctcatcccttcttgatgtcattccttagtccttacatctgctggatctattctataaggagtgtttagggctggcatatggaaaaatgatttgagattggtaaacagcaagtcacagcaagtgatgcctctcactgtcagtctataaaatcactgcatcgtcaatttgaaagtgtttttgttctatgtatgattccatctcatttagcaacagttaccctgcccctttcttccttctaaaccttggatccctgagctttgcttttctatttcgtaaatgttatttattcctctaacatagataatgacatctgtgatataatacatgtatgtataattccctatcatcaacccttacagcttactatgaaaattaagaggaggaagaattaaactggtagagatttgaaaggaagagaaaaactattttgatttcttctagacctgtttcactaccatttattatattcctcattatgtcttttatatatcaagaaaaaaactgcaggaccaaaattgaggcacaagtgggaaaaaacatccagtgatccctaccccaataagaagcttcatttttatttttttctttttgtttgggtaaatggatagcaattaagtcctcctgtcttatgaagtcagagatttatctcttgaattaattaactgcagaatagtgacgagtggcccagtgaacactatcagagcactgagagatgctggtttatttcccctccttagctaaatacattcttctttttaaaactgaagaggtcagttggtgggatgaaaaagaaaggtttgcagtctcttgggataggcggtaaaagataacaaccagatcttgtatgccactgatatttccagagtatattaagtttccatgctggtttccacctttttaagggagttataatcatcccctctcattccctaaatcagcaacaacagcagtggttttgtgtgtgtgtgtgtgtgtgtgtgtgtgtgtgtgtgtgtgtgtgtgtgtgtaggtggggataacattaggccagaagggatggatgagagggtggaggttgctgagggtttctttgaggggaggttggttgtcctaatcttgttttacttaaagctggtaaacagcctagattctaattcctattctaaagattcccaatgttatagtgaaacctttccactttggccccatataggacaccttttcaattagtgcccatgtgtctgtgcacctgacatggcagagggctgtgatatgcccctggagaactctgtagagcagaggtttgactttggccctgacccatctccacacctatgggcaaagagttaaccatggatttgccagtcaaaggagaatgcaaattaaaagagtagaagctggcttggtattgcttggaaacaggcccatgtagccaataaacaagcagttggagtagccacatattttagctgggcctgtgctaaactgaaacacaaaactacaaagctgctatttctgtaattctatgtggggttatgacatcaggtatgacagttatgagcatggactcagggttaacagatctaggttcaagggccagctttgccacctcctcactgtgtagccttggataagctgatttgtctttctgggccagtttcatcttatgtaaatcaagagtaagtaattttgtacaaggcttggactacagtaagtactcaggaaaggccagctagctaatagaatggtgaaaagagccatgaacatattccattcattccccatcaaaagaagagtgagtggagttatggcaagaaaggtactaccgtaatgtgaaaagattccacctaaagatacctgatcatttcttacttcagggaagcccatcttacaggtcctttctggccctacagtgtaagactttaaaagacataggtaggcaggcacaattgcagtttctccatatctttctgcctaggtgtgtttctcaacccccacttcacccacaagctgctgttacatgttcctccaagagtccagcatcccagtgagccaattagggaacacactccttatttgttattgcaaaagtatatatttaattgtgaatatgggtgtaaattcttctaaaggactattttaaattttaaatgaaaaaggctagagaagtgtaaaattttattataaaaaggaataaacaagaaccttatttggtagatgataaagaatagctatagtttctgccctgtgagagcatacaattttaataatcaaaactcttaagagaaggcatggaaattttattgttttagagcttccatggggactattttacaaatgcagtttaactttaattgctgtaaaataattgaacatgactattagtgtataaccataaaaaaatgaaaattataaagttaagagcaaataatacaattaatacacaaaaagagaatctgtctcactagtgatcaggaaaatggagactagaacaacaagactggcaaaagttaacaatattgatgatactggtattggtaggagtatgaggatagaatcattcttacacagcactctgttggtgagtatgtaaattgatgaaatccgtagaagacatcttggcagtacctaccaaaagtataaatgtgcatttttttaactcatcagttcttctaggaatcaaagctgaagaaatattcaagaaataaatgtataggagtatatgaacaaggatattcatcaccacattattttctattaaagagagagaacaagaaccctagtgtctatcaataagagagtagttaaaacaattgtggtacatacaagctatgaaaatctatgtaaccattacaaataatgagatctgtatagatggaagcatagtatttgggggaaaaaaaagcaagctgaaacaaagtatgaatagtacagtctcattttaattttatttttatttttgagatagggtctccctctgtcaacccaggctgaagtgcagcggtacgatctcagctcactgcaacctccgcctcccaggcttaagtaatcctcctgcctcagcctccccaggcaagagccaccatacccagctaatttttgcattttttgtaaagacagggtttcaccacattgcccaggctggtcttgaactcctgagctcaagcaatccacccacctcggcctcccaaagtgctgggattaaaggcatgcgccaccacgcccagcctcatttttatctgtaatgcgtgtatacagacatgtatttttcagtgtgtagagaaaaaagccccaaacacacactaaacagttgacagtagttaaccctcaagaataagtgtgagaagggcacattggtgttttactttctgtagttaagagtttttttttaactttttctcaatgagcatgggctacaatttacctttctaaattgagcaatggtatctttatggatatttatctttcagtctgatatatttttgagcctatattgtttttcaggtaaaaagcatttggttataggtccatagggtatatgcgcttggaatatagatcaaaacaagaaccagaatgaccgtggcttaagctaagttgaagtttatttctcacacgcatgaagtgcagaggtcatttacttgcctctgcagggtattcaggggcctaggtttctatcttgtttttctaccattctcaatgtatagctaacaaaagcgattaaagaagcctacttcatctctgtccatcacatctgtacacagcacaccccttcctggtgaggacgtgacctaggagtcggacacatcatttcctgtcccagctcaatagccagaaaatagtaatgtgatgatacctacctaaaagagaaccaggcaaaatacccagttgaaatccattactatatcacaaggtctccgaacctcagcactattgacatttgggctagataattgtttgttgaggggggctgttctgtgcattgtaggatgtttagcacatccctggcctctgtccaatcagtgctaggagcactgcccaggtgtgacaacccaaattgtctccagacacagccagatgtccctgagggtaaagtcaagcctcttgaagaacaactgctaagtaagaagagaatagatgctgcagacaaccagtaacatccgctataagcattgtgttatttcccccaaaacagtgcttagcactgaactaatatttcacctttcaaataacaagtcctctaccaggaaatcaaacatgctaagattgtgtcaaattttattttggttgattctaggatgaaaagtcaatcctgtcttattttaatctattgaatctaaattgatatttatatcaaataaataacaatttttatttgaatacacagacaaatgaaatattcttccctagtgtgtaagaatagtattaaggatattatagtgtgttacatttataatgaatatctcagtttaaagtgtaatatttctgaaagactaatataacagcaaatatatacagcaaatataacagctctatcctaaatcaagaatttcatctgcagttgatggcctgtctctttttagggcaattaagtgtccataatttgatgctgctgtattatgaatactttaagagtacagtatttttctgttaatgaggagtgtttacttaacatgctcttcctttccaatgagggaacatgctttgctgccaatcaaattaaggtggagatcatttcaaagaaaccatgaaacactttttctttattctgcctctcctattaaatgttgagaagcaaatcttctatcaaacagatggatatactgggatcttgttaaaaggctgcttgataaaaagggaaagttaaatataaagtggatctgtgttgggcttcttccaaggttgtttagtgcctagtgtgtcagaataaccttgttataaggcaaattcaccacatggagtgttcgtgccagcctagggaaggccatcatttaatggaactccagtattcttatttttgaaaatgcagatgctgcagaaattatatcagaaatgtcgttgccaatcatgaaaataacagaataccccaaaagtcacgtatgaaatgattcatactgggagacgggagtaaccggttttagctcctgtaatgaacagaggctgtgtagaggcatgattggtaaagctggacctggaagagtgggtaggatactgaaaagagaatggaaaaggacagcatggaaagcccagagatcagtggatgcagagaccagaaatcacaaggcaagtttaagtgggacagtttggctaaagtggtggatttgcatagaggcaagaggatctctggcttgtggccaaaacagtaactggtccaccagagtttgtgccccctcttccaaagcacagctgggtctggaaagcagttgcagagccggccctccttgcatctgagccaggccgtgtggcttatccttactggtgtgctatgaatgagtcattgtctgtaggacctgggcagttaaaggatgacacacttaaatcggataatttggaaggaatttaagagggactctttttatgagaacacatggacacagggaggggaacatcacacaccggggcctatcggcaggtgaggggcaaggggagggagagcattaggacaaataccaaatgcatgcagggcttaaaacctagatgacaggttgataggtgtagcaaaccaccatggcacatgtatacctatgtaacaaacctgcatgttctgtacatgtatcctagaacttaaagtaaaattttaaaaaagaaaaaaagaaagactctgtttgcaaagatgtgggagaaatgcagggaaaccataaggggtagttcagtgtcttgaggcaaaatgtaccttgttacccgcctcccccacaccgccccccaagccataaaaaggtaagagaatggcactatttctagatcccagagtaggaatcatctggaaagatccacagagaggagctgtaacctttagaaggacacaaccagaccgagtcaaacccttaaggagggagggatggaagtaaacactttgacctcactctcaaacctccgtccagtcttctgccatggtgtcccattggccaaacccaactagaagccagagggagccctttgatgtggccttactgatggtaacccagggcacagagcagggtgaaggagggttgagggacaggcctggggtagatatcctgcactgtcacttcctggcaaaggtaggaagaagtggatattctctcacttctcctatcagccagctggactggggggattttacgatcctaggggctactagagctacagggatgcaggagccaggctctctgaatcacctgacaaaggcaagtggattatcattcagagacactcactgtggactaggtcctatcaaaaaataaacttctcttgaatcaagacattgaattttaggggtgtgttttttttataggacttggtatttgaggattgatttattacagcatttagcattaacaggaactcaactgtagaaagttttgaaggccaagcaaagaatttggattcatttctacagatggttaaaaattagtggaggcttctatgctgggaggtggttttaaaaggaaaaacagaaagagagccttggaatgatgagtctggcagtcacatggcaggtggaatggaacacagtgagcaatccattgatgcagctggcccaaaccccatgtgatcagcgggacctgtgaatcagtcccacacaatacaagctgaagggatggaagcataatcatattccaagttcaggtgccagcctgccatgtagaacttggggaaggaggtggtctaagaccagttgaatgatcaccccactctatgaaagggactggctggcccactgtgagatatggaagaggaaatttggaaagagttgttgatatgtcatgagtaacccacataagggagaggcttgggagagggtctgcccaccatctcaagcctagagaagggggcttctgtgagaccactgaagagtgtgctgtgtgctccctggagcctggaggatgcaatagactatagtatttttctgaaaaatcagaaagttttcagaagagaagttttggtcagctgctctgatgacggcaaaaccaaaaaaggctccttggggagggtgggtgttccaggcaaatgatatgtgaccattggaggacactgagctctagagagagctaatgtggggtcaccccagtcctgtctatgtgaagacctggaaaaacaacaggaaactaccaggcagaggaatgcaatagccatttgcgggggagaactgcagaccccatgagagcacctcacaagaaaaaaagatacatacctggacagccttttcagttcctggtacattttacaactgtactcttcaaaaaacacctttcctacctcttttctcctccctctagcaaccagtcagaaaagagaagagaggctcccaagcccctcccactgctggaggccggcttgtgccaggcaagctgggggaagagagagatggctaccaaaagcatatataagtttttattattattattattattattaagctggactgtacataccagatgtctagatgagaccatttttacagatctatgactgggaataaacagaaaacttttttttttttttttttttgagacagggtttcattctgtcatccaagctgaaatgcagtggcacaatcacagctcgctacaacctttacctcctaggctcaagcaatcctcctgcctcagcctcctgagtaactgggactacaggtgccgccaccatgcctgaccaattttttgattttttgtagagaaaaggtcttactatgcggcccaggctgatctcatactcctaggcccaggtgatcctcctgccctggcctctcaaaatgctggaattacaggtgcaagccaccatacctggacaggaccttttattccagaagccaccagaagggtcatagacctgccgtatatttcatgctggggcagaagaaaaatctaaccccagaatacatttagaggaacagtgggagacaaaaataaacttgttatgattacattttataaaagcacaatcattacataggtttgttgcattaaggccttgacctaaaagaaaaagctaaaaagatgagcaactcctaaacatgcctttgtcatgcctcaaaatgtattttaaaacatagtagcaataccttcattggaggacatttccatcccaatatataaaacataaaatttagaaaacttgggaagtacaaaacttgaaagcaaaaatcacctaatatcccgctatccagaaataattgtacattttggtatatttccttcctgtcttattttcctccgtggatatgtacacgtgtacttggtttttcttgtttaaattttatgatctgtattgtgtcctgctttttaaacttaacatagtatcttatttttctaagttaaggatcacttctaaaatatgatttaagtgatggcataatttgacgagtccatcaaataattttgtcaaatatgctagatccagatttaggtttatatatgaattaacaatatgaatgagaaaaatatagagaatttgactcatagctttagatattccatcaagttgtagtatttatattatcagatgaaagagctacttgtggagacggttgtcacccctttcttcaaactctctttccttggtttcagtgaagccatatttccctgattttcttctactgtgttagtcactcctacgtctcctccaaagcttttcctccttccatctattttctaaatgttgttgtggtttaggactctccttggatactcccctctctctcttggttttctcattcaaccccttggttttcaatatcatttatatgctaacaactctcaaaatgaaatattctctctaacctctatcccaagctccagacttgtatgttagcatctccagttggatgtctcattagcatctcaaatggaactctgaatctctgctccaaaataggtaccatcttcagtttcctcagcttggtaaagtgacttcagtcctctcaactgctgaaggaaaatgccaggaggcattgctggtacttttctgtcccttatttctagtttgcagcaaattctgtctccctccctccaatatatctcaaatccacctcctctgcccatcctctcgttcatcacccttctctaagccatcagtatctctatatgaaccactacaactgcccccaatcactttcctgcctataatccctccaatgaaactggttgtaggactatggaaatgatacagtttgtgggtaggcaaacctcctcctctctgagaggaagtgggacaacctcttgcttctgagttcttcaaatcatttctcaagttctttcctgtattaattttctattgcttctataacaaattactacaagctcagtggcttaaatcaatgcaaacttattatcttatagttctggaggtcaaaagttctaaaatcaaggtgttgacaaggctgcgttccttcagaggctctagcagggaatcaattcctgctactctaagtagcagccagagtgaaccttttcaaataagaatgctgttccctcattgaaacacatcaaaccattaggatggcctataagacccagatctcagtctgtccagtctttccagcctccagttctggcactttccctgttacccgactaatgaactcatatgatttgctttcaggtccccgaaccttactgcttctctatccctggaaatcaactcccctaatttcctaatgtgctttgtctttcctcaccacacatagtaatccaaaatgtcaattccttaagggcaagactctgttcaggtcacctttatgtccccagtttgtacaaaggacacagccagtctttgttgacacgacttgttgactggcccattctcacttttcaggtctcagcctacagatcattcctcagagagacctctgagactccatcattcttgagtgggtctccgcccttctgacctcaattatttcacgctgttctttctgtcactgacttcatttgtctttatgcatgtgtatctttgtctgtttaatgtctctttcccccactagactagaaactcccatgagagcaagaaccacgtctctttttcggcttatgcttcccacaatgcctaaaataatgcctggctcatactaagtgctcagatctttgctggcagaatgaacagcctctgactgaatggggttctgagggaacctcttctctctgctgggggcaacacgggaaaaaatgccagggtcaatcctgaagtagaggagtgtgatccacagaataatgggaccccaaagagatctatgtcctaatccctggaacctattaagaagacattgccaataacttcacacacttggcaggtgtgattaagttaaagattttgagatagggagattatcttagattatccagatgggtccatataaagcgaagtgagaagatcagagtcacagaagatgtgatgagagaagcagaggtcagagggagacagagatttaacaattctgctggctttgaagatggaggaagaggccacaaggaatgcgggtggactctaggaactgattccccaccagagtctctgaaggaacgcagccttgtcaaaaccctgttttaggacttctgacctccagaactgtaagataataagtttgcatttttttaagccattaagcttgtagtaatttattatagaagcaccagaaacttaatacaaggaagaacttgagaaatgatttgaagaacccagaagcaagaggtggtcccacttcctctcagagaggagtaggtttgcctacccacaaactgtataatttccatagtcctacaaccagtttcatgcaatctctctgtctttttccttagttctctcagtgggaatctatccctgtttctttatccttaattctctcagtgggacaaataagtgggctatggcttgtttcttgagtataggttcacggagaggagggagatcctggagctgggtttgagctgtagaagatgaaggccacgctgaaaccagggtgtggcggctcacgcatgaatctcccctttttgggaggctgaggcaggagaattcttaggacaggagttgagatcaacttgagccataaaatgagaccctatcccagccaaaaattgaagaagattagccagagcatggtagcatacacatgaagtcacagctaatgggagttttaggtgggagggtaggttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccaacaaaaaattgaaaagattagccaggcatggtagcatacacctgaagtcacagctacttgggaggctgaggtgggaggatggcttgagcccaggagtttgaggttacaatgagctgtgatcataccactgcagtccagcatatgttgtagaaccggggtggttactgaagaggaatgaaggagaaataataaataaatggggaggctggtcagcatctcccttcccatacacccatataagaattactctcttgctgttttgttgttgttgttgttgttgttgttgttgttgttgttgttaagactgagtcttgctcttttgcccaggctggagtgcagtggcgccatcttgggtcactacaacctttgcctcctgggttcaagtaattctcctgcctcagcctcctgagtagctgggattacaggtatgcgccaccatgcccggctaatttttgtatttttagtagagacgcggtttcaccatgttagccaggctggtcttgaactcctgacctcaagtgatccaccctcctcagcctcccaaagtgctgggattacaggcgtgagccactgcacctggccctctcttgctgttaacaggtgatactgaaccatttctttatggcctagtctaaggcaccttgtcagtgaatatctctgatttagaattagactctcaaaatctatggttttgggaaaatagatcttctcagaaacagagaaagcattggacctcatccctggtaaaaatgcccacaagcaaaaattttcacatgtagtttttaggggttcataaggtcagcttgctcaaaggatagagtatttggtttttaaaatatatatcaggcgtgggagttggtgggaagcagacagggagtaatattctaagataggcttccagtgttaagctaaggggtttggacttaatcctccagggagggcactgagaacccattagagggcttcaagcaaggcactgacatgatcagatttgtgcttttgaaaacaatcactctgcaaacatctatattggccataatcccaacatttgttcatccattcaccttaggtggaaaaatgctgttgacatgaaatgttttaatatttccttttaaagccagtgatatcagatggcatattaagtgacctaattttatagatagtgtgctgtagaaagcagttttgatgtaaggacgtcaaaatcttgtcagatcattgcttttctaagagatggtttgcttaggcatttggtcttattgtaactttcatcattattatctcattgttcgctgcttctcagcttttatcagatccatctctagcagagaaaactccggtaagtaaagcaaaattgtagaatgccgtattgggagccttctagaagaccagcgtatgcacacactagctaagggatttagaccaagttcatctcctggagccacggtttccttatctatactatggcattagaaaccctatgtagctatgtaacagttgtgacaatcaaatgtgatcgttaaaagacagtgctttgaaaaccataacatattacccaaatgcaagctgatattcattttcctcttagtattaccatcatatctgaacatgtttgggttaatacagaggagctgtgaaactaaacgtttgtggtttgcctttatgatgttatatggttctccctttctccaagtatcaaatgctttagaggtttttctagtatccaggcaacatattgcctccacttagcccttgcaaaaacctgaattaaaaatagactctgtttgctgtgttctgaaacttaaacctatatgttttaaaggagtcaaaggttccccttggcactcaaaggggcagtagtcctgtcctagcacttttagagcatatgccaagccatgcagaggaaagtggagaagctcagttgtgcaaagccggcaacccaccaccgtgtcactggtctgttggtggtatcctggaggaaggaagggagctctggcggcttagagttttcagggaaaggactattggttctaatactgcaatcaccaacacttcacacagaaggttctttgtcatcatcatgatttactaatctcatcagagacactccaggtagtgtttcacagtgttttttcacagtttcaaagtacatctggcttaatattaggatgtgcctcagacatttccacaaagcagacaagatgctttttttctattttatttttttaattgacaagtaaaaattatatgtatttattgtgtacaacatgatgttttgaaatatgtatacgttgtgaaatggctctgttgagttagttaattgaggtagtgtgcatttcctcacatagttattttttgtgatgagaacacttaaaatctactttcttggtgatttttaacatacgatcattgttattaatgtagtcaccatattgtacaatagatctcttggacttattcctcctatctaactgaaattttgtccttggaccaatatctccccaagcccccagcccccaaccagcccctggtaactggcattctacttcgagttcaacatttttagattccatatataagatgctttttagtgatacccaaatatatcactattaaagcatttaatttttacacagacctggggaggaggaaactttgaggtgtcattcctagtatgtcagcaaaatgccgccttttgttaatagtccccatgttaccagtggtgacattaacgatggtgtttgtacagctttaccaagaagtttacaagtttttccttggcttacccgtgggtgggtatgattggaagaaataaaatttttacccttttttcaccaaaaggaatggctctctcagagcttttgctttgttgaggtcaaacattcatacttaaaagagaacttccgactttgattctaggctcattttgcaaacactgatatggaggcagcctgaatttggcagtcagactccaccacatactagcaaagggacttgggcaagtcacttaaccttgctgagccttaaatccacctctgtaaaatgggaacagttgttactatgcctcacggttctggagagggtcaaatgagtgaggagattctgatttagagacagtggagtataacttgggactctggagccagcctccctagaggtgagtcccagcttcaccttgtcagtagctgtgttacctcgtgtaagttgctaaaccttcctgagccaatagaaatagtaagagtgcctacctcatacagtcgtgaggataaaaggcttaatataaccagaaagcacttagaacagtgcctgccatttagtagtaaacactacattagtatgtgctatgattatgatagattatgatcataattgttattattcatatatcaagtgcctggcataaattagttggtcaaaaaagattaataactacttttattatttctcccatcagagcacctgaaatttaaatgctctgaaaggaaagtaatattattaccagtctgtttttgatttaactaaatatataacagcagggttcttttcaaaatcttactcctcagggactcaaaacttaaccttacaccagaggagaaagatttttttcttagaacaagagcatatatttggtcctcactccagacctttggaatcagaaattctggggacatgaccgtcatctgttttagcaagtatacccagtgattctcatgttcctgaagtttgataacactaggtgtagactagtcacagctttgactaccttctgttgccagggtggagacaagaattggttactctctttggcaggctgttccagcccaagaagtgttaaaatgatgttatcgtggtggttttgtgagttaagcagatacagatagttctggaaagcagcgtcaggggtgcggtgcgggggctgcagagcacttgggcagcatgtgaacctgttgatagatctggcttagaacagtgtggcgtatcgggccctctgggaagtgcttatgtcacgtcttgtgccttaccagtctgagtgacgcatgggagaagagatgccttttgagtttttatgcaaggttaaaatgaagaaaatccatttcagcctttaaaagtcagagctactggtacaaaaggtcactgacgccaaatggtggcattgcagagctccgagagggagcattaaaatagcagggggtttttttgtttgtttgttttttgttttttttttttaagaaacactgaatgcactgtgggcttaagtcttagtcttttgccatcttgctgccctaggatcttaaataaaagggcatgtgaaaaaagaaaaacacgaagacatttttctacctccttaagtgtcaaggatgtagatagtcgtcctcacactaaaggtgacataacctttattgtagaataagcaaagtgatgaaatgatgcccctatgagaaagtagtctgtagatggactagagacctagccctgctctagatgtagtctgtttggaggtcaagtttggataactgaagatgacactgccttgggaaatgaagccagtctcagaagtggtgtggagaggttgtaagatattaatctggctctgtatacactgcattcttgttgacagaacagcatcccaattgattgaaaagaatctgcgagccatctgaatagaaacagtatttaagtcattaagaatggattgattaccagggcaattaaggagacctgaggatcaaggaccgaattcaggggacactgcaattatagcaaatacaatatgagaggtcagagaagaagtgacaggagagactataagaaagctggaagtgggccgggcatggtggctcacacctgtaatcacagcactttggggctgaggtgggcagatcacatgaggccaagagtttgagagcagcctggccaacatggcgaaatcccatctctactaaaaatacaaatattagccagatgtggtggtgcatgcctgtagtcccagctactcaggcggctgaggcatgagaattgcttgaacccgggaggcagagattgcagtgagccgaggttgcacgactgcactccagcctgggcgacagagtaagatgctgtctcaaaaaaaaataaaaaataaataaataaataaatatatatatatatatagaagtggctccaggaccatattctatcatagaaatcaagagaagacatttttttccagaatagacaggtgttctctggtgttaaaagcttgaagaaataaaaagatataaagcatgtggggaggtggggatgggtcttagatttgctaagtaaaaatattcaatcagaaagaaagctatcttttctataaagtaaatgatctttattacatccattcatgtcagggtttcttaacctgagcattattgacattttggtctggatgattctttgtggtgggagctgtcctgtgcagcatccctggcctctacccactagacgtaatgccaccacctccagttgtgattaccaaaaaatgtcttcagatatcatcagatgttcctggtgaagaaccactgatttaagtatttaattcctaccatgtatgtagcactacattaggcagtgcaaggcataaaaagtatgacacacttcaccgtaaaaaaatacattctaattgtcctaaattgagttattctgttatttctcctattatgttggttaaaactatatatgtgtatactcatacacacacacatacacacacacacgcacacacacacgtatacagtagttattctccaagttaacattacatcagcttaattattggatgatattagaaaagtagtaaatgggaaatattggtgtccccatgctgtatgttttagcacagattaatgtaagaaattattatggatctatggtgggactagtaagcaatttccaaattaaattataagaaacattatcacaaaaaacatttgaaaagaaagagctttaatgtttggaatagattctgcatcaaaagaagcaacttatcatcttgccaaacctcagcctcgtcattgttttggagcaagaaagagaattgaacctcactcatgttttgttgcctgtaccattgaacaaggccctgactgttaagactaatgttgagacccttgttttctttgcagactgcatcatctgctattaaaggtgctattcagctgggaataggatacacagtgggtaatctcacttccaagccagaacgagatgttcttatgcaagacttttatgtggtggaaagtgtgttcctacccaggtaagaacatttttatttgtgatgatttccatgctaaggaaccttctttgtgacaaccccatattgaagggcttttctactatgtacatgtttatatgtacagatgtgaatattgggcctttggcagggccaaaggcagtccaaatgatgtttacttcctgtttcatcaggatgtctcacaatttttatgtggagatggtaaataggtttcatctatggactaattctaattagttgtgatgaatgcctggaagaccatatggagaaagattttgaggttcagtgggaaagagtgcagtaatcacagagtaatgtccgccaagggtttatagaaagaaggcttccatgaagcagcaactggtgctaggtttttgctccccctaatttaaaagcatgggctggtaggcccataattgggcctcaaatctgagtttagtcttatctcttctcttttatgatgactttaacttaactttcctcgagaaaacatggataatcctgctgtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcaccacaagtgacaggatttttcaaatgaaaaataaaaataaagaaaataaaaataaagatattcaatttggggacttgtctttggagctgtgagaattgattttaacatttctcttaaaaataagtcatgttattaccaggcttgggtaaacatagctaaagtgacactttgtttaccactagtgtcctcatcaccttattaaaaatctatatgtatctttagaataattgtctttacacatttatctctgtgtctaggtgtcaactgcctaaaaataaaacctgtttgtggacatgcagtaacccccacatagtcaccaaggagcagagcccataaatttttaaaagtcagctacctcgttttgctttaaatgctcttagctgcagaataaagttggtctactggccttttgaagtctgcttgtctagggtcctctagcagccatgagaaccagattccaggcagaaaatggacaaccgcaaggcccaagatataatccttgcttatgatcctactcttctttctatagttggaaatgttctctgtgtttgtttttaacagcctaccattccaaaaaaaaaaaaatgtatattaactacatgtttttctcttaaaagccagggggtcatgagtttatcttcatcttttggtatgatttttttaggctcataatgcttgtaagtgtgtttgcaggatgtttgtttgagctctcatggtctccaaaggtctctacccagacatttcaactttgttgttctttggctacaaagaacaggagaaatggaggacttctgtgggagtgtggagacagtgagctcagggtgctgagagcattacagctgaaggtgggggtataaagacgttccatgtgctccccctatcctcactgactgacctcttctacttccagtgtccaatcaacacagccaaccattgacgggcacttggggaaagcatggctcaggcatgaggtccccaaatcctaaacactggcacacctggaacttgctagacatgcagattcttgggctccacccagaccaactgaattagaaactctgtgggtgggaaccaggaatctgttttaacaagccgtcggggtgattctcagcacagaaaggtttgagaaccactggcctcgcccatgactttccacttgagagagagaatctttctggtagataacaaattttgttcttggagttattacacgactcttacaactaataaaactcaaatcattttttaaaagcatcttaaatgtcaaaatgacatctattagcactttgcgtctttggccttcactgtcatccaaggtagcagcagcaggtgtgtcactggcagaggagtagctagctgactttcccttatttagaggcatccattgtcacatttaaaatatagcaatttagagtatttgcagcctataaatgtgcacacctgtaatcccagcaactcaggaggaggctgaggcaggagaatctctggagcctgggaggcagaggttgcagtgggctgaggtcctgccactgcactccagtctgggcgacagggtggtactctgtctcaaaaaaaaaaaaaagaaaaaaattacctccctcattttctttataataatattgtgtaaaatgagtaaaagtctataagaaaaactttaaaaattattaagtgatacacgtgtgtgtgtgtgtatacatatacactcatataatatatatctacacacatatgcaatggagtaataaaaatactacataataaatataaaatagaataaaactatttaaaatagatgcatgaaatagaaaggctaaatagatattgatgtttgcatgtaggcacatttagttggattaagttagatttaaattgtccgatagagaactgtgcatacaattacaattacaaatcaaccctttctctgggctgtctaaaataatcaggtactagaccaaaaaatgacatgctgtctgccttaccttttagtgacgatttgtaggaagaggaaggtgggggctggtgagtggaaagatagtagagtttgtgagggaatgttctgtgtgactgaagacaaaggctggaggttcatggaccagaaggtgtgaatctactctgaaagacaggcaagagtccagtccagggaaaaaggtgcagatggtaggattttggtgggtactcgaattaaaaaaatggatttgtgaggcaatattgctggggtcaaaaccaaaaaatcaaattgaccagagtgaaaaatagcctgggtcctagcatggctctgctgccacgtaggatgactggactgtcccttcaggttcgtgtaacaatccatactacttatagtatacatgaaatgctttctattcattcaagcaaccttactaaaaacaccccatgaaaataaaagtctatatcttcccttcaaaaaaaaatggcaatacaatatttaacatttgatgcatttttttttcttgttatttttaaatgaaaaagaattattgtcccggtttggctctacaccctcggactccggctcccacgccaccctggcaggtgccggcctcaacatttgattcagaccaagaatttctttcagcagatgctatcttgtttgtttaagtaacacaggcacaccagatggatttacagtaaacagaagaaacttatgttagtcttgcctcagtttcatcatctggactcagtgtcttcgtggatttagcaaagggatttggcccagtgtttctcaatggaggtgctattggctttgttggataagacaactctgtgcaagacagtacctttcaggagatctttggtccccaggccctgccagtaatatctcctagttgctgtagcagtcaaaaaacccctataaagtgatggataaatttagtatcatgattgtggtgatggtttcacaggtgtatatacacatgtgtaaaagtaacaaatggtatactttcttgtatgtcaattaaacttcaataaatcagtcaaataatgctttctctctaagtatttccaagcccatatggggatgaagaaaggggtaggtgggcaggacaggccctggttgtaagcatccaaaacattctgcagtctctgatggctcaacgagtctatctgggtcatagaactaattacttgaggtaccttgagatgttttaatttactgctttctgaagttgcagaatccgtttcccctagcaaccaaatgcattgtgtttttttcttatttatatattttgaagctgctcaaagttatttttaaatatcaagtacataatttgtcctatgaattatttcattttggagatggaaaaagccctgggcctttttaagatttgaaagaggatataaaaatctcttttaactgtttggctccatgatcttccaaaatgtgttccaaaatctcaaagtagataagtaagaaaatcatgatcatatcttaatattttgaccccaaattctgtgttgggatcagaagctcaaggttatagataggtttcatgcattgataggataaagaagaaggaggatggtttataaagcttgtaccatgtaaacaaggacctaaggtggcaaagggaggcaacatttttaaaaactaattgtgaatcaagcatagttttattcatatagtaaattgacttatataacatatattaatttttattatctttcatctttataagaacactatttggtatatgaaataatttgaccctaagacattaagtcacttagcccaaggctatccagccagtaaatggtaaagccgagattttaactcagggttagctggccccaaagttttgtttttctctacattgtggcaataaagcatgggaatggtatttctgctttattgaatcagaacaagtgtccagcttttatcttagaattatagacctcagtctgcttctttgttcccctaagagccagccctaatctgttctccaggagacactatcactaccttacctggaggtggcaaaaatggtttaaaagctggtggtaaaagtttaaatatctttccatattcaagaataattacacagctgaggaatttttaaagcccctatatttcagtctcttcacttgtaaaacaggagtttaccctgatgtaaagatcattacagaaaacagactgcccttgggtttgacccacatgcacttcaggatttatttggacagccagggaatacccaccttttggaaaagaattccaagaaactacggcaagggtaaaacattatcctaaatgataagcaaacatatatgtcaaagattcatataaaatattgcctcatatcatcactcaatgttacaggtttgacaaactagccaactgcctgcatttctaggcataatgacataaacttagccaagagtccatcttataccagggattcccaatccctgggctgtggacaagtaccagtccatggcttgttaggaaaccagcagcacagcaggaggtgagcagagggcaagcaagtattacaagggcgagctccgcctcctgtcagatcactggcagcattagattctcataggagcacaaaccctgtagtgaactgtgcatacaagggatctaggttgtttgctccttatgagaatgtaatgcccgatgatctgagatggaacagtttcatcccaaaaccatccccccatttccactgtctgtggaaaaattgtcttccacaaaactggtccctggtgccaaaaaggttggggaccactgtcttatatcatgtgggtcagcatacaacagcccatgggacaggccccgcttactgcccgtttttgtaaataaggtttaattggaataaagccacatccattcatttacaaattgtctgcggctgctatctacaatggctgcagagttgagtaattgctacagagactgtatggcccacagagctcgaaatattatctggccctttatagaaaaagattgccaaggctggctgcagtggctcacgcccgtaatcccagcactttgggaggccgaggtgggaagatcacatgagctcaagagtttgaaagcagcctgggcaatatagtgagacctcatctctttatatttaataaaaataaaaataaataaaaaagaaaaagattaccaactcctgatctatacaaacattctgcaccagtttttatgtacatgtgggtagaagacaaagctgccagcttagtcttcttgggagaaaatgagaagtgactgctgctgggcaagccataatatgatgctccttcaaatcaaaactctttatgtctttgttcagcgtgtatttggtgaggatggggagaaactgatttcctattactaaaagccatatacctcttcctttagctcaaaggatttattgcatgcactggatattatacaatattctactttatttgaagttatcttcaagcacggttttccagtatggtaataacttcttggatggtttaatgtttatataaccgatgatgtcacatgttcccagtaaatgacatcccggaatgcactgtttggttggggaatttaagctgtcttcagatgctgacttttacagattggctgtcagctggttggtctctgaagatggtgcagcctcgtcttatacaatgcagttcatgtgtacccatcacagaactgctcagcaacaggaggttggcaccagcaaggaatgtgtcttttgttttgctttgttttgtttttccattcatgagcactctctaatttggcaaaaaagaggaccaatttctgtctctctctctctagttacgtaaagaattgtatgtggaaaccaagggatatccaccttggctgaattggcagaggcaattaataataccttaaggccgcttttacagactgctgtgtacgaaggtccaacttgaagactgggtaccatcagtagtttgttactggattgtagtggcattcacccaactgtagtgccacttaagctttcctaatgtctgcacatcaagacaaagcacccttcatttatcctgtcatacagagggtaaggtcatgtttgttgaatacaagtgagggcatttagcatcctttagcgacactgaccactatcacccaggagttgcgtaagtactagttttgtcaaaagtcctcagagccactattgatggtttggttacaatttgaaataaacaaagctcactaaatggaaaatgctgctctagaggcaagaaagctctgagtctcagctccaaaactggtccccttgtgttgtctttgagatgctaaattagttttaccccattgcttaccaccacatctctcagtccagtgccaccaaaactagcacttggtcatcaggctctaaaaccccataaacaaagctgtgttgttattagtacatagagaggagaacaccaactgaccaaagcttctgtaagtgaaattctacccaccagcccctgtggtgtgaaggcctcatgtggaagtaattgggatatttgggcagggagaaacccctgaaacttgtaacagaatcctgaaaaggaggaataacagaggaacgtcaagtctaagttaagccattcctatctgcttatgacttttctgctgttctgatgtgagtctaatctcccaatcttgtttgttcctgatcagtttgggccattgttttccctccctggactatgatttatctgctaaatggggaattccagatggcggctaatgcttcctcaagcttcaacattgtgtaattctgaacatacgttgccattaagatatatgtatttttagactaagtcaagcagtagctttggccttaaaaatgaacttgcctcagaagaggtgaatatcagaatgccagagctggtctgtgattgaactttaactgcttcttagtgaataagtggggaagaggacagagaaacttctgttctttatttgaaatttctttctccttttttggagctaaaaatgccctgatgtgatagggattgtaacgtgtgcttgcttaattgtttaggttcttacttggcaaaataaagttggaaatccaaggttggattccaaacttttgttgtcgaaattttactggcccatgggatccaagcatctagaaccactgctcaaaaccccatagctgagatttccaaagcttcaacttacgccaagacaagaaagtcagttgtcgggtgtttttttttttttttccacaccctacataagtgcattgaagaaatataaggtaaatcttaaactgtgaggagttctactctttttctgacttcatttttgctaagtctggatgctgagcacagttactcaacaggtaactccagtctcaggcaaggaaagcctgtggacttcaggaggcaaacgttgattgcggtcattgtgtttgaatgttggcagttctgccatggtggaagttgctaagcacttggtacctgtgctgtggagattctgtgctgaacgcctgtgggctggcacccacatctacacacagtaaatgtgccagcgtggggcctcagagaaccaaggttgttgcctgctggctgaccttcactggacttgctgttttgttctctgcactcgtgctcccctgacaaatatccgggcccagcaggggccagcgatctcattaatttgcatttccttcactagagcttcattcatgtcaagctggtatttgttattcattggaacagcttaaatatgcagaggtaaacaaaccttctgctgtggtgctgagcacggagggctcagtttgggggaagaggaatcagtttatggcttttaacctctaactttttaaatttatttaattttgtgaatgataatacacagcaaggcttgtcctgttcttaaaaggaatactgtgaagagttccttttgtccctgtgcctttttttcagtgtccagctccagttatcactgttacttgtggctgttttttccttcaaggattttttatgtatatgcatgccaaaagaatatttgttttcttttttatgcaagtggtgacatcccctacacagcattctgcatcatgtttcatccacttaacaatttatcttagagatcttgccatgtcagtacataataagcacccttattcttttcttaataccacatagaattccattgtgtagctgaatcataattaattagacaagttctctcctgaaggccatccaggttaccataatgagtaaccatgttcacatatattgttttggacaaatgctagtttatccataggataacataggcatgcatttgctggatcgaggagttacatgtttgtaattttgatagaagttgtgaaaatgtccttcatggggaaaaaaagtctcaatttacattcccactaacaatatttcagaatagcattgcccctcaagctacatcacagtcgtggattttcaccaatcttccaggtaaaatggtctctcggtgacatttattttatgaatgaggttaagcatcttatgtttgagtcatatcttttcatttctgtgaagtgcctgatcatatcgtcagctatttttttaagttaactttctgatcttttttttttttttttttttgtctgagacagggtcttgctctgttgcccaggctggagtgcagtggcgcgacctcggctcactgcagcttcaacttcctgggctcaagcgatccttctgcctcagcccaccaaacagccgggactacagatgtgcaccaccatgcccagcaaatttttgtatttttcatagagacagggtttcaccatgttacccaggctggactttttggacttctatgcagttcattggagctctttatattaggagattagcccattttctgtgatatgagttgtaaatattttcccattttggcatttatttttcttattttttttttaactactttttcaatacattcctcatgtgaagtgtttggctcagggctgtttcctatatagtctcaatcatccaaatgtgttaggggctccctgcattcaaagtactttacctttcaccttttcatttactaagccacttaatttgtagaggttctgtactgggcctcgtgaaactcagcttttaaataacagagataatttgaacccaggtctccctggactataaaatccatcatcttaactaccacacagtgtatccagtaggacttaagagagtacagcccagtcttaatattaaccaaaggaaaacagaagccataaaataaaacctactaggagagaaaacaaacaagaagttttgatgtactatgaacctaatttacagaaggcactatttgagaattttcctttccattcacgcaaatacagaggttcaagagtgtgtaacctcagcaattaattgttatttcctgtatgttaattacgccatgaagcaacatccattctgtatgatgcctccattaagtattatgcccactccttttcattttctctgtttatacaaatataatttcttgattatcccatgtaggtaagcctgcctcacagttggcccatacttctccatgtcttaatatggcccaaagatagctagatttaattctttttcatggaatgatttagtggtttttttgaatgaccaaatacctgttattatttctgtatgcctaaggaaataaatgttccccttctctacctgaagctgctctgctgtgtgtacatgagcattcttgtgtgtatgggtgtacgtgtgtctgtgtgtctgtctcacctccagggaaacctaacactatcgttttataccataactgaataaatcacagcagtcagagagatgtgaacccaaggaaaattattataattaatggaaacttcagggaaagatgaataatccaaggagctcagaactaacccaaaatgaaaataataatagtaaatgcagcatcctctctgataaaatcttgggcccaaaactgcaacaaaatgagaaactccatttaggtggaacatgggtgttttatcttacctctttgaatgttgaaggaaatctgctccagtagaatgagttactttgtatgagatagaaggtgaaaaagagagaagaaattggcaacactcttagcccactgaaagcagcctgcttcagaacctaaggccttgtggttatttttactcgcttgcaaaagtgaggaaggatgttataggtctctttgagcctctttgcttttaccctttatttctatatgatctacatttatattaataaattattacatgccatataagttccagaatcattccttttgacagtcccatgggatttaatcccctcctaaatcccaaaatatagaaagagaaaatgtttgggtacagcactggggcatcatgcatactgaatattcaacaataaccatttgaatgagtggatgatttgggggtcattccttactatgtgactgctcttctctcaggcagtcttagtccctgtgtcactctcctagtgtgtagccgggctgctgcctgagtgtaatcctagcctttcaagataaccatttattatatggtgctgacccctaacaacacaagccagctccatcctctggtactcagcaaaaaaaaaaaaaaaaaaaaaaaaaaccagtcatctgtaatcgtgcaggaggaaaaactagttgcgttggttatattgaatagatacttcctaaatagttttcaagggtgacctgtgactatgctgaatttctgccttacatattgattttctaatgtaaattccatgtaataatcaaatcttctctgttaacattatgttgaagactcattccttcactcaacaaatacttattgagtgtctgctatgtgccaggcattgatgcaagaatctgattgatctcaacaacttaaactatagtagatccaaagtgtttattctgtgctgaaagcctttgtcatttgcccagtcctttttgtgtggtatccataaaaagcagaccatgataaacttgcataggctctcaatgtcccacctagaatgtagatcaaagggattttgaacctttacataaaattctattgcattgttctaatttttctgaaaattttaagaacaaaaacactgaaaaatttaagaatgagtggcttaggtggtttgactgagctcatgtattaggtaatattgtatggagtcaaagaataaaaaggatgagattgataaacatcaacatttaggccagtggatccctctatggatctgagcagtaaaaagtacagaaggggcttcaactgtatggataatgttttatgtcttaagcagcattttggattcattgatattcactggtttattctttgtacattttatatatcataaatattgtgtataatttttcaaaatgaacccagaaaaaggaaaagaagataatgatatattgaggaatggaaatcaggttttaaattttttaaatatgtaaggtctccttttttggaaaatgtaaataaaagagttcagattggggtcctattccatgtgatggttctctctgttggtaggatgttttaagaattatttcacttatccctggttaacaatgtttgtcaaatatccaaaattcgtggttaaaaaaatgcatttttgaaattgctccacactctaaggcctagatcttttacccaaagcattacaatgtggttacactggtgataatggagtgatcttcccaggaagaaggcacaaggggataaatgaattttcaggcatgtgacactgattgacagggaaagcctgcacggagtgacctcactaactaacgtcttattctgcctggttatcattggcctttatgacatgaactttgagaaacccgctctcaggggatgatttttctagagataacattggcccaggactaatagagctacaatttgcggtcaaaattgtccttgctaatgtgttctttctttctctctctttttaatattttgacttcagcgaagggagcaatctgaccccagcacatcactacccagactttagatttaagacatacgctccattagcattccgatatttcagagaactttttggtatcaagcctgatgattacttggtaagaacctgtcatttttcttccttctatagaaatgtgtgatgtaaacatttgtctcatagcaacagcaacaagtggcttgtgtctctcattttataaagctctggggcatagtaaaagttccaagttttataatgattataaatttagcttcaagaaatttgatgtgactttgtagcttttactgataactgcaaaatctgtggtggtaattgatatttaaataactataatatcagttgtgacttcagataattattctaacagatatgttataattagttctaaatactcctgtgaattttgctgattagattctatttgaaagcctttctatgttaattgccttatttgtaccattcctctcaactaccttggcccacaatcatttcaccttgacctacaaatttgagtaaacattgtaaagaatctggatagttttgttctcaagatctcttcaggcagactttttaaacatatttttagttggtacaagggcatattttatcctcagatttgtctgtgctcttcatctgccttctggcacacaagaggtacagacacaacagcctttttgtaagaggtagtctgatgtgacctcagagttttacctcattcctgttcaagaagccaggaactttctgttacaagtgaaaaaatggtttgtttcataatttgatcactgttaacaccctgggggctcctcagaattggtttcaaaagactgtaggaagaatgccatcaaatatttattgttcatcccattctgaatgatcttaataagacttgagccagatcctgggataatgcttttcagaggaagtatagcaacacgtgtaacaaagagtgcttaatatgcatcttataatttggataagatgtaaataattaaaagctgattctactctgtgctgatgaagactctcggatgtctcctctgaatcttcttgtaaaggaaaaaagaaaatctgtgaatgatcttctttatttggtccctaagaaaatcatatgacttctgcctaatgaagcaatactgcttcctcaaggcacatcaataagtctccaaagaatggtgagcgcaaggttgaaagtccctagcatactgctgcccttaaatgtatatattactctctttctctcaccactcccctttcattgaagcctcaggtgcctctacccatcactaccaatgcaagtacacaagcacacgcatttgttctgtgtgtgtgtgtgtgtgtgtgtgtgtgtgtgtgtgtgtgttagagaacaccctttggtttctagccattctgtaattactgagggttgccatcattcaggaaatatatttgagaaacccaatggggttttgatattatattatggaaaacaagatctcttatcttctgccacacactcaaatttaatggattctctttctgaatttccttgaacttctcaccagctgaagagatgccttagacttgcgtttcacactgttgatccagtcaatatgaccagatggatgcctgtctttagccctcccatatccattgccccaaaggctggaagtccattctttcattcatctggacctcacaaatttgctttctttggggaagatccttttctgaacaacttcccacacagcctccccaagtttcctaatgagtctttaagctggaaaaattattttcataatgtggttagagtatttacaaaggagcataagaatctaagctcatcacttctcacaagaaaagtctttgtccctgtacctagcaaaaggtaaattaatcaatcagtggacactttgaacaccaattatatctaaaatgctttgctcatagttgtagggaaattcaaaaaactgcaagtcatgacacacaaagaacttaaaatcaaactggaatactaatttgtctatgtagaaaaccaatcaactctaccaggcaataaatgtaaaaactgaagcaaaacatgaaatactctagggttgaggtaggggtctttctctttgttggggtgatgattaggaggtcttcttatgagcatgatgtggttttaaccatgccttaaaaactacaagggattttaaaaggtagaaaagagatggatgctcagggggtgaagggttggaaggggcactgtagaatcagagatgtggatgtgttcagttttcgaaaggacatttagtggaccaatatggctggaggggagagtttttatcaggaacattattaacattattaagagataggtccaggcaactcaaataaacaagcttctaaattataggaaactaaggaaatataaagattgacaagatatttgatggtgttgagaaataacttttttgtgggataataatatcatggttctattttaaaaggagaatccttgtcttttagaagatatactgaaatatctatggatgaaatggtttgatatctgggatgtacttcaatagtatctgaggagttggtcaaagcatacaaaatttgaattagacagccaggcacggtggctcatgcctgtaatcccagcacctcaggaggccgaggtgggaagatcacttgaggtcaggagtttgagaccagcctagccaacatggtgaaaccccgtctctgctaaaaatacaaaaattagatgggcgtggtggcacatgcctgtaatcccagctactcgggaggctgaggcaggagaatcacttgaacctggaaggcagaggttgcagtgagccaagttcggacctctgtactccagcctgggtgacagagcaagactccatctcaaaaaaataaaaataaaaataaataaaaaacaaaatttgaattagagaggaggaataaatacaggagatctattctacatggtgactataggtaataataatatatacttgaaaattgctaagagagtagattttaaagataaatgcttgaggtgatggatatcccaattactcttatttgatcattacacattgtgtataggtatcaaaatatcacatgtacctctaaaatatgtataactattatatatcatttttttaaaaaagaaaaagttcccaccacaaataaagtgatgaatatgtgaggtaaataatatgttaattagcttaattgagccattccacaatgtatacatgtatcaaaacatcatgttgtataccataaaagtatacaattttatttatcaattcaaaaattaatcggaaggattgtgtactctaaacgggtgaattgaatgctatctgacttacatctcactataactgttaaattgaatgcccccctacaaaaagaaaaatctgagggaagtagggcagcagagtggttggaggtctagaagaaacaagattggccatgagttgatcattgattgatcatgaatgagttgtccatgagttgacgctggaagatagatacatgagtgttaatttcacaattcttttcgcttttatgtacgtaaatataacttaaaaggtagagagaggccaactgtggtggctcacgcctgtaatcccagcacttagggaggccaaggtgggtggatcacctgaggtcaggagttcaagaccagcctggccaacatggcaaaatcccgtctctaccaaaaatacaaaaacgttagctgggcacggtggcatgagcctgtagtcccagctacttggtaggctgaggcaggagaatcacttgtaccccggaggcaaaggttgcagtgagttaagattgtaccactgcactccagcctgggcggcagagcaagactgcatctgaaacacacacacacacacacacacacacacgcatacacacacacacacacacacacacgcatacacacacacacacacaaaatagagggaaagatagagccaggtatgtaagtgtgcttttgtttgattccatttgtccacctccctcattcaccacacacatggttcagtgtctagacacatctctggggcttgcaagaaacagaacaaaggcagtggccttagctaaacataactacctggtccccaacagctgctgccacccacctgtgcctgcactggggacacctgcagcacaggactgaggcagctccccaacaaactttggagtctctggaagctcacctccaaaccgctctatctgggactgcacctaatgatctggagtgtgatagatgaggaaagggtcgtttgcatgacacagcatgcttgagtgtcaggtataataaccttcagcgactttttagctcaatccttcattttacagatgaggaatctgaagctgggatcagcaaagggagatgcccaaggttacacacattggtgggggcagagcctagaccaaacagtggtctccccatccttccccaagagcttgaagacccttcaccagctggcctcatgctttccatatttgatgagaatcacagacctcttaccaaatatgtactcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgatattgaatacctgcgatatgtgtgtatttctacttagctttttgctgttgcatctggattcctgcctgaattactctgtttatgccctccatcccattaaaattcaccctgtgcatgctgattacaagtttcatgttgaaacatgcataatttggattgtgagacagtatggtgaaggggcttctgtacatacagcagtgcaaactttccttcttccttattcctagacaaacacctcccaaggcaaagccaaagggccccagagcattcccatctctgcttgggcaaccagctatgggttctttccttctccatcatgtgcctggatattcaaaaatccagtagaacttatatgagtcttttcaggctcacctgcgccaataagaaagagagcagagtgaatatttcatactatcgggggaagaaatggcacataaaattatctccaccacatggggcaagtttacattgttaatttacactggcagggcccagctgggttgtgctctgctttttctttttctccagtgaatatagcagggagaccctgcaggaaatagaagcaagagcatgaatacattagaacagcttgcacagatgacaagtgcctggaaggtgcataaaacccaggagcacacatgggggcttttgatcatgactaattaaaatgttcccatctctcctcttcatttgctcttaagaggcaatgttgcaaagaaggtggcttagaagagaatgtggtaaccaagttgtagagtgagaaaccatagaattctacagcataatggtgatactcctgttcagtatcataatcacagtttattgcacattgatgctagtctatgaatagcccccaaagggttattaaagtggatcaaaacaatttattatttcattcatgttatgtataaatgacataataaaagaatatttgacaatgtagtaaccaatgaaatagtcttcatattatgtcactgcatttttttttaatgtcactgcttatagaagaattggagactttaattgggagcagatgttcaggtctgaatccagtttcttctagacacctctttccggatcaccccctaatttctcaatttgcaacctctaatttctgcatcctttgttgttttcatattttcacaacataaactcctacccataaggaagttctgtgtcaggaattcaaatgccatggaacaaagaatccaaattcctaaagagagtctagggtctgcctttactttttatgagagcttggagtccacacctttatattccagggtcccaaattcgtgagtaaatgagaaacccaacattttcttgcttcactcagaatgttttagtgtctctttggatcaccctgaagtcatgggcagtaggctgagaacctcagtgtatcctagggtggtatcagctcttccttacctgcctgtggaatgagtatattgtaggccgtgtgcttctctcacctgtgtgtgatcatgtcataaaattaacaacagcaatacatggtcactctttgccagggttttcaaaagcattcactttaaaaacttccagtgactttccagtagatattattacctttattttagaaatgaaacttctaaaactccaagatgctaaattccttactcagaatcacataactagcaactgatacaaatctcacgcccttttcacaaatcgctcttccacaaggacactttgtctgcacacatggctgggcaagtgctctctgattcctctcggtttttatggtgtcctgtctgcagtctgatagctatttttgttttcctaacttatcctcaactcatctgtaggcttaggctctaatgctgtttagcaagagattgtcaagaagcaaggctaacagaaagaaggggaagtggacgatcaaagttgccaatgacttaggaagccagcagacacttgcttctttcttttctgggataattttgtttcctttatcctcagtattttcaaagcaaaataatgtaaaagatgtatctagaagctaccttttaatcatgtttctgctagtttctctctccctcctctccctttttctttcagtctccctcctttcaggtttttctatgatagggacttaaatattcacaagctcagaacaaaaattgtgggatttttagccttgatgttttttcagatgcctacatcctcaagatatggctgtttatattacagagctgtagtatcaaaacagcatggtactagtataaaaacagacacattgaccaaataggatagagagcccagaaataaacacacacacacacacacacacaccctatagtcaatagacttttgacagaagtggcaaccacacacaatggggaaaggatagtctctttaagaaatgatgttgggaaaactggccatccatattcagaagaatgaaattggacccttacctcacatcataaacaagaatcatctcaaaatggattaaagtcttaaatggaaggccagaaactgtaaaactactagaagaacacataggggaaaattgcgcagtattgatttgggcagtgatttcctgaatgcaaccccaaaagcacaggcaaaaaagtaaaaatagatcaaaagggttgcatcaaactaaaaagcttctgcactacaaaggaaacaacagagtgaagagacaatctacagattgggtaaaaatatttgcaaataacgcatcaggtaaagggttgatatccaaaataaataaggaactcaaactactcaataacaagaaaactaataaccctatttaaaaatgagcaaaggacctaactatacattcctcaaaaaaaaaaaaaaaaagatacacaggccaagcatggtggctcacccctgtagtcccagcactttggaaggctgtagcaggtggattgcttagcccagaagtttgagactaggctgggcaacatggcaaaaacccatctctacaaaaacacaaaaaaattattcgggcatggtggcacgttcctgtggtcccagctactcaggaggctgaggtgagaggatcaccagagcctggggaggtcgaggctacaataagctgtgatcagcccactgcactttagcctgggtggcagagcaggaccttgtctttaaaaaaaaaaaaaaaaagacatacagatggccagtagatacattaaaaaatggtcaacattcttaatcatgagagaaaaccacaatgaaatatcacctcatacctgttagaatggctgttatcaaaaaagataaaagataacaagtgtttggtgaggatgtggagcaaagggaactcttgtatactgttggtgggaatgtaaattcatacaaccattttggaaaacagtagggaggttcctcaaatagctaaaaatagagctaccatatgatccaacaaccccaccactgggtatctatccaaagcaacggaaatcagtatggcgaagagatgtctgcactcccatgtccactgcagcattattcaaaatgggaaagatggaagcaacataaatgcccatcaaaggacaaatggatttttttaatgtgatgtatatacacaatggaatactgttcagcctttaaaaacaacaaaattctgtcatttagaacagcatggatgatcatagagaacaatgtgctaactgaaaggagccaggcacagaaagataaatatcacatgatctcacttacttgtggaatctagaaaaatcgaactcattgaagtagaggagaatgatgattactagaggctgaggtggtagtgggtggatagagaatagggaaaatgttggcgaatggatatgaagtctgctggatggaacaaatcagctctggtgatccattgtacagcgaggtgaacacagttaatgtatatctttctaaattaatttaaaaagtggattttaaatattctcaccacaaggaagtgtgtatggtgatggatatgttagccatcctgatttgttagccattctacaatgtattcatgatcaaaacatcacatacccaatacatatatacaattattatatctcatagaaaaacaaatactgcatgttctcacttctaagtgggagctaagctatgggtatgcaaaggcatgcagagtggtataatggacattgaagacttagaagagggagggtgggcaggggatggggaatgacaaactgcctattgggtacaatgtccactactcaggtgatgggtgcattaaaatcccaggctccaccactatacaattaatccatgtaatcagaaaccacttgtacccctaaagctattgaaataaaaaaactaaaattaaacaaatcattatttgtcgatcgaaaatttaaaaatagaaaaatttggccaggtgcggtggctcacgcctgtaatcccagcactttgggagggcgaggccggcggatcatgaggtcaggagatcgagaccatcctagctaatgcggtgaaaccccatctctactaaaaatacaaaaaattagctgggcatgtagtgggcgcctgtatcccagctactcgggaggctgaggcaggagaagggtgtgaacccgggaggcggagcttgcagtgagccgagattgtaccactgcactccagcctgggtgtcagagcgagactccgtctgaaaaaaaaaaaagaaaaatttaaagatgatgtggttctttaagcccctgcttctgccaggctgggtctgtctcacacctgcatggcctccttatctttttctctgccacccagtgtttctctagtcaattatgtagcttattaattaataaacactgagcttaataaaaccaaaaacagacttctttgctggttttagcattttttggtgacatttacagccatacaattattggtggagttcagccatctgacggaaatttcttgagtaccaaccatgtatgtaggcacctaccatgttccaaggcacaggtcctggaactgtatcacagtgtaagatagtcacagtttctgctgcaccgagttttacagtctctgcaactcgaggaaaaggaaacaggcaattgcaggattttgtggtgacttctgtgatgagaacatccagggccaggaagcaattgatcttttatccgcggaaccaggaagagttttccagagcaagtgctgcctcagcaggcactgaaagctgaagctgtggcaacagtctatgaattatgctccctacatcttccccttgtccttctacggtggtttcctaacccaacagagtggtcctctgctccagaccctccaatggcttttcggcccccttagagaaaacaacaaagtccttccagtggcctatagcactggatgtggtctgtccccttgacctctctggctccatccctttcagggctcctccttgccctctctgctacagccactggcctctgctgtgccttgagcccaccacatctcaggcctttgcattttctcttccctctgcctgaagtgcccgttccccagatagccatgtggcttgctgcctggtctcaacctctgctccaatgtcacctttgcaaggaggccttcagtgaccaccctatttagaatttactgcaactcattcctcactctttgctggtattctctgctgctttttccatgatccatttttttctccactgcacttaccactttctgatgtgtaatgtatttacttgtttactgtctgtttcctcctactgggatataaactttatgagtgcctgggacatagcagatgctcaatagttattttttaaatacagcaatgagtggtaggcaggtgaaagtagaagggaggttgtcgcaggcacaggaaaacacaaaagcctggctgttgagagtatgcagcacttttaagaacatgagaagttagtctctgtggctagagctaaagttgaaggaggaagtcatgagagagaaggctggggaggaggctgggtcattcatggccttggaagctctgttaagaaccattgatttttagatctcacaaataagtgagaacatgcaatgtttgtctttctgcaaaagatgtgaaagcccagaaaaacatgaagagatttgcattttagaaagatgcctagtttcctggtgaatgtactagaggggatgagagtggacaattaagaccagaagcttgccataacaatccaggcatgaaatgatgaaacctttgaactaagggtgttggcagaggcgggcaggcagcatcaacagtctggttaggaaagatgaggaaatgtgaggaatcaaggatgatgccctagtttctggtttggggaataaggcaaataatgcttccattctctaagggaaaaggcagagaacagggggcagatgatctagggtcaccatatgcagttgtgcaggctgtgcactgctcaagctctcctacctggccgaggggaaggagtggagactggaatccagcctttttttttttttttttgagcagagtctcgctctgtcgcccaggctggagtgcaatggtgtgatcttgactcactgcaacctccacctcccaggttcaagcaattcttctgcctcagcctcccgagtagccgggactacaggcacgtgccaccacgcccggccaattttttgtattttttgtagagacaggatttcaccatgttagccaggatggtctcgatctcctgacctcgtcatccacccgcctcagcctcccaaagtgctggaattacaggcgtgagccaccacgcctggccccagcctttcttctactcaccaactttgtatcctagcccagagctgcatctaccaagataaaaagttgcatctttctaattaccacaaaggcaccatgtgggctaaccacagccttgagatgaacttgattgtgaacttattgcatataaattgtgtgtggtataaccaaaatagaaatgtctattaaagtgttagatgaacaggtcttgagccctagcgaaagatctgggctagagatacagatgttgaagtcatctccttgttgaaaccatgagtagatgacatcttctgggaaaatcatgaaaagagaatagggttggtgttcaagtgataaaacacagtgcagttcacatcttcacttgttattttatggacatttgctggaaacaaagcaccttagtcaacacaactgtttgaattatctcattggactgataggatgattcatgattctatcgcatgactctgggggttaggagtgtatgtctgtttttcatcatagaattattaagataaacagaccaattaaatctttagaaatctcaaaaagagccttctcggtatacgtggagcctcttttaaagcccgtagagaggcttcttgtttcaacatagctaagatgtgcaatgctatgattgtcctccttggaggcatcacgtacatcaagtatatgttttaatgtttattcatttacccttttagtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatggtaaggaactgcacatcattaatgcttctacttgaagtttaattactttcctcaacagtttttttctgttgtttttttcagtgactcaggcatgtttctttctctttggtaagctttattctgcatttaaattatgctatgacattcattgaatagattttttaaagtaaactagaactgaatggcagagcatacttgttgaatcccacaatcctgagttcaaatcccagctcagccaataattaactgtgtgaccctgagtaagcagcataactggtcagccttagttccctcagtctttaaaggctgagaaatacgtggccaggcgtggtggctcacgcctgtaatcccagcactttgggaggccgaggcaggcagatcacaaggtcaggagattaagaccatcctggctaacacagtgaaaccccgtctctactaaaaatacaaaaaaattagccaggcgtggtggtgggcgcctgtagtcctagctactcaggaggctgaggcaggagaatggcatgaacccgggaggcggagcttgcagtgaatcgagatcccgccactgcactccagcctgggcgacagagcgagactccttctcaaaaaaaaaaaaaaaaaaaagctgggaaatacttatcttacatagttgttgtgataaagtaaggatacaggatataaaataaaggaaagataaaggaagcaatgtgtttcaaagctctttgcagccagtacgcagtaatagtataaatggttaactttcatggattgcttactacatgttaagcaaggccttaagtgctttgcattcattaactcatttaatcctcacagcaaccttggatactacaattatcacctttttatagaagaggtaattgaggcaaagataaattaagtaacttgccatgggtgattcagctggagagctgcagagctggggctacgcaagcaaaagggctccagagaatgcatttttaacccctacactaatacaccggaacatattctatattagctgttctcagctactagacttcagaatttagaatttcatgggtaaatgtgatagtgtgaaaaatcacctttcatgtaatattttagagacaaaggaacagtaacttagcctagacggatttactacacgtttactccaaaattttcaaaactatccccactgttcctaaatagtccaggcattttcatacctccagtttcattgtactttgataacagttcttaattttctatgattggaagggctacatgaagctgtctggatttcagaagcccaagttctgccaatcacttgctatgagtggtgataaatatcatctttgtttttaaaaatgcattcatcagatgccatgttatctttttatgtaaaaatattattttaattccaaaatctgctagacacagcattaaatacttaaattaatctcatatagaagtataaaaataaaaaatctcaataaaaatcttagtggcatgcaggcagattttaaaatatttcaatactgagcaattatttttttttggaggaacagaaaatatagaaaagccaaaaaaaaaaaaactaactatagtttctttcccagagatacatattactaaaatatggtgtatatgctttcagttattctttgttcatgcacacattttaaaattatctaaaattaggatcaaattgatataatattatttgataacctgcttaattagtaaatcttaaaattccatagttctgagctcagatatacttgtcctcttgtaaaactgcattggccatatttgactacttatatttaattaaaattagataaaaagttaagggccaggaatggtggctcacacctgtaatcccagcactttgggaggccaaggtgggtggatcacttgagcccaggtgttcaagtccagcctgggcaacatggtgaaaccccatctctacaaaaaaataaaaaattatccaggcatggtggcacgcacctgtggtcccagctacttgggaggctgagaagtgggaggaccacttgagcctggaaggttgaggctgcagtgaactatgatcaagccactgtactccagcctgggagacagagcaaaaccctgtatcaaagaaaaattaaatttagctgaacaagtgattttatcccaattatgtaagctagtataacaatataatccaccccattaacaagaaaaaatgtgaacgtcacgtggttacccaaatagatgttgaggagaagctaaggccctcaaaattcaacatcttcacttaattaaaattctaaaaattggcaggggagtttttttttttttaaaaaatgataaataaatcaatgattatacaagttgtacatttatcagtcttccaaaagttcacatgatagctcatggaaaaatacaggaatcctttctctagaaacaataggaatagaccagagtgcccctcccatcaatagtcctttctgataaatttgctagaaattctggcactgagtcttgagtacaaaaagaaatagaaaaaagtacaagcactgttctctttaaatgacagaattcaaaatgagcaaaccttcattttgctcatgaaagtaaatcaggaatttttagaagtgatatgactccagcagatttgcaggataaaaggtaaatctacaaaatccattatattccattatatagatgatatagagtgggagaatataagggaaaaaagagatcctgttcatgatgacaacaacttataatgaaccctattagaaaaataagtaaataaagtcatgtgagtactgtaattctgattgggaaagcaagatatagtaagtggaaaacataaacaatcagttcagaaagaatgtaataagaaaaattctaaaatacttgaatctataaaaacaaatgttacaagaccaatatgaaggaaactacaaaacgttattgaaggacataaagaagatctgaaataatgaagaaatctgcattgttcctgaactcagtattgtaaagatttcaactgctcccaaatcaacttataaatccagtctaattccaagcaaaaattctaataggatttttcacatagcttgacaaagccaatttctttgaaagtgagagcaagtctcatttgaagaatgttttttaaaatgaacaatcacacagaaagattgtaagaatggagaaaacatttttgaaaaagaagaaaaatagtaggcctgctatagcatatacaaaaaatatataaggctgtaactaatgttaaggatgtaggatgagtacagttttagacagataaattaatggattcaaataaagtgtccagaaatagatctatgtgaatttgtctacttactgtattgacatggagggatttaaactcaattggaaaatgtcagactgttcaataagtatccatttgaggaaaaaattaaattctctatttcagatctttcacatacacacaaaattaattccatatggagtaaagaccaaatgtaatgaccaaaactattaaaaatttggaagaaaataaaagtttatgactttgggatataaaaaagctttgttaaacaaaaagcaaaaagcaaacacacacacacacaaataagaaacaagtaaataaacatgaccgcatcaaaaggcaacacatttaggccaagtgcagtggctcatgcctgtaatcccagcactttgggaggccaaggcaggaggatcacttgaggtcaggagttcgagaccagcctggccgacatatagtgaaaccctgtctctactaagaatacaaaaattatctgggtgtggcggcacacacctgtagtcccagctacttgggaagctgaggaaggggaatcacttgaacctgggaggcggaggttgcagtgagccgagatcatgccactgcactccagtctgggtgacagagtaagactccgtctctcaaaaaattaaaaaaaaaaatttaaggcaacacatttatataaccaaaaataccagacacaaaattaatataagcaccttgaatatttctggaatgaaataaagtgagagcagtggttttctcaaatgttgagaattgggggaagaatcaaggatagcagagacacttttcattgactacatgccgttttgtaaactattttaatttcttatctactttaaaagagaacaaaagtaggcatgtattccctattttttttctttttttttttttttttttgagacagagtctcgctctgtcaccccggctggagtgcagtggcatgatctcggcttagtgcaacctctgcctgccgggttaaagcaattctcctgcctcagcctcccgagtagctgggattacaggcatgcgccaccaggccaggctaattttttaatttttagtagagacagggtttcaccatgctagccaggctggtctcgaactcctgacctcgtgatccacccgccttggcctcccaaagtgctgggattacaggcgtgagccacagtgcccagcctccctgtttttttaaataataaaaaagacaacagactagaagaaactaccccatatagatgagagaaatgataaatatccagagtatatcaagaatttcaacagtgacaaaaacctgcagaaaaaaatgagcaaaattatctttaaggtgactaaaaatacataagtaatcaatggcattcaaatttttaaaaacaggtttctatttttcactaatcatgcttacaaagattttaaagtttgggtactattcagccctggtaagagtaatgggaaaatctatgtacagtcttacatagtgtggttgtaaattggtctgccattttggaagacagttttgcaggagctattaaaattttaaatgttcatccctcataccttggcaattcgttttctctttggctaccttagagaatagtcactcatggcaccagtcaattccttgcctgtttttagttggagccaatttgggacattatgtccaatccagtcactttcactgccctgagtttagaataataaaattgctgtccagtaagcagacttaagaaatagattagaaacagcaaaattttagtaatgaacattaataaagataatcacatcccatttttaattattatatcagcatgaaaacacatctttagtggagcattattttgtcaaaatagaagattgtaaatatatttttctttttttggtttctagaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtaaggaagtttgattgttgtgatttcctttgaactctgtgctcatgtaaactgtggctgccacttattgaaagcatagaaataaggaatgtccaaagtggcagacatgtggaatcctatctttcccaatcctggcgctgagccatgcttccctgatattgaaggaattggtagatgataagggagttatctagagtccttaacctacatctctgttgattttactaataagctaagtcagctttctttgataaaatgaaacaagaaagctttgttttcttttctttctccgctgtggggaagatagtttaactagaaagaaatagaatttaggtttaatgtggtgttgagtaagaaaagccgtatagaaatcttggaagaagtaagactcgaactggggagacaagtttaaagaaaatgtacttgggattaataatggctccctagagatcagtgtggatgcaaaactatgatatgagcagcacgtttgctgaaattattttatgtggtctgaataagaggtgagcaggaatgaagcttgccaattagggcagacaccattccatgcaaacttagctggagtgattgtccaaagtggggaggaattcccccaggctgcaatgctttaaaaaaaaaaaaaaaaaaaaactaagggaagattttttctaacatggtgaaaagagataaaaatttttttagagaaaagaaaaatgcagtgctaataacttctgaaggataataatcatgggagaaccgtccagccacttggctaagttgggtagtggaggtgggcagaaagcatgatggcacaggctgtggttttctgcactttccatgggcctggacggatgacccatgttgttataggggaggggagacacttctctgccagacccaaactcacgtgaaggtgaggaagactgtctgacaccccttctaaggtataaagtagggaatttccactaaggaacacaggtctactgtttctgtttttttttttttatttcttcctttctgcctgttatagcttgcatgattgtgcacaaaaatgtgtccttagaattgtttttctttattgacagagatgttactcctattgtttagctaccgtttattgaatgcttacagtatgccaggttagtctaaggtttttttaatgcatcatttcacttaattctctcagcaattctttgaagtcagtactattcatacttccattttaattgctgaagaattgggttcttaaagagattcagaaacttatccagcattacttaccaagtcaatgacagagcccacatctgtttgggtacaaaggcatgtgcttctaacaactaaaacttaaagtctcactctgaggatttttttttaattatcttttcagaagtcagggaaggagcagtaggaaccaagcaaacagacgaacaaaaaacgtccagcagatattcagatatctgagtggatttgagtgatgcatgtttttctattcaaaaaacgtaaaaacagaacacacatattttagtagaaatctttttcctgtgttttttctgccctttacaggatgtgggtaaaaagtgactctcaattccccagagtttagtgtcagcctctccagttttaagtttgctttctcttttgtgtgcttcttgcctctttagtatggaaagcctttatctgctgccttctaataccacatgcttctctgccagaaaaaaaaaaaaagcaaatgtaaaagagccattgctcaggatttgtctatttattagtgtttcctgagctcaggactgagaccgcgaggtcaaaccaaacttttcatcacaagtgagaccctggagatttgcctttttattttttattctttggcaggtttgttgttctaaggaacataaaggtcaaggtagaggtatcctgaggctaactccctcttactcactgcatttgcagttgtacaagacacagatcctggacattcttcaaaatatgtacatctgccttcagaaaggcttctcttgggctggtatgggagtgtgtaaatgctgagctgtaggggaactcagctcccttccctgatctgtcctgaccatgaccaagtcctctgggatctggattcaacagctggtgctctgagcagagctgcctcaaggaaagcctatttctggaatggtgaatattaatatttaatagtcaagggcctcttagtaaatcgtatgaatgctgtgaactctcctccccccaaaaaatgcccatcctcgtgatggatcgtgaatctcttggagcccgttgttccttcccttccttcttccccaaggctcagaatccccttcctagagttacctctctctctcttcaggtcatcctctgaaaggccaactcactggatgattgcaataggatatgtggttgacatcgccccaatattgcccttgctttgcagagctgagcctcagtgctggctgaggggctgcagagacccagagggtctgcaaggttagtctgagctgaggccagcacctatcaatcaggaatctcctctgctaaaattcctgtgagacagtatggctaaggctctagaaacaaaccagttagagaaatgtattactgtatcagcaccccaggcagagaaaggtgaactaaacctatattaggatatatgcttctattcacttatcagcacatattgcaagcacactacatgccaagcatgaggtgcacgacctttattttttatcaattgccatacagtctagtatgtgcaatgatattatattgtgaagattagagtagggaacattgtagcttgcttttaaaggatgagaagctttctccggataggcaaagcagtagaagcatatttctaggataagagaacaataggtatgaaacaatgggtgtgaaatagcacaatgtgttccgggagctatagttgtttggttttggggcagttaatagggagagcatgtggggtagaagaggaaagtggccacataatatgagagccacatattgtcagaagaccctttctggtggtgccagggagctcttaaggacttagcagtagcaaatccaagaatcccagacctttggaccccagcttctttgttgttcccagatggatttgttaagcctcttaacctatggctgacctccccctgcttcttggcgcccccacctctcctttcatattttggcttgacatctcagaccctggaattctatttcctttagcatgagtgctggccggaagggccagcttgacctagcttattccccgctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaaccctgctgagcccaattcccccacaggatcagagggctctttccaaaagcaggcatccagatgtcaggttctgcaccccatctccacattgctattccccattggctgtgtgtggtgggggagaaatggatatgtaaatgatgagtcccctttcttgaaggctttcctatcccttggcctgaccctctatatgctcactgccacagccatccatacccacaagttaatttgagccaaggaaagagtggtgacattgagtactacaaagacatcacagatcacttgctatcaaaaccagaaagcaggatttattcaaaccatccccaatggctcccacgtgacagacaagctgagatgcgtgtcctatttgaaaactgctcatcccaggtaccccttcatcttccgccaggcctgcacctcttctagtcttctgtgacccagggaacatgaccatcgtgcagccagatacccagatctgcaccctgaagctactccttcctccctcctctccctctttccctgcatgcagtaaaatcaccatgtcccagtctgcctaccaaataactcatggctctgccccctcctcactgtaggcacagccactgcttttattgagaccgtggttattcatcacctggagttttgctgtagcctctttgctggttttcattatcattgccttccatcacatccccaccactgctgccagactgatcctctgatcagaagacttaacactctctggccaaggttccccactgcttttgggcgaaagccagtgattcccagcttggaacattaatatccttcctgatctggtccctgctacattctccagatgcgttcttcagcttctgtctccagccttctctctcccctctcctctgatacagatccccactctccagctcttctaatctactggccacattctctaaaggttttggtttttttatgcatgcctcactctgctggaccgttcttcccctcttctacacctggccctcacctgctcgtctcaggactactcagggatcagttcctccaagaccgtgctgttgtggttccccatgcatcctgggcttacttctttcatgggacttaatacactgttactttttcacatgtaaatcctggagcctgaggagcaaggcttaatctatctttatatctacatgcctggttcttagtaggtacttagtaagtgtttattggaatatgtatttgaacagaggaataatcagctgtctaatgatttaaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgaatcacttgggattatttgaaaagttgtactggttgtcctcctatcaagagtcatttgtgtaacaaaagtacatttatattgcagtgagttttcccatggaagcagtgttgtaaatggtcattagactttttttctttccaacttttattttaagttcaggggtacatgagcagatttgttacatgggtaaattgtcatgagggtttggtgtacagattatttcatcactcaggtaataagcatagtacctaataggtaaattttccatctttctaccctcctcctcccgccctccaccctcaagtaggcccttgtgtctgtcattttctactttatgttcacatgtgctcaatgtgcaactcccatttagaagtaagaacatgcaatatttggttttctgttactaggttaattcacttagaataatggtcttcacctccatccatgttgctgcaaaggacatgatttcattctttttatggctacatagtattctgtgttgcgtatgtaccatattttcattatccagtccactgttgatgggcatctaggttgattctatgtctttgctattgtgaatatggactttattttattagcactgacccctgtcttctttaggtgtatgtactgtctctccagcgagactttaaatgtctcaaagggcaaagctcattctttacacctctctgcagctgcagcacctggcttattctatacactcagtacatgttgcaagattgtgattgaaaactcttttgaattgaaaatgtatatattaattttaaaagaacaattaggatctatttttgtattcattgtaatttaccatgattattttttctctgatataagttatctatgtaaaatctagaatcccatatcatttaattaatttgataaatttttatatgctgaaatatttattaataactctgggaaatgactttgagacaaagtatattagtgagaacttgtgtttacaacccaaatatttttaatccttcaagtgagagtcatttcagagacagtcttgataattaatgacctaatgacttattttacatttattataatttttgttgagccgcatgttattaatttttaaagagtgtggaaccaattttcttttttcacacaaatgactgtaaccataaatattaataggttctcagaatttaatgaaaccagtctcaagaatactgaaactttctgatgtgcaaagaagggtctttctatgtaaggcaagttctgaatttatgaatcagattcttaacagctatgggcatgtttgcatgggttacaaaatgggttattttatataatatttaacattatggctattgcttaccattcagctataattttgctggtagtaaactttttacattttgttcagacagtttattttctttttttgatattgcttgccttctcagttatcactggggaagaaaaaatgctttagacctaatacaaaggagacgtacatatcctgaaggtagaaatacttcaatttaaattatcctctcatcaataaggaattcgattttgtttttagacttcaatcaaaacatgaaaagggtgcagggacatcattgactccacactcctaaattacttgttttgtttttgtttttgttttttgaaatgaagtctcactctgctgcccaggctatagtgtagtgcataatctcggctcactgcaacctctacctcccaggctcaagggattctcctgcctcagccttccaagtagctgggactaccggtgtggaccaccacaccccgctagtttttatatttttagtagagataaggtttcaccatgttggccaggctggtctcgaactcctgatctcaaatgatcctcctgcctcagcctcctaaagtgctgggattacaggtgtgaagcaccatgcccagccaaatccactgtctttcaaagtgtgttttacaaacactgtaaacccatgagatatttgatttgctccattgtcttaaaattatgagttttggctatctgtaatagtttgatatcatagcagtataagcataaagcaaagttaaagttggtgaacaaataaaaccaactcatagaatcaaagattgttcgagttggaaggaatcctaagagttcctaagaaacagtaaaagaatgccttctactctctggtcttagaaaaaatgattttggacttacctagccaagccaggttttattgtgagaacagaaataatgatgtcatatcatatatgcaagggctttgtaaatttttctacctgtaaatttttttactttgtattttgagataatagattcacatgccgttggaagcaataacacagagagatatcatacacccttcactcagtttcccccagtggtaatatcttgcacaatcttgcacaaccttagtacagtatcacaatgaggaaattgactttggtacaacctactgacgtttttcagcttttttcagatttcaccagttttacatgcacatgtgtggtgggggaggttctgtgcaattttagacgtacatagatttatataaccaccaccttggtcaagtacagaacagttctttctcaaagatgcctaatggtacccttttatagccacagctacctccttccctcacaactcttcctaatcctgtgcaattaccaatctgttttccatctctgtaattttatcttttcgagaatgctgtataaatggaatcatacagtatataacccctgagattggcttttttttactcagcataatgccattgatattcatccaattattgcctgtatcagtaatgtgctcctttttattgctgagtgatatttcttggtatggatgtatcacagtttataacattcacccgctgatgaacatgtgggttttttctagtttttgagtgttacaaataaagctgctgtgaacatttgtatactggcttttgcgtgagcacaggttttcatttctctgagataaatgcctgaattcaatttctatgtcatatggtaagtgcgtgttgaattttttaagaaactgccatactcttttccagagtggttgcaccattttacatttccaccagcagtggatgaatgatccatttttctccttttcctcactagcatctgctgttgtcactattttttattttagccactctggtaagtgtgtatttaagtctcttgctaaaaaattacttgagtatatgccccagaaaagctaaagataaatctaataaagcagtttggggatatagaaaagagtggtgaaaagaaagcggaaaaactcagtggttaagtttagtgcctggtgatatgcctgtgagactatgcaactgacaagattcctaagaaaaggcctgcgatacaggagtttaacgtgtgtgtttctaataataagcactcctgtgagacttcatctaaatctattctacagccattggtgttgcttcattatattgtaattacttgattacatgtttaacgtttgctactaaaaatctgctctgtgggaactgtggaacctcattttcccagtcttagctcactcgagagttcttacacagcatttctcttggtgtcaatcttctgatgaagcctaggaaatagcaacagcaaacattcttggaatagtgaatcttacctagtcaatgcacataataaaagcaggttttagtaataacctacacatggtttgtctggaaagaaccaaggtaaatcatgtcaacattgtgaatttgtggattaattgtttggagtacatttgtattgctcatttgtccaaggtctgttaaaggccagtgaattactaaattgcaactgtgttgacctcttcatcctctcagtttttatttaggtggcaactggtgtcgccattgaagaccatccatacaccacaactgttcagtagtcttgggagggggctggtgtttgtctaggcttttgccgcttgctgcagcttagttctgctgaaagtagggaatggaaatgagctgctggcagcaacagaaggaacacaataatccatgcaagatagtgtcagggtagctacaaaaatcaaaataactctatgctgttgttcatgcctgactttctactaagtaagacaattcccaaattttacagaatatgctcttctgggttttggtggagagagggttccatcttggatataacctatagataccaaagtaacttaacatgtaaaacaaatcatatgtaatatgtaatcatcaaatacgtatatacaatacaatacataatactttattgcatggacaataaggatgcatttccaaggcttactttatctgtgggttggttcaggtaacatttatttaaactttgagccagacaatctattacatataggttctctcattcatcttcacaacagccatgtgaagtgagtggtatgattaccttttgacagataaagaagtgaatcctcaggagaggttcagcttccgcaggtccacagagctcacagtgctgcatccagaatttatacccaggtctctctgactccaaacccatgttctttcatcattacactctccttaaggagcttgtgtataatggtggtaaggccactgaaatgaaaacattaagtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaagtttaatgaaaagcataatcaagcccattgacatttgccaactgttaccaatgtgcatgcacacgaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttttaaactctcactgcaaaccaaagtattatcaaaatttctatagaaagaatgaaaatgggaaactgaaggtaatttcctcggctctaagaaataaactccttttcctttcttcctaaaagagatattacctaaagattggagagttgaagcatttcctgagtttgttgttatgtgtctagcaagttttcattttaagtaacttgtcccacagaaatttatatatgcaataattcaagttaaggagagctaaaatctttgggcttatgaaatagaacaatgttatatctactacttagagtttctggcttttttgtaaaaagaacctactggtctctgattagatgaccctaagtgtaggagtaaggtcaatataggccccaagcagaaagacccacaaagtatttgggggagggagcaaagggaaggaaatgcccccaaggacccctcttctcctccctgttgagaatcctgggagtgcagagaggaaagctatggcaggaaggggaagtggccacacggggcctgatggtagcaactctggctttgaagatgtatctggaaaggctttgaggttggctgctgtggatctggttgtggattctgacgtaagccagtcatacagatcatgatgcaaaacagggcagagttgccaacagccaatccaaaagagatgttaggggcagcaaaccctggtgatttacaaaatggaattgaggctccataccttgggaggaacttctggaagctagtgagggactgagttacagagatttaaggcatatttgagagtttccaaggtctaggaaaatattacaaagtttaaaaaatggttcagaaatgtgccttgtgatacattacccagtgcattgtgtacctgtcagacatgaccttgtcttcctcccagaagctttcaacttaggcttaaagaataaagagtaaaatcagtttgattttatagggcttaattttattcattcaacatccagggcacatttatggagtaccgatggtgctgtaggaccagggcctgcacgattaccttgtgaaaagtaaagtactttggacatccagtggttctgaacctttcagaaaagatcaccccatactggcttctgagaggtttggggccacgtatatggctcttcatccctgtcagtatcagtccacactctttacatgcccttctaccctgcaactgagtgtccctttgatatcaccagtgttcttccttcaaagacatttttcaatttagtgtttttttaaattttgagacagagtctcattctgttgcccaggctggagcttggtggcatgctcatggctcacttgcaaccttctctcctgggctcaagcgatcctcccaacttagcctcacaagtagctgggactacaagcacatgccaccacacttggctaatttttgtattttttgtagagaaaggatttcaccatgttgcctaatttggtctggaactcctgggctcaagcaatccacctgccttggcctgccaaagtgctgggattacaggtgtgagccgctgtactcggccaaatttagtgttttgatcgagcaaggataactcttctctcctcatttttgtcccttcaaatactgcatttctaagtgacaaggtagaaaatgtccgtggggggaatgtctccctccatgagaatgaaatggccaaggacaatctgttattcatgaattgatatataacattcaacttttcataaaaaggatacatctgcgaactttctacatgtatacatcagaaatgtgttttaaaagggatatgtacttcactggacagatcaattgtccatagctactcaggctacagagaagttaaaactgaacgtttatttaaaatatcttcatccagccttaatgcgagcctggctggaatgattctacatctcgttaacttcctctcttcatttctccacacaaagacctcatttgtaaactttgcccatattcagccagctccagatgttccaaggacaaaccattatcacgaccaactcagtgtttgctgcattttcataagcacttggtgatctctcttcaaatgatgacgggagttctttagacacagagattctccatcctctgatattcctcattctgaattggctatccaacttttttttctagtttgttagcaatttcagaaaaaggtctacaatcaaattttcaaagaccagaaaaagcagtgattccagattgcagatttactctctgtccactcagatgtgcggggaaaatgtagttacttaattatctatgaatccttttccctactagcatccacttcctcaaactgaaacttatcagttagtaatattgcagtctcttctggtttagacagtcacccctccagttaaatattctgtttattcaaagttgaactctctcagggtaggtgtgaactgtccctgttttatcctccattttttaggtgagcaccattggaaacatagggtccttgtcccatgtggacacacagagctgagaacattgccacaggcctctccatactcacgcattccagctctgccttaactgtcaccttcatgctaagtgtggctttcaactgtgtcatgttgagccactcttgtaccttctttagttttgatcatgtgcatatattaaaataaatatttaaaaaaatattaaaataaatattaaaaagtaaataagactccaaatgatttttttttctaatgataattctcagaacctggattttccatcacttcttttaaaactcactctgtaggtacttgctgttcttagatattgtttctcaataccgatggtgactttcccgggcctcagatttttcctgctctatgaaagcttcaacaatcctagagcatggatcagccagttttctttagccttaaacaaccacaggaatctcagttgataaattctgccttaccttcctgccgaattaattacatgttgttcagcaaacagttccgaattttctctctgtagaaggctctgtgctaagacctgtgggaggtacaaaaaatgaataggatgtagtcctttttctaagaagcttagagtttaaacactaagtctaaaccatcaaggtcttatttatcacggacagattcttccattcttcttctctttctttgtccatagagtaatatgaaaggtgaagggtaagtacttttttctttttaccaagaaaggcagtttaccagagttggtgggctgtagcagacagtggtgagggttccagaattttacctcacacatggacgtggatgtgggtgcttggaccaagtgtggcctctgagtctcacaagacagctggcctatgcctgggctctctgctgacgtaccagttaagccacaatgaagtaaatcattcatagtaaagccaacaagaagatatatcatataatgagaaggatgtgacattttaacataaaatattacttttaaacctgtttacaaaataatttatgaagacatctttatttgaagaaatgaagtgtttataaagaaaacaaaccaaattcatccagcataggaagctggtgaatatatatatatatatacatacacacacacatacacacacattatatatatacatgtatatgaaatctttttaaatgatggatggctatttttaagtgtggaaaaaaaaaaagccttggtacaggttaatccagtacagcccaagttctaaatcacggcatacacaccatgaaaaacacattattgccaaaacaaggatttaatatttatttcattctgctttgccagccaaaattgtatggcttgtcacagcctgtattttctcattatgacattagcaaagaacactgagctttactgaagaaatttaattaaattgaaaagaaagtgtttggctctaactaaactggcacaatacaaggaattctagaactgtattctgaggggtctactttgtgaggaatggcaggcccttggattcatttttccctaaaccagtattttcagaaatgtctatttgcataaaatctccaggacactattttgaattttctgacattattgaattaacaaaaatgtatttgccaatcattaactccttgttcaggaactagattctaggccaactggaaacattactcaggacccttgatacatcttcctgtcagctccacattttgttaatttggttattttgcagatcttccatcaaagattgatcaagtgagatggaacatagcaagttttctgctttaaccactttagttaagatcccaaattattaatttctgtttttttctctgccatctctagctcatcattggcaaagggtaagttaatgctaaacaggtatagacgtgcattttatctaagcatttcaaaatagcacgctaaactttaattttgaaaagtttatacaataaaaatatgtaaaagtagaccaaatattgtaatgaatccacatatactctgtgctctatttttaactcatggccaatctaggtttttttgtttgtttgtttgtttgtttaactgcctctcttcccatataatttgaaacacatccaagacatcacatcattttactcatatgtactttagtaggaatccctaaaagctaaggactctttaaaaaaaaaaaaaactacaataccattataatggattaaaaatattaataattcttactaatcatcaaatgtcagtgttcaaatttctaattgtttcagaaacaactttttgtggtttggatcaggatttaaatagaatctacttgctaagttccttgtcactctgattttttcattttgaaagtatttgttgaagatattggtttgtttatcccagagcatctggattttgctgattacaccacattgtttcatttaacacactcctctcttgtgcgttttttctgtaaatggattgtaggatcctacaggttgagtcagtcagatttaggtctgacttcatatttgatgtctcccctcatcaggaggcacatcatgtcagaatgcctttctttctgcaatgttagtacctgttgatgaccactgattagactcattcattcatcaggagtggtaaaatggggatgttctaattttattatatgtctgctagactgcacaaaggaattttaaacaaaagagtacctgtcacatagtaggtgcgcaataaaatacgtattgaatgggttaatttccataagaacccctatgacaagggagcagaggacaggaaaactaagaaggccttgagatgtgttccatcttagggccagcaccaagcgttcttggatgattaaagagccttcacagttgaccaagcctgtgacatgctgttcttgcaaaggcttcctaaagaaaaatgtgatagtcttactagactcaaagctcagcctaatttatagcaaaacaactttgccttttatctgccatttagctgtatgcctactaaacagtaaatcaaaagaatctctataaatatcagcttgatttttgcccttgacacagtgtatataaaatacctatggtgtgggtaggtttgaaagcactgtaggcttttatctttatttttctgacaacacagagcacataatcacagtaaatgtttttagtgccaaaaatttgttcatgggcattgtaatcatgatgcacaggtatcaagttcttatatttaagatacagggtgtagtgttttacattctttattgctgaatattttggttttcacttacttatacatgtggaaagcagtataacaaatattcattcctactgtgttcagagcacacagcaaaatgcactaagtcaaaccagtctttgttgagaaatgaagtcttgtgtgtatgatacaaagaatataggtgtaacctgaggtagaattttatatgacagagggacactaataatgtgcttgggtcttcagaggggagacatatcccaatagtttgttgaaatcattagtaaatttgcatggagtggggacaggctttgaaaaaacagtaggatttgaaaagatggtaaggaccatctagaagaaacgacatgagcagaagcatcagagtttacatcttcagagcacattcaggggtaaagagctccagttagactagcctggcaaatgtctctaggcaggcattaagtaacaaaaagacattggctagggccatattagtgaggactttctatgtcaaattgaagcactggcaccaagcagtggtgagagactgaaggctttgagtagggatgtgatgtgacctggtcaagcacagatgtcaggaatgggtttgtgaggaaagaatgggaaactgggccaggcatggtggctcacgcctgtaatcccagcactttgggaggctgaggtaggtggatcacttgaggtcaggagttcgagaccagcctgaccaacatggagaaaccttgtctctattaaaaatacaaaattaactggtcatggcggcacacgcctgtaatcccagctacttgggaggctgaggcaggaacattgcttgaacccgggaagcggaggttgcagtgagccgagaacatgccattgcactccagcctgggcaacaagagcaaaactccatctcaaataaaaaaaaaaaaaaaagaatgggaaactgaaattaattcattatcattagagagaaggaacgttttgataatagaagctgcaggattgggtgactcagtgaaggaaaagtagccatgaagtatgaaatcgcattagaatgatttcaagtaaaagagggaagtgaggaaaaagaactgctttggagtgaggtaagaatttagggttatagcatggccatgtgtagacatttagatggtcatggtggctcacgcctgtaatcccagcactttaggaggccgaggtggttggatcgcttgagcccaggagttcaagaccagcctgggcagcaaggcaaaaccccatctccacaaaaaattagtcaggtgtggtggcatgtgcctgtagttccagccactcgggaggctgagatgagaggatcacttgagcccaaaaggtcaaggctgcagtgagtcatgtttgcaccactgcctccagcctgggtgatggagtgagaccctgtttcaaaaaaatatttttttaatttaaaaaagaagtttagagatgttctgaaggaaatatattgggctgcagcttaggaatgaagtcagattaaatgcaacaatttaggaattttctgtagaaagatggtaattggaatctacctttaagaagatctcaaatctatccacttctccctcgagctccccagctgcccctactcattcaagtattaccctctcttacctggactgctgaaataccccccagtcgaaagtaggtacttcctgtgggatcttcccacagctctctgatttttccctccaggccttattacaatgtgtaattcgggcttgtttaatgttgagtatggaataattatctgttgttttatccctgaagatccatcaacttccacagtgcgtggcactcaaacatttttttttccaacaaaagagtcaatgaatgtaagtactagaaagtagaaaaaacagagagctttgggtgaacatctttagggcacaggaagaaaaagtggaaaagtcaaatagacaaagaaccaagagaagccagggcacaatagctaagggagaggggagattcaaggtgggctggtcatagggatcgattctgcaggtggaggaataacatgaatagctgacattaattgagtgctttttgtgtgcctaagacttggcacggattaactcagttaatcttcacagtaactttggtaggaattatttggtaggaatccctattatagagataatacaggtgagaatagataccagaaatgttaaatactttgcccaaaaacaagcaagtgggggagccatgagtcaaaccaggccatctggttccagagcaaggagactgaaccaccctgcagccacaccagctcctgctagcagtaagacagaagatagtttgcagtgtgatgtggtgttaaagatgtaaaagcaaaaggaggaccagctgctctttgtagcctttagtcatgaagagaggatggcaatgcctatgattctgagttaggatatttccacattaggtccccaaatctacagaagttacaggagcactcatgcatcaccagtcatgaaaacctgaggaatatgctctcatttcaagaacaggtagtttttgattgtgtcttcagggtactctagcagctgctttgacattgactttgacattgacttttttactacattccaatgttgttattgacttaaattagtccttgagagagaaggaagaaagaatctgactttggcaatagaaagccttgcagtattccaacttgctttcagttttaaatagttctgtgaatcattcctgtttcctttttttacaagtagggaagtaaagtcctgccagagctagacggaaaggcacctgtatttgcattgtaacctgagttttgaatagtaaatgcacaggtacagaatatactagcaacagtaaggtcaggcagacattctggaaatgtgcacctgagtgatgaactggactaactggtgtctgtcatgttgcagaatgttgctaactcttaaagctcacacatgttaagttgttggcagatttatcaattcttttaattaaaggactgggatgatatgagtaacggaactattttgttcctaattgatgcaaatcttaaaagtacgtgactaaaatctgttcccagagtttctcattacagaagccttttaatttgttttaaaatatatgcatatacatttctctttttgttccttcagatttcttaatcgatggtgatttttcccaacccaaactctaactgcaatggccagctttccacatatggggatagaatttctttttttaagccttccacactgaaagtaggggtcttggcctcacgaggacaactcagcacccttcccagatgctggcaatccaaaagaagagtacagaggagatgaagctctttttaatattttttatcactttttcaaaagttaattctctcttggaatttattctttaaaaaaaaaaatcggaccccttacaggatcaggatagtgtcttactttatccaatagttcagtttggaccacacagcctgactttgtctcacctgtaaaattgcacagttctcttaggcctgttcatgggccgggaaaaaagactgcaagtacaaaacacatggttcaggttgaatattgcaggaaaaatataagaaaaagtatttcatttttaaaaaaatcttcttaacaattaattcatggatgctttgctgaggaaaatgctttgcagaggttgaatattgcatgacaatataaaaaaagcatttttttaaaaaaaacaaaggtttttaacaagcagaattcattcatggatactctgtggaggaaaatcatggtgtccggaatgtttttaagcttgaccactcctaacttgagtaaatgattctgggtgccttttgggaacatccacagtattgtcagagtcttcttaggacctgcttttgaagccagcttactgctttggaggatgctttgggctgtgcagggcagaagactgtgtttttgccaattgaaaattcctggccaggcacagtggctcacgcctgtaatcccagcactttgggaggctgaggcgggcagatcacgaggtcgggagattgagaccttcctggctaacatggtgaaaccccgtctctactaaaaatacaaaaaattagcaaggcgtggtggcaggcgcctgtagtcccagctactcgggaggctgaggcaggagaatggtgtgaacccgggaggtggagcttgcagtgagccgagattgcaccactgcactccagcctgggcaacagagcaagactccatctcaataaaaaaaataaacaaataaataaataaataaaaagaaaaagacaagagaaaattcctgtgttgtcagccatccaggccataccccttggtatccacaaacccagagcttctaaaggaattaggatttgccagaatgacactggtaagcaggccagcaatacagttctatttttgttggctaatttagtgacatttgttttcagaagtgtaattctaggaatgtttacttcaagcgaacacctgttgtctcttgagctagtgtgagggatgagtcaccgtgaattataatcatagtgataagagctagcaattaattaagcactttatgctagagacttttctaagcacttgacttgcattgtcacatttaatttttacaagcaccctatatgatatgtaatagtgtcagcattttacagatgaggaaactgagacacaaggagatgatgtgacctgcctaaggtcacagagtccatgctcttcatccctcatcccccatgtccttatccaagtctctccgagaaaggaagcgctagcactgataaatatgagtagggaagttagcatctgcaaatggtcattcattgtgaagagttgttgaagctgtctcggggggtactgttgccaagccatcatttcagtatggttgagaattagaaaggttaaggcccttctaccacttgtttctgtctgaagaaagcatctaatatctgttagtgttttcttttaagagtctggcccttggtgcttctgacataaaacagtctttctttctcccatggtctgtgctactgtatggtgcagtgaggcactgataacacctccatggagaaccagccaaagggtctggtactcaagcattggatcagtggtaagaaggatttcctatcacccctcccttcctcctccaacttgacatcactcctccttccattaggaaggctggttccacattgttatcaagccattcttagatcacttgggttaggaaatcccacagcccaaacctcttaagtgataagattctactctgagctcctgcctgactcccttctgaacttgactttttgaaagatgaagtgtgaaccctctggaataattgatacccatttgcagcccactctcagttctcattgatggcaaagatgcctgtaatacagaataacctatttcttgaaggccatatgccatacttcacaaagccttttctcaggtggcatccatgaagtggcagccacaggtaactgaatcttcaggcctgatcccctctttactatatcataaatatcaaaaggcagttgggctgaacaagaacaagaagcataagaaattctggattattttatccctaaacaattatctataggctatgatccttcagggtgtttcctagctaaagtataggaacagcttctcatgttggttcagagacagccgttctgacaaccagggttgtcttgcttttctgagcagctttgtgtgagaaataccaggtattaagaagtctgttgtaggggagaatcatatacagactagtagaaaaagaactttatcatagaggaaaacacccagtttgcaggcattcttcctgaacactgctcttccgtctgaaaaggtcctgagtgtcaaagccccacctataccctgaagccatctcaacagactcggacccagacctttgtctcctgtcattttcttttcagagcattgccatctcttttgtctggctgcatccaactatttttaattcccttgcctccccactgtctgctgagtggataattaaacatgaagtactatgctttgttgagattatatttttaaaggacttgctacagggaactgaacggcaccttcgaaagacagactttgagggctgggtgcggtggctcacacctgtaatcccagcactttgggaggccgaggcaggcagatcatggggtcatgggttcgagaccagcctggccaacatggtgaaaccctgtctctactaaaaatacaaaaattagctgggtgtggtggcgggcacctgtaataccagctacttgggaggctgaggcagtagaatcgtttgaacccgggaggcagaggttgcagtgagctgagattgcgctagtgcactccagcctgggcgacagggcgagactctgtctcaaaaataaaaaaaaaaaaagaggttttgagaagaagaccactaacttccaagaagtttatgagaacagaattcagacatagaaaagatacattcagctagaaaagatacattctagctgtgtcttcatgctgaggaagatacaagcgtacaaacttacaagcttgtagagactattggttgttggtttctctgctctactgcttaagagtgtggacaccggagttgactgcttgggtctctgtcacttatgtgctgtgtgatattgagcagattaccttatctctctgtgcctccagtttttcatctgtaaaatagacaatagtagtacctagcttatagagttgttgagattgaatgcaaatgagcttcctagcactggcacatggaaagtactcaatccgtgctattagtgaaactttcatggagggttgagaaaacatgtgcttgtttcagatttgcataaaattcccatcttggagccattgtgataatccttcctgcatgtggcctaataataacctcaagtgtttttattttgattcttcatctctcagccaccccgctgggaggaataacaggagctgtgtgtctgtatatctagagctctctgataatgagtagatgagacgaacaggcctttgggttgactggcttcctggttctttttctcattcaggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacgtaagtgcagccacacacctacccaccctcttgactgtggcagcccacgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttattttttttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaagcaaatacacaataagaatgatgttcgcaattcagagctttttatctgcctaaggggattctgttgttctagtcctgcaccctgacagatgtggtctctcgtctcagccagatgtggtagtaactacaggattaatttgcatgtgtaaaatgcatattgactaacagaaacaactgcaaccaaagtaagttattgaaatggcagactgcatcagttatgtgtactagctgagcaaggagactgaaagaaagcaatcattttccaaggccataagtgcctgccttctagaattctccaacgatgactaaaccatgggcatatttcatttttgtaaaggaaattaacacatattaaatattttttgaaaagttctttcttgcaaatcgatctaactgtccaataatcagttaaattatcctatatcagtatggtgaaatacaataaggctattaaaaaccacgctagcattgaatataaggaaatgtttgtcatttagcaagtaaaaaaatcaggttataaaacatgataaataataccttttcttgactaataaatacatacacacacacacatactagaaaagcgtaccagatattaagtagttatctttgcatcctaggaataactgtttaattatattttttctttgtgtttttctgtattttatttttaaaagtaaacatacattactcttttgatcagaaaaaagtattgcattttttaaaaggaatattttataatggtctaaaaattcttgctcatagttttaaagtaggaataagttttaaattggattcttcccatccaactcttcacggttagcagctacgatattattctcctttgtagggaagtattaatacatcattctggattcccaggatgaccttaactgatggccaaaaaacaaaaacaaaaaggaacaaacaaaaaaaaaagatgaatgggagatagcccagaattcttaaaaattgtcaatttttattttcagtctatttattagaaatgattttttaacttcctattcttataatatgtaatcaaatattttctcttttgctccatcaacagaatgggaggcattccagctaaaagccataggggagaaaaactacttttatttatgggcattattgacattctgcaatcatataggtaagaagtttgaggagtggtcttttattatttcaaaatcaatctacaaaaggttctgaaaaatcaccaaatgagagtgattttacattctcatttcaatttttccatttatatttaggttaatgaagaagttagaacattcctggaaagctcttgtttatgatggggtaagtgacttattttccttattatactgtatatatttctgctttctcagagacttcagagtatgtgcaggaaactgtgttgctagactctaagaggaaatgaaacaacggtctttataaactcagaatcttaggttagtagatcagttcaaatctaagaataaggacaacataaatttgaatagctcttcaaatacatgacatccagcctagcggccagaaaaacaaaatgatatctgtgtctatgtgaaatccaaaggacctaactttgagagaggtctttttttgtagggatgatcagtagggcatttgaaatgaagttctcacacaaccaagctacagtaagtgtgagtcctgactctgatggtgaacagcctggatttgaactctgcattcactgctgaactagccatgtgaccaggcacaatgctggttatttggcctcttacccttgtttctcacctgtaccagggggatagtaatgacacctgcttggtgtgaacatgggacaaaaaaatgcatttcagtgttcaacacaatgcctaacaaatacacagagaaagtgaaaactttttaattggtatggatttctacatcaacatttatacatgctggctgcctgaggatgtctttttttttttttttttttttttttttgagatggagtcttgctctgtcacccaggctggagtgcagtggtgcaatctcagctcactgcaacctctgcctcccagggtcaagcaattctcttacctcaccctcctgagtagctgggacaacaggtgcgtgccacgacgcctggctaatttttgtacttttagtagagacaggatttcgccatgttggccaggctggtctcgaactcctgacctcaggtgatccacctgccttggcctcccaaagtgcagggattacagatgtgagccactgcgcccagccaagaatgtcttaattgatgtaactgaagaaaaaaatcagttaacaaagagcagtttctcccatctttctctctccttctttctcccattccgtctctgtctctctgtctctctctctcacacacatacacacacatacacacacacacacacacacacacacacgcagtcccatctagacattagatttctacttcctgctactaacaacatttattggcctaagttaataacttgaagtagcaattccaaagaatattttggtcaaggatttggtcacacatttccttttaagatgttagcagatactttcttttgaaagagaataaattatagatgatcttcttcttctttcttggaaaggagcccataatttctcagttctgtggaagactgttaataacctttcagcatgaaagatctacattttgtccaccgctaaggactgacttcagtcataatgcacttttaaacaacaggttcacacatttatttccaagaattaacctctaagctgggtgtaggggcatgtgctggtagtcctggctactcaagagactggggcaggatgatcacttgagcccaggagttcaagtccagtcttgaatatagcaagaccctgtctctaaaagaaaattttttaattaaaaaaaaaaagaattaacctcaatcttactgagatcaaaaattcctcctatgaaagaaggtcaatatggtaggttaatttaatgtttccttccagctgagaaaggaagggactgcatacatagtacctcgaacattgaaggggagagagtgaataccctcattccattcccctcctgttttctgagaccatttcaatttcctgttaccagatggatctgaatcgtctagtcttgtaccaaccaggtgcatctaagggccccccacctttctctattgaaaacccaacactttggggggagaccaaagcgggcggatcacttgaggtcaggagttcgagaccagcctggctaacatggtgaaaccctgtctctactaaaaatacaaaaattagccagacgtggtggcacatgcctgtaatcccagctattcgggaggctgaggcaggagaatcgcttgaacccaggaggcagacgttgcagtgagccaagatcgtgctactgcactccagcctgggcgacagagcgagactccatgtcataaataaataataaataaattaaaaaatatacctatcatctgcttttcttttctttttaatgaaaatttctgtgctggttatatatcatgaacctatttttgtttgttttcagacatggctcttacttaaacaatgtttattcatgccaaagcgaacaacaatgtaacttctctttataggcaacggctgaactttaatcctctatggatacccctcaggctcttgccttctgctgatatttctaaattactgccttgttggaagaatgtgtccacttcaggcagatactgccaggataccagaaagagtacattttaaaagatgtagcagggccaggtgcagtggctcatgcctataatcccagcattttgggaggccgaggagggcagatcacttgaggtcaggagttcgagaccagcctggccaacgtggtcaaaacccctctactaaaaatacaaaaattagccaagtgtggtggtgggtgcctgtaatcgcagctactgatgatgctgatgcaggagaatcacttgaatccgggaggcggaggttgcagtgagccgagatccgccactgcactccagcctggcgacagagcaagactctgtctcaaaaaaaaagaaaaaaaaaaaaaaagaaatttctctattggaatccataagcctgaattcaaaatgaagcattatagaagcaaatttactatgtctacaagtgtacagcttggatacatgatttggataaatgattactaaataaacatagaaaagtagctccttcatccacctcctttcccttcatctatcccctttcctggatttgtaatcaaatgacccttcagccctaaagactcctgccaagcatgagagaagaatggagttaacagtttaattcaattcaactctatgcaatcagcagataattcaatgcaaaggagtcatctgttagccttgtctcctaggaatcctcctagcatctcctcaccttgctattgggagatgaaaccagaactttttttaacttaaacgtcaatgtcactcttacattaggatagttttgtttatgtctccaatttttgttcatgattaagggagttacccttcattccagatgacatttgatgcactggttgcctgtatgtaaaaaaagaacttaaaaactcctcctgggacacaatgttatgaataagggcagctgttttgatttatgtagcacagttttttttgctgactctcctctgctcagtttggtcttgagtgtctagaatctttgttccgattgagtctgtgccctcctccctcagccccagactcctgggccccacgggctacaggacattcctgttttctatctctgggccacctttggttaagaatgttggctaacagagaaccaattgcatagatctctcttctgacttgagatgaacattaagaggtgaccctgtgatcctgggtttttgtcttttcaggacactgtttctgttcatagaccaagcttttatgcagacagatttcttaagttcatgaattccagagttttcaagaaaattcaaggtaagattcttatgaatttttttttttacttttagcagctaatttcattatgtatctttgcaagatttttattggaagaactaacacatttctctccctgcagcagtaatcacttagtaattatggttaagtaacccagtcaggtgtttattgatgccataatcattagagtcctgcttagtggtgaaaaaatttagaaggtatctaaatgtccaaccatataatatattggttaaatatattatgatacagtcaaataatggaatagtatgcacccaataaaaatgatgtgttagcacatttagtttgctaaatatagatgtatttaccttttatgtagttatcagtctgtataccttaaatgcacagcagaattctaagggaatatacaaaacagcagttattctcataggacattctctaggatggatcatatgttaggccacaaaacaagtctcagtacattttaaatgactgaaatcatacaaagtatcttttctgatcacaatggaatgaatcaataaacagtgaaaactgaaaacttctcaagtatttgaaaattaaaccacacactcttaaactagcaatgagttaaagaagaaattacaaggaaattagaaaaacctcaagatgaatgaaaaggaaaacaaacatacgaaaaatttatgggatgctgtgaaggcagtgctctgaggaaaatttatagctataaactcttacctttaaaaaaaaaaaaaaaaaaaggaggccgggcgcggtaatcctagcactttgggaggctgaggcgggcagatcacttgaagtcaggcgttcaagaccaacttggccaatatggtgaaaccccatctctactaaaaatacaaaaattagccagacgtcgtggtatgcacctgtaatcctaactacttaggaggctgaggcaggagaatcgcttgaacccaggaggcggaggttgcagtgagccgagatcatgccactgtactgcagcctgggcaacagagtgacactgcgcctcaaaaaaaaaaaaaaaaaaaaaaaatgaaaaaagaaaaatctcaaatctataccctaactttaaaccttgaataactagaaacagaagagcaaactaaacccaaagctaacagtgcttattccagatcaagggagtatgtgggctcttattttcctttatattgatatttattaaattttctacaatgaatatgttgtatctgtgggaagtttttaagatatgtgaaaggagaaaataatcctatatatagttattttatcattttgctattctgtggtccaatttcataaactaaaacatgataatttagccatacacaactgaaaaagtagaatgttcatgttttatatttaaataagacaaattttcctggtaatatttattggagattttttaattaatgaaagtcaaacacttgcaatgtaaacattttggaaaatacaagaagatgaaaaaaaaatgaaaattcttgaaatgccacaacccagagatatccactgctaatactttgatgtactttctaccaatctttatttctatactttatgtatttacgttaaaatgatagcataatggtacacaattttaggtatagtcctcttttttcacataacattataacatgaatagtttataatgttatatttttcatatcattgtatattctacaaggcaccatttgaagttgcaacacattaaaattgtatgagtgtgacgtaatctaatttttttttttgccagaatctatttaaccattctttcagtattgggcatttacattgtttctcctttttctatttcttaatagtttatgaacataatttcagataaacgttgtgtccaaatttaggattatttctttagaatggattccaagaaaggggtactagggtaataaaatgcacgtaactgcacggatagattgtgccacagaaggttcccacgaggccatgagagcccgtattctgccagcccttagccagcattgtggtttttaaattatgccactctgataagtaaaaaatgttatctgattgttttattttgcatgtaagtactggtaaggttcaacccttattcatgtttattagccatttgtagctcctttgagaattgagctttgtaacatttgaccatttatattgggtgtttgttatttttccgaattattaatatcaattccatgtattaaagatattaacccctttttaaaccttatttcactctaagggaaactttcttccacatttgactctctcagtggtatcttaaaattgctgtcaaattgacatcaccataaattatttgcccaaggtttctttggcctaaaatagactataagatagtgtttattgagactgcaagcctacatgaataccagcttgtggttccaattttttttttttttttttttttttttttttgagacagggtctcactctaccactcaggctgcagtgcagtggcgtgatttcagctcactgcaacctctgtctcctgggtttaagcgattcttctgcctcagcctcctgagtagctgggattacaagcatgcatcaccacacccagctggtttttgcttttagtaaagatggggtttcgtcgtgttggccaggctgtcttgaactcccagcctcaagcgacccacccacctcagcctcccaaagtgctgggattacaggcttaagccaccgcgccctgctgtgtttccaatttttaagaaagatttttttcacttttcttagcactgtgccaaggttggaaaaacatgggtttcactgcagcccctggtgcgttttggaggatctagccctttaatgttctagctttggtgagcctcccttaggagactccccatcttgggaggtttttctttcttaggggcatataaattaatggtacaatcaatggcatcttcagtttcataaaatatggcatgtgtcgcagatttttccggtttggataatttttcaggtttttaatggaacaagttgtttaactcacgggtaatcaaatctattgacattttctcattttgattttattatctattttttaataatagctttattgagatataattaagatgtgtatgcttcacccttttaaagtgtacaggcctatgattcttgatttattcacagttatgcaatcatcaccattttctaattttttaaatttatttatttatttattttgagatggtgcctcactctgtcgcccaggttggagtgcaatggcgcaatcttggcttactgcaacctctgcctcctgggttcaagtgattctcctttcttagcctcccaaatagctgggattacaggcatgagccaccacacccagctaatttttgtatttttagtagagatggggtatcaccatgttggccaggctggtcttgaactgctgacctcaggtgatctacccgcctcagcctcccaaagtgctcagatacaggcatgagccaccatgcccagcgattttctaattttagaacattttcattaccccaaaaagaaaccccatacccattagcagtcactccccattccgtcctcttcccagcccctggcaactactgatttactttctgtctctatggttttgcctattctggcatttcatataaatcatataatgtgaacttttctgtttggctttttgcacttaacagaatatttttgaggtttatctgtagcctcgtagcatgtaccagtaatttattctttttattgcagaatattccattatattgatataccatagtttgtttattcatcagttgatggatatttgggatgtttccattttggccattatgaataatgctgttacgaacattcatggacaaggttttgtatgggcatgtattttcatttcttctgaatatgtacctagaagtggaattgctgggtcagatggtaactctctgataacattttgaggaactgtcaaactcctttccaaagcagctgtgtcattttacaatcccaccagcaacatatacgagttccagtttctctacatcctcactgacatatgttattgcctgtctttttttcttttggctatcctggtaggtatgaagtagtatctcactgtagttttgatttgcatttctctaatgactaatggtattaaacatcttgtatgtgcttattagcaatttatatcttctttggagaaatgctcactcaaaccctttgcccatttttagttgcctttttattattgagttgtaagagttctttgtatattctggacacaagtccgttatcagatatatgatttgcaaatattttcttccattctgtgggttgtctttttacttttttgatagtgtcttttgaagcacaaaattttttaattttgatgtccaatttttttccttttgttgctggtgtctttggtgtgatctaagaaagcattgcctaacccaaggtcatgaagatttactttcatgttttctttgaagagttttatagtcttagctcttacatttaggtttgtgattcattctgatttaatttttttgtatatgatatgaggtagagtctatcttcattcttttgcatgtgggatagccggttgtttcaccaccatttgttgaaaagcctattctttccccttattgaattatcttggcactcttattgaaaatcatgagagaacataaaccagacaaaaaaaaaaggaaaagaaagtcgattgaccacaattataataaggatttacttcttgactctcacatctgttctattgatcaatatgcctaccctcatagcagtaccatactatcctcattacttctggtttgtattgttaagtttcataatcaagaagtgtgagtctttcagctactctttttcatactgttttggctattctgggttccttgtatgtccctatgaattttataatcagtttgttaatttctgggggaaaaagggtagctggtagtttgataaagatagtgttgaatttggggagtgttgccatcttatatcttacatcccataaatgtgggattctttttagttaagccttatgcttacaaaggacttcaccattgaataatcagataaatgttcacccatatttttcttttaccttttatagattgttgtttatgttttcttttctttaatctatgttgtattcattttggtgtatgaagtgagggagatctaaccttgttttttcacaggtagttaactattgtcctaataccacttattgaataagatatttcacttcaaagcacagtcaagtactttatcacttttgtttattgcgtaggtagtagtgataatgtttatagtgctgctacagtggaaaatagtcctgctacagtgggaaaggtgattcctatctacttttcttgctttatgttttctaacatttatcatgacctataatgacctatactttaggtcctatgctataggttttacttacttaatgcctgtcccctttatttaaatgtaagctagctgggcacggtggctcacgcctataatcccaagactttgggaggccggggtgggcggatcacgaggtcaggagttcgagaccagcctgaccaacgtggtgaaaccccttctctactaaaaatacaaaaattagccagacgtgctggcacatgcctgtaatcccagctacttgggaggctgaggcaggagaatcacttgaacctgggaggcagaggttgcagtgagccaagattatgccccactacactccagcctgggtgacagagcaagactctatctaaaaaaaaaaaaaaaaaaaaagtaaggtgactgctgtatccccagcacttaatgaagccatgtgggtttggagggtgcacatattgtaatttttatttgttgaatggatgaatataccatgtatactgggtccgatcttctccttaaggtccaggacagatccctgtagagattatctccactacagggtaattttaaccattcactccctcttctggctccacacctcatccttccatctgctcattctcatatatcatagaaacaaacctcctcaacgatctgtctctcttcagttcctggtgtatctttttcctccttcactgtcaccctattggagatgagagttggatgtacttgctgtctcactttttttatttcttgtcactattcagtgttctccagtggcttttgatcccaccactctaccaaaatgttctttttgaagtaatcaacaatcattgctcaagccattgaacaactttcagttttttttgtttttgtttttgtttttgtttttttgagatggagtctcactctgttgcccaggctggagtacagtggcactatctcagctcactgcaacctctgcctcccaggttcaagtgattctcctgcctcagcctccagagtaactgggaccacaggcatgcgccaccacacccagctaatgtttgtatttttagtagagacagggttttgccatgttggccaggctggtcttgaactcctgacctcaagtgatccacccaccttggcctcccaaagtgctgggattacaggtgtgagccaccgcacccagcctctttcagtcttcttaaaactctccagcatgtgagaccactgatagcagttctctgtgaaataacgctcttcgcttgtctttcgtaactcaggacttccctggttgccttccagcctctcttctcctccttggtatcctttggaagcttttcatccctgcttactcttattgtggttgctcctcagggtccaggctctgactcggtctcttcttatacagcactctgggtaattccctgttctcccaagggttcagttaccatctgtgtacttgcaacttactccccacacttctagcaattccccttgcctgtccactccccaaacttaagcatccactagattccacaagctcagcatgcccaaaattgaatttagccacttaccaccccagagtctgcctctctacctgggtccacgtcttatggaagaccaccacaatccacccaattacccagccagaatgctgccatcatcccttgaccccttccttctgcttaccacccacgtgcagttactcagcaacacctatcagtcctcactctgcagtatcaggattgcagccccttctctcacagtacctctcctgattcagccactgtgttttttggtttgcaggttttattattatttttttttttgcataaagttgtggccccaaacaggtctctttgcctcccatcatgtacccattcaatccaatttccacacacacacactgcagctagaggaatcagtttaaaatataaatctgctcttgctgatttctgttaaaacccttccatgctaataataataataataataatgctaaaggaaataaacgtccatggattccctggtgcccaaagtccttaactttcacttaacacatttcctggcacacagtagacactcaatggttatttgatgaataatgcaatgaatgaatggaatttttatctaacaccaccatttcaaagggtaattaaattattagaaaagtagacacttgagttaactttaagatgttccatcaaccatggttaatttaaagcccttaatgcctaaaggcatactcccctcccaccaagaaaatagtacctggtcttcaagtttcttttttgaagtcagtgttttttaacctttttaaatcccttcatcccacccacaagtgagtcatgctgccggtgtaataatgtctacaaaatcctataatatttcctggaaatattagccaccattatgttgaaacttcactgaaattctccatacgaataatttgtctaaagtactaaagcttagtttcctgaatagaatataagagttaaattaatttgttagagaaaattaactgttctaaaacttcagaacaataatgcattcatgaacaaacactcgtgcacctattatgtatctagcactacactaagcactgatgatatagaaagctttttaaatattgattagttcctccctcaataatttaatagtctcttttgagccggagattgaaacatgtgacagatctgtaatgaaacaattgctaatatttctgcatatgctactatgggtacgcggagagaaataagagaaaaaaagaccaattcttccaaaagagagctcacagagaaaaagatatttcaactaaatcctgaaaatgtaacccagagttcattaagaagagagacaggaagggcatctcaaggagaaagaacagcatgtgcaaaggcctaagggcagaatgaacatggtaggttccaatatggcagaagggtgagctgaaaagtgaacatggaggcagtcgagtggcagaatgcaaggctagaaatggacacaggatacctactgccagccatggttgagccaaagacaaatctaggcgtttctgccacacaaaaggaagcaaccagccacccaaaccagctctcaatgttacccagtcaaaagagatcctgagaattaaatttctgcaaaatccaagctcttatctgctgagtgagatcattcctttaaggaagaaactcaccacttgagacaaaagtgaactctttgttgtggtgctatgtggtcttggcagaggtttgttttccggtcttctctgctcctcattatacgtgatgctgataaagaacaaagagttacttctttttccagtcttttggccttcactccatgaaatgccatgagtataggtctcctgagtatcttttcctcattacacggctctcaccctgatcgcatttccttggtactgccgaaaaccttttgatcattgctgtttcttcgtttagagaaataacattgacctaagaactatgatgtagaaaagcagttctcaaaccttttggtctcagggccacattacacccttaaaaattattgaggacaccaaagagcttttatttatgtgggtgatagctatctatatttcacatattagaaattaaaattgagaaaaatttaaaaatatttattaattcttaccagttaacaaaaaaaattgcgtgttaacatcagtcaatttttaacataaataattacaaaatataattatattttccacaaataatttagtgagaaaagtggaattgttttacctttttgtttgaaatccttaacgtctggcttaatagaagataagttggagtctcacatctgcttctgaattcaatatgtggtgacatcacaggtcatgtaacatctagaaaactctacacatatgagagaatgaaagtgaaaaaggcaaataatgtcttatgatgatgatgaaaataattttaacatcacagatcttctgaaagggtctcagagaccccttagtttccaccccacatctgagatcctctgatttagaagttttaaaatacagctgggcacagtggctcatgcctgtaatcctagcactttgggaggccaaggcaggcagatcacctgaggtcaggagttcgaaaccagcctgaccaacatggagaaaccccgtctctactaaaaatacaaaattagccaggcatggtggcgcatgcctgtaatcccagctactcaggaagctgaggcaggagaattgcttgaacctgggaggcggaggttgcagtgagccgagattgcgccattctctccagcctgggcaacaagagcaaaactccgtctcaaaaaaaaaaaaaagaagaagaagcagttttaaaatactatattgaaagacaggagtttattgaaggtctataaaagttagcagatagagatgataggttgataggtgtagcaaaccaccttggcacatgtatacctatgtaacaaacctgcatgttcagcacatgtatcccagaacttaaagaaaaataaaataaaataaaataaaataaataaaagttagcagatagaatgttaaggcagaggccagtgtgacaataatggcttcttccttgtaaaacaagtgtaaccactgtttgagagagtggagaattaaggtaaacataacttattttttaaacattcaaaaatttcttcccctcaaagaaaaacaaattcaaggtttatctttttctcccctcagtttaaccagaaaacagaatgctaaagaactagaaaatgaaccacctagaaagcaacttaagaaaagaaagacacctgaaattcatgcttgctagttctgtgaccctgagcaagccacaatctttctattctcagtttctggacctaaaaaagggccttcctcttcctcatacatgtggatggtttgagatatgcaatgtgaatgttggattccagactctaaagccctccacaaatgttatttattaggatgatgatattattatgattctaagactgctcgagggacaaataaaccttcccttctctttaagtggagagattgtcctccattcttctctcatttgtgtgtcccaaagtccttctccaattaagttcttgcaagcagcctctgggaaggccccagatgagctgtgtaatctaagctctgagattcccaaggctaaacacaattactctaatacacttactatcaggctacccctttatgcaaacttctaaaggaagagagacactgccaaaaacatattcaggggaaaacataaagaggcctcaacttccctctccccctccctccaaggaaattctctagcaatattaagccaagaagaattattgcagcaaatagtgaatgtaaataaggatggccttgctgccgcttaagcagcttccatggacgtgtcctccatgaagtcccaggcttcagcaagcatgattgatggtgaagtacattttcattagttcaggttcccaacacacttctgaagttgtagactgctgtttagacaaagattggaagtgaattatacgtctgacataaaaccatgacctagaaaagagctaaagggtaggaaatgtcagtggaaagtcacagaaagaaaaaagcaaccagaagtaacttggctaaattgggcaacatgagtagaagattaaacattggcatgtttagaaattcccagtcccaagttaataaaaccagggtcgtgagaattctctatactttaccatctgtgcttatcaactcacccatcctcctcccagcactagaaaaacattgtttggagaggggggaatgattctttagcaataaaacatttgaattttacctcaagtaagactttattgcaaaatctggagagaaattttaacttttaatttgctctaggaaattctgatttaagtcaagtcattttggacaaataatatagccaattcatcgtattcatcagatgaaacaagttcatctccctttccatatatataaaataagcgtcttgtcttctattcaaataataactaaaatgttaataaataataaaatattcacttttaaataaaatagtaatgtgattttacagtaaatatctgtatttgtccttttcctttctgtctagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaaggtaaagatatgtaacttttttaaaaagacaaacgttcttgtgatttatttatacaagtaaatttgcagaagaaaaatttaaaaatacctgctctaagaaataaaatatattaattaagtttttaaaggatagctacagtggccgggcgcagtggctcatgcctgtaatccttacactttgggaggcctaggtgggtggatcacttgaggtcaggagttcgaaaccagcctggccaacatggcgaaaccctgtctctactgaaaatacaaaaaattagtcaggcgtgatagcgggcgcctgtaatcccagctacttgggaagctgaggcatgagaatcacttgaacccaggaggcggaggctgcaatgagctgagattgcaccattgcattccagcctgggcaacagagcaagactctgtcccaaataaataaataaataaataggatagctacagtaagatgcagttcatgcacattttaactaccacataaaaaatacaatttatggtttacgataaaaattagacaatactaattcaaaaagaaaaatgtctgcttccactacctgatggtaacaaatactaacattttgttgcttttacttctagaccttattctgtacatgtacacatacacatatgcacgagtacacatacacacacatacactcaatgtaacaataagttgtctcttcatttaggtcttctttaatgatttattttttggtacccactggtaatactcaggaggtactacacgttctttactttgaaagcttcataaccatgagcaggtaccaagagaaggaaagaaaagaggcagaaaggaaaaatatggaacgtttcacaaatttgcatgtcatccttgcacaggggccatgctaatcttctctgtatcgttccaattttagtatatgtgctgccaaagtgagcgctttaatgaatttcaataaagttttataatatttttcttgtgtggcttgtacatataccttttgttagatttatttcttggataaatgcagagatattgatatagatttttttctggatttttaaaaacagtatcttttttaagaattgagttttctggccatttgttgctattgcatagacttcacaccctttttgtctttttttctttcttaacttgctggttaggacttcttgtacaatgataaatagaagtggtgattgtagacagccttgctttgtcctgattttaaagggagtacttctaatgtttcactgttgaaaaagaagtttgctgtatttgatacccataatcaagtcaaggaagttcctttttttattcctactttgctaaaagttttttttttttaattaatcaggaaggagtactgaattttatcaaatactttatctgccaagttaatcatttgttttttcccttctaatcaaatatgggagaatgacattttagatttttctattagtatattctttggagaatctcagcatttcctgaaaatgtcttctactttctacagaagttaagacctcttctaggggttttcttttcctcagagtctttaagatgtggtgttatttctattccttcttcagcagcacttatccatatgtgctgtttggtttctttctttctcatcttcccataaaccaacttttacctggagttaatgatttcagcaagagagttacagaggtgcccttgatcctctccgaattggtgtctccaattcctagcagacattcatccctttctcctaagctcccctgcactggcatctcccacactatactacctgattttctgatagcacatgcaaaactgcaggtgcctgtagtctgggaaataggataaacttattttaaaattatattagtttattgatttgcatatgttgaaccagccttgcatcccagggatgaagccgacttgatcatggtggataagctttttgatgtgccgctagattcggtttgccagtatttcattgaggattttggcatcaatgttcatcagagatattggcctgaaattttctttttttgctgtgtctctgccagattttggtatcagggtgatgctggcctcataaaatgagttagggaggattccccctttttctattgtttggaatagtttcagaagaaatggtatcagctcttctttgtacctctggtagaattcagctgtgaatctgtctggtcctggactttttctggttggtagcctattaattactgcctcaatttcagaacttgttgttggtttattcagggattcgacttcttcctggtttagacttgggagggtccaaagaatttatcccttccttctagattttctagtgtatttgcacagaaatgttcatagtattctctgatggtagtttgtatttctgtgggatcagtggtgatatcccctatatcattttttattgcatccatttgattcttctctcttttcttctttattagtctggctagaggtctatctattttgttgatcttttcaaaaaaccagctcctggatgcattgatttttttgaagggttttttgtgtatctatctccttcagttctgctctgatcttagttatttcttgtcttccgctagattttgaatttgtttgctgttgcttctctagttcttgtaattttgatgttatggtgtcaatttcaggtctttcctgctttctcttgtgggcatttagtgctataaatttccctctacacactgctttacatgtgtcccagagactctggtacgttgtcttcattctcatggtttcaaagaacatctttatttctgccttcattttgttatttacccggtagtcattcaggagcaggttgttcagtttccatgtagttgtgcagttttgagtgagtttcttaatcctgagttctaatttgattgcactgtagtctgagagactgttatgatttccggtcttttgcatttgctgaggagtgttttacttccaattatgtgatcaattttagaataagtgcaatgaggtgctgagaagaatgtatattctgttgatttggggtagagagtactgtagctgtctattaggtccgcttggtccagagctgagttcaagtcctgaatatccttgttaattttctgtctcgttgatctgtctaatattgacagtggggtgctaaagtctcctgctattattgtgtgggagtctaagtctctttgtaggtctctcagaacttgctttatgaatctgggttctcctgtattgggtgcatgtatatttagaatagttagctcttcttgctgcattgatccctttaccactatgtaatggccttatttgtctcttttgatctttgttggtttaaagtctgttttatcagagattaggattgcaactcctgccattttttttttccatttgcttggtaaatattcctccatccctttattttgagcctatgtgagtctgcacatgagatgggtctcctgaatacagcacattgatggatcttgactctatccaatttgccagtctgtcttttaattggggcatttagcccatttatatttaaggttaatattgttatgtgtgaatttcatcccgtcattatgatgctagctggttgttttgagctgggctgagttcttatcaggaagtgctgaagacgaatcctcttccaagctcattcatgttgtcggcagaattcagctccttgtagctgttgggtggagatccctgcttctttgctgtctgacagccaagagccatgtttagccctggggtccatccacattccctaccatgctgcccctctgtcttcaaacacagaatgtcctacaagtcagccccaaacactttgtctctctgacttcttgtctctgacctctagacccagatttaaagggctcgtacaattaggtgaggctcccctgaataatcttccctttgactaactcagtgttagccaactcagggcaacctgagttacatctgcaaaatcccttttgctaggtcacatcacatagccacaggaataacagctcatcatgtctgcaggccccacaacaaagggagaatttacaagagtgtgggtcattacgggtcatcttagagttctacctaccacactggctttagaaaaaagcatatgggagcatgaggaaacacttctctccctcaaagaactgctcctcatgggttgaggggtcaccttcccaatgatgtgtgacctgagactgagtcactggacagatgtgttttgctctgtcactcaggccatgtctactttgtgaagtaaagctggtatgcccaaaacctaggtcgaagaccagctccacctaccttataaggagtggcaattcattggaatctgatatcaggttatttttgacacccagttttcaatgttatggagagttttcatgtttttctttccatttaatgagaagttgggatcaagaatattgaagattgcaagccaggtgtcacattaaagttgaagcctttctaatttttgaaggttgagcactttggttattcatggttttatatgacgatcatcttttatccatcgctgcagttttctattttgacttgaattggaggcagagctccaccaccccagtgtgtcgtctgatttcccagactagagtccagcctttcctgtgcttgcctggcttccctccatgttgcttcctaccccaccatctatacccttcacatccaaaatccaaaacctcacactcatacgagaatccctgttagggtcggtttatatttacacactaaaaatctctaattttgaatttgttgtgcctataaaggaataccaggaataccttaaagttataattgtatttattagcatctattttaggtcagtcttgggggagtgatggaaagaatccacatagactccagagagatgggcaggggttactgcccagccttgaacattcctctttcctcacaaggatgggctctcgcataagtaatttcatgggcccctaagttttaaagaaaaaataagtgttttctcatttttaaaaaaggcagctttgctgttaaaatatgtcaataagagtcctggataatgtttaaaagtatttatgggctcagatggggttaaggtagagctgactgttagtctgttgaagtatttgtttcccagctcttgaaaagcctgggttcttagatccaacctgagaatcatagatatgtgcatatcacagggagggcaaaaaggttcactgtctgtttatacacttgccagtcatccttttaatctctgccaaattgtctgctttaactcctatgagtttttttatgccatctttttgaaatagtaaatcactttattaggtttttaaaagaacattcataatgtcatttccatgagccattttgtaaattaatgcaatttccttcctgtttaacctgtttgcaagaagctattttacatttctgctgtaattcagaaaaaaaaagtgcagttaattcataattgaatttgcagcctgataggtaaaatgaatgcttttgactcatttcaattattatagatactaaagctgcatttatccttgagattcatgaatgtgtgtgttgctttcgttcctagccctgggatcccgacacaggccagacctggtccctagcactccatcactgtttgaagctgcttccttggcaaccacaatttcatcttcttccttatacgtcaatgagcactatccacacgacaggcctacactctattcaaacaggtaatacttagtgcagtcaaataacccatcaggctgttaccacatcaacatcaggcctgaaccagtatctctgaatgaggacacgtctctaacaaccaggatgtgcctgtcatctgcctcataggtcggagagagaacatgcttgatttttactgtggcaaaagaacattggagggaaaaccctcatgatttttctttacagttgatcattatgtcatgtagaaattatatacttggctcaatggaagaagacaaatctttcatcatttttattttagtaaattttttaggaatgggtttcttcagagtgagcactcttagttaatattacacaggtagctgcaaagatattgtaatattctcttttggtatgtgtgatcttagtgactatggtaaacagaataattgctcccccaaagctatccacatcctaattcctgtaacctgtgaatatgttaccttatatggcaaaagggactttacaaatgggattaaattaaagatcctgaaatgggatgattatcctgaattatccagataggcccaatataatcacagggttcttgtaaggggaagacagaagaaaggtgagaatcagagaaggagacacaacatcagaagcagaaggcaggatactccatttgccctgatatgattattattcattgcatgcctgtaatcaaaatatctcatgtaacctataagatttttggaaattgtatgctctctagcaactttgtgtgaatttttatataagcactgttttataagttctatgaagtgttataaaaatagaaacaaattttaaaaaataagtaaaataacaattatctgttaaatgttagactagttcttgttgaaacctagctctcaataatcaagatcagatttatgcaggtgaagaattccttacgctttaagtcattttccatctccaggctagcagttcagttgatttccaggaagaggaatcaataaggtagatttatttttaatatatggatatccatagagtctagcttagtcttttggtaagttaaagtttgctagtcggacctgctataggaattcttttttgttgctgtttcctcctccctcagctagatacaagattaggtaggcaggaggttaggcggccagtctaggtccagaaaagtagatcaagtgggtagcaaggtgagccgcaaatcttagctgggcctgagtttgcactgttctgctctaagggccaacaaataaggctctattaaaaattatttaactcatctaaactatacaaagttatttgatttggtcagtttccttggattggagaaatttaaaatgacttaaattaatgtgtaatacttagtagtaatgtcaaatgtttaaacctggtatgtaaattagtcaagcaacggcctttcctgtctgtttggtgcagctgaacacatgggtctatataaagttcttttgctctcaaatataaatagcagctcaaaagatagctggaaggttgcaggaagttcttagcaaggtcaaaaacaattctcatgtgaagccatggtgatttcttaccgtttgctgtcatgataattattggggcatataatcggatgtgctcttcaatcatttcgtgagattttcagccaacaataaaagggttttgttttgttttgtgttttggtagcagtggtggtggtggtggtggtggtggtaagtatccagtctcttgaccaggggtgttagactcttgggtattcataaggttttcccggggcctggcagggcctcctcctgactcccaatcgttcctggccatcctggaagctacctctgcatgttccacctccgcatgctcccagagctgtgctgtcattcttgatgcttttatttacaccgatactgactagcatatagatttggagggggaaaataaaaagttatctatgatatttttcctttcttttaaatatttatttaaaacaagtgcattgttttaatcttctttggcactgtatctccaaaatgcaatttgatatcttatatttcactatcaatcaaggttcacttgcaagaacaagaaaccacttaatcttaaccagaaaggaatttaatctagggaattgggtgcctacaaagtctgtggaaaggcagtgggcatgggctccaggctggcaccaggaaatccatcctggaacatgccaccaaactgagccaccagcagcactgtagcaggacccacagtcaagttggtgcctgccaatgagatgcaacccagacaaacgcatttcagtgagcctagaatgttgtttcaatgagccaccctttaaaaaccaaacaacttcgctaaaatacccagattcttttgcaatatcagtgtcttcgtcaccatataattttggctctgtttcctcctggcatttatcagctggaggggaaaacctgagaccaccccaggtgaccaccctcttcctcattcatctgtgctgtcacctgcctgctcctgtaggtatgtctgcttttagccttgatgtgtacaagaagctgacagaagggcctcgggtcttaatcacagacttagggaaatcataaggaaaagaggcatgaaggtgctaaaaaaatcttaaagacaacagtttgagaactcccaggagtcaatatccctatttccctgacccactgtgcccaaccctcattattcaactggcaaacttcaccaacaaaccaaaacaaaagaaaaaattgtcatatttttgtttctatcattttttcctttagagcccacctagtcctatgtggcaataaatagacactactctaaatctcatctggccaactgagtttcaaaacctaatccagagagcctggaaagaaaatgcattgaaaagaaaaaaaaaagaaagaaaaagaaaatatgttgaatattgatgttataatttacatgtgagatttttctctttatgaatcatttttctgttcaggcaaagtggtctgttttccgattttgacattatgttatatgtatctgtgctaaaataagctgcaaatacttcaactagcagttgtcattctgtcagtctttttagaatccttaagttggcaaggtattgattagtgcctggatgcctccacacctaaattatatactgcagtgggaaactgctgtctcttagaattattcctttttttaaaggattattctttgtaacttcaaaaactctgatagcaacccattctttttttaatgtactccaaaaattggctaggaaggaaagaaaaaaaaatagtatcatcttaaaagtatgtatctaacctactgattgggagtacatattttcacaagttgcactgtgcagtcttgtgttagagcatgcagatcataggaataaagagaaactgtcatgggcattgcttcctagttaactagcaacatttaagttctgaatttttgatacttgcatttttatttactagtaagaagtctgttcttttaaaaagaggtataaattgagcactaagaaatatagaggcaaatgtgttttacctcaaagttaagaacaatttcatttaatgttgtagaaataggttacacttatgaatattttcatgatttcctgcgtagttggtagcaaagccaaagctctggttatgcataaggaattgaaagtcacacttcattccagtgcacctatgctttccccatcaaagatgtcttaccagtgtcaccactctatccagtctcaggtttggttggtggctatttctaacagttgggctcaccctgcagacatttgcagtattgtgagaagggcaaaaatgtcagagaaaaagccactggtcatttacacgtagagggaaaattggcaaaggctccctaaatgatgagtccaacattctagatctcagaggctaatccatcagatctaacagtcttgtgccctcttcttcctgccattacagtgtcataaacctagaacaggggtggaaacactctaaccagaagcccttccccacaaattgcttaccactaaggtttacagacatgcaagtagagccatcccagtggttagagatctttctttagatttgtctaaaatatcagaaaatggaaatgcagaaaccttacatggtatatccgagcgtgttagtaggacttcagttgaacacaggtctctagggtctaagcctcttgtcttttccactgtaccactcctgcatcatagcctccaaaaacatacaaggttggttggttggtttttttcctaacatgagttctggtcctgtgtttgagaccttttttttttttttgctgcttaataactaaaatatttctagcaggcaaagttgtgggcttatgttttggtttttgggttttggttttttgggtttttttgagagagtctcgcgctgtggcccaggctggagtgcagtggtgccatctcagctcactgtaagctccgcctccagggtacaagtgattcccctgccacagcctcctgagtagctgggattacaggcacccgccaccactcctggctagttattgtatttttagtagaggcggagtttcaccatgttggccaggctggtctcgaactcctgaccttaagtgatccaccctgctcagcctcccaaagtgcagggattacaggtgtgagccaccgcacccagccaatgggcttacgttaatgtctacctatagtatttgttctaccagctattggtgaattttgcttattaaaaacagcattgcaaaggcaacttttctatcataatattagtcctacttcaaaccaccaataataatcgaatacaatagcagctaattattggaccttattaagggccatgttaagccctttatacatatcaagtgatttaattctcacagcaattctgtaaagttattatatttacggtctccatcttacacatgaggaaattgatgcttagcaacatgaggtaactttctcaagaccacatggctaaaaagtggaggcatgacttccagctacagcactgatatagaatatacagtttcagatgataagttttagatgatgcttttaatggaaatttggtgacatccatacaagttctcgtcttcatctttttgccttttctttttccatgggattttgagtgaggattttcatcttcaaagatgttagagacagaatgttcaaacactttaaaaatttaacattaatttaaatttataagaaacctaaaatagctatttcctcaagttgttatttccaactctccaggtggactccaaatcactacgtaatcatcgagaaaagacttttattagatatgttcctgctgggtttagaaaatcctatatcttctgttgatacagcaaggtcagcaggaatctttaatatttacaaaatgaaaggagaacagctagttgcaaaaacttcctagtgattccattcccctaaccctaatctcaagggaaagacagcacaactgtgttacctgctgtgaactttgcagctacctgccatacctagacaccagtctagggctacacagcccctcgtaggatgatgcactcgttgatgctaaacattgaagacgacctctccagactctttgttcttttatggttttttgttttttgttttttttttgagacagagtctctgtcacccaggctggagtacagtggcgtgatctcagttcactgcaacctctacctcccgggttcaagcaattcccctacctcagcctcccgagtagctgggactacaggtgcgtgccaccacgcccggctaatttttttttagtagagacggggtttggggtttcaacgtgttagccaggatggtctcgatctcctgacctcttgatctgcccgcctcagcctccaaaagtgctgggattacaggcatgagccaccacgcccagcctgttcttttatgtttcttaatctgctgactcctgccttgcaaacagaccttcctacccccaccacctcagatggtggtgggtaaagatgctcatgcgtcttgctaaatcatcccttaggacattagctctcaaactgccacttctagtgatctaacattgggcaagttacttgctcgtcatgtgcctcagtttcctcatttgtaaagtgtgaattactatactactgcccccagagttgttataaagattaaatgaaataacaattagaaagcatttataccttgtggcacatagtaagccccataaaacatttgttgaaataaaataaccaagtgatttgagacactaataccttgcagctgccgcataagtctcactgtaaagggcatgatgtttttgacaaaaagccatcatggagtgctttgttagagtcctttcaggaaatggaaaacacacttggaatttcaaagggaattggttacagaatgtggggaggctggaagactgaagggggaaattccagaaactcaggtaaataactgcaggaggcagctcccaccatgagctctgccacgatacctgctgccgccttggagaagggacagtggcggaggatgctacctgaagagctgggatagtgcaagaacatagccacctccagagacactgccctgaaatggaagaaagataaatgagagcagaaagccagcagcttctgtcctcctgccaccttctcatccaactcctgcaatgccttgactgacaggacctagtcaagaggcctatgggatatcgtttgcaactctgggccccagcattgcaaagtagagttgagataggataaaaacaaccacaacacatggagcaaaagctagatagacacaggatcttttttaaaagagagagagaggaaagggtcaaagctttacaaaggtagtgtgagtgcaagaacaggaatcaatttaggcttttatagaagtaatcatggaaccaatttattctcatgccattgtaatagtactatgtaaagtagccataaattttttaatgatctgtgcaattagagactccagtatttaccaataagtctgtctgacaatcagtaatgcattccctggtactgtgctggttgtaaatactcatagaaatgtcttagctaattctagacacatgggatagatctttagtttgagaattcctcaaagaggcttgtaagcttgaggaacccaagtgagtctccctctgataaggcaggtgacacagtttgggagcagatagccatcacccatgcccttacaaaacacttctgctttattaccaatacatcatttgtgaacccaccacccctgcaacatcttatctgaatctttcttagtctggagcaaacacagaatgaggggaaaatgtggtcacattctttcattcttagtaaagaaaggatttagtcaccttttcccaagtgtcaagaaatgaagtcatcaagcaaatgataccacatgtttagagaagcaaaaaccttccttattcttcagtctcttgaaagaaggatattccattttaaaaatcaaaaccattatagcattaccagtgaacctgagtggtgtcacatctctctccagttgtggctgaggcacatgctgaaaaagttggaacctggctgcgagtgatggctcatgcctctaatcccagcactgtgggaggtgaggcaggaagatctcttgagcccaggagttcgagaccaacctgggcagcttagcaagacctcatttctacaacaacaacagcaacaacaacaaaaaacacatctgagcatggtggcacgtgcctgtagtcccagctacttgggaggctaagatgggaggattgcttgaatccaggagttccaggtttcagtgagctgtgatcatgccactgcactccagcctgggcaacagaggcgagaccttgcctcaaaaaaaaaaaggaacctgcagaagttttataatatgcctgttagtttagtttttcctccccacccccagaaaaaaaaaaaatagaagaaaaaacatggatttacatcacattagtctgcacctggattttgccagatgtcttttttcctttttgacaaattatagaattacttctgaagtgattagcttttcaaatgatccctcatatatttctgccagggcaggaaattgaagtgaatttttcagatatctgacattatatgaagaataatttaggattcagcattaattcaaagaacattcacattttttgaggaattcatgtgagataatatttctgggtactttttgtgtgttactaagatttttaaatcgatttagtttatggataaatcatattgccaaaaaaagtgggaaaactgttggccaatttttgaatattttaactgacaaaaaaaaaaagacttctttatccattctttgcctcttaattctggaactaaaacactacatctttatttcccttgacttaaaacactagtgctatgtctctggaagaatggtttgctggtagtggatgtacctttgtagacactcttcaattctctgccctccttcgtggagcctctagagaaatgcttctcagtgtgactagctcctacatcagggtacctacctctagaaatggagccctgaagtctgcattttggcaagctccttaagaaattcttacccacactaggatataaaagttctttggaaataaactcttctcccctctctgttctttctgagtagtgaaacagcacctgtctgtggttcagctgagacacagctggactctctgaagaaattaagagggcataacatgtaatgccagaaatataaaaccatagcaaagtggatatgttttcagattctagtaaggagaacaggacctcagttcctttctcatacttcagacatgcctggacaggccctaagcaaaagtgactttttgccttaaaggtgttaaaagaaaaagttcagctgaattaaattgaaaggagtttacttgagcagtgaacaatatgtgaatcgggcagcccccagaatcatatagcagattcagagagactccagcgccgacacgtggtggaagaagatttatggacggcaaaaggaaagtggcgtgcagaaaaccgaagtgaggcacagaaactactggcttggtcagagctcggcgtttgccttatttgaacacggtccgaacagttggctacatctgattggccaagactcagtggttggcacaaatgtaaactatggttggtttacacttccgcttgttgtatagttatcgatgtacagaaaaacctttaggccaaacttaaatatgtaaggaggcagctttaggctaaacttcatttaacaaaggtattttaggttagcaacacctctgggaaatgcttcagccagccccaaacctgcttcccagtgtggttcctctgacctgaagccaacatacatttctgcccagcagctattcgtgacctccctgagtctacagagatccttggttctgtagtcaagcagggtaattctctttcagattccttggcctccactgactccccctctttgcttaaaggtcagtttggtccttctgagccttgagagtccccctctccaccctgaccatttcactctgctgtttgctttgtccacgtgacagttgcactcttgggtgaagctggccttatgcaaatttcgtctcaccctagagagcccctggccagcagcctcacacagggcagcacccttcccaggagcttgtccatacccattcagctgccttccctgccatggcctctcttcgagacgtttccctttggcccaaccactgtatttccatttgccttctgagcctagctcttgtgttgtgtacaaagtagtgttccctgtgtgggcctgggatctgtaacaggtgaacttccaggttcatgttaccagttctggccatgtctcctccacccagaggtcctctagctggggggtctgcaagaatcccaagattcatttttgtttctctgatatgcttcaaacatacaggaagagtaacaaacaatttcttccaaggcaagtagaaagttggtcccgacatcctctgtttaatccttctgttacctgtggagtcatcaccacagtagtgagccttatctcctgtaatttaaatgacttgttgatttgggagggaaggaatttcactggggaagtccactaacataaacctgctgctgaggactcattcacttcacagcaccaagctggcccagcctccccacagacagaccaaacgcctctaccacaacctgcctttgcatttagttcatgatagttatgggtgcaggagaattaggtaagtgtaaggagggaactaggagacaatgttaaactctccattcagaataatattaatctaaaatggaatcatttaataacctgttttcaaggataaagtaataaaggtgacatgtgtaatgaagtaatggagctcattatttttccagccagccctattaaaaattagtgtgtggaaggtcacaaataacttaaaaatgaccagatttgttttcaaaatgaaggatttggctataatgcaaatttcatcctgaaggctacatggggaaaaaaataatggtagagtttctctgtcttttctttcattgcttctcatcacactggaagaatggttcggactaagcactttgtctgggagaagattttttgtcttttatttatgtatgagtgcatttcagttggtgtcctcctaattccaaccaccctcacctgctgctttctgtgtggtcactgagttgtgacaggagagaggccaggtattcgaaggccaggtcaaagctcatttagggaaccggtcgagccttcgccttttccctgttcaccctcctgcctttccaacctaagtggtaaaactcatcctgaaagaatcacggagctttggagatgagagggaactttggccatcatgtcatccagcccttttatttattaaaaaaggtattgattgattttaaaatttataaattatttttgtaacaaaactctatgcccagagtttaacaaatagtcgtgtaacatgtgttaagaaaaagagcaagccgtagtccacctccccctacgtcttcatgtgcaatcaccttcaactctttgagctgattcctttggcaattactttggtttttctaaataacatgcttatattgttattgcttgatctattgggtgtaggcattagctaataactgcccactatagaagacgaagatttagctgtcttttctccacccgacacataccacgtatgtgtactgttcccaccccctcctcctacacccttccagtttccctgtatagttacatcttgactgtagtccgatcgatattgagtgttttattatggcctttgtgaatagtgtcatatactatgtttcagtttcctttcctgtgtgactttttgtttttattgtaataaatgactgccttgttcttcggtttgcttagttttctgtgtatttttccttaatagaaccctaagctttccaccagtgtcttcatttcttctcaaaccatttaagtgcatgaggttctgttccttttattgtcttgcagaagtttccgccagacacttctgaccagcctggactgaactggttgccctctaggacctgatgtacaaatgttactttggggcctctctgctccatcattctggggattctagtaacctcttgtctgtatcagttccgttgtttgtcatctcctacatcttcctctttgcttcttcctctttcttggtttactccctcattttggtggaacacattttccagaagaaaatcctccagtatgaaaaatattcattgcaggcaaaatatttgagatcttgcatgtcttaagtctttattctaaccctaacacttgattgatagattaactagtatagaattctagattgcaaatattttggattttttttttcaacatggtgaaggcttggctccattgtcttctagtttccaattaccattgagaaatccagtgctgttctgatttctgatcttctgtaaatggcttgctttctttgcctgcctgtctgcctgtctgcctgcctgcctgcctgccttccttccttccttcctttcttccttcctttctttctttcttcctattattattattattattgcagaaacctgtaaactctttgattttctctcagagtctcagtatttcatgatgctaggccttggtgcaggtctattttcagccagcatgctaagcactcaggggaccttttcaacctgcaaactcatgttttgagtttggggaaattttctaaactattttcttatttcctcctctctattttctttttcctttttgtaattccttttatgcatacagaatatcctggatttgtcttccaattttctctacttttctgtcttcagtcccatctatttatgtttctgtcctagtttctgagagatttcctcaacttcatctcctaatccttccactgagtttttaatttccattaccatgttttataagaattctttttttgttcgctgagattttattttttagcaatctttccttttttcatgattgtaatttctcttttttcctgaagatattaggattatgttttttgttttgccctgaattttgtttcttctccctttttagtctcggttttcatccaggctgcctttttctctttgtagtctacatgttctatactggaggttttcctcagatttttggaaatcttcatttgtctgctcaactaaggcttgagtgggagactagaaaactgattagaggccaggtgtggtggttcacacctataatcccagcatatttggaggccgaggtaggaggactgttggagcccaggagttcgagaccagcctgggcaatactagtgagaccccatccctacaaaaaaaattaaaattagccaagtgcagtgacacacctgtagtcccagctactcagaggctcagatggcttgagcctgggtggttgaggctgcagtgagctgttattgcaccattgtactccagcctgggcaacagagcaagactctgtcttaaaaaaaaaaaaaaaaaaaaaaaatccctgactggaaacttaagcacttgagcagagcttgttgaccagcaagctattgagctggtcagactccctataggagatgcttccagtttcttgcttggaggagaaaggcctggctgtcagccttctgggacatctggcaggaacaggtgtcttagcatctagtatatacatatttacttcctctctttcttttacctcaattgcttctggtgtccctgggtccacacatcctgttctgtgttttccgcagggagaaaaaaaataaaatcctccagtcttctgttggaatggggagaggtttttgcctggctatatatttctttgcttttcccagtggtagctcaggattttcctctcaagtttgctaaattgattactacctgttcatatgcctttcagactcctaaattttgtctctcttagcttcttccaatcttctcccctctttataggtttatgtccttttttaaccctttattgtagtgtagagggttgagcgtgtctgcaaaattagatgagatgtgtttcatctgcctctgtttcttcgtctacagattaagagaggcccagagaactgctcagcgaagattctaaggtttgcagcataacttaatagcaaaagtggagctaagacctacaattcctgactccttgttcagggcagcctctttcaaaatagacaaaatcattaataatgagttaatccaaaatcagtatgtttctgattgtgtgtggacaagttgaaaaggctatttttcaaagagttctttgtatcttagctttgattggtatctcatcatgagacagtaaatcaggaaatgaggacttcccaatgccaacatgccccatagacaagccccacatgagagaggactagcgaaaaatgttgatacgacagcagtggctgtgctgttatactgctccaagtaactggagttgcaccagatctcctctacatgtgggaacaaacagggttgcagtcaaatacccaaatttcactggctcttgccccatctgctggggggcaggtccatggtcaagtgctgtccaagtagatctgtaagtccccagaggtgtctccttggtgctcacaaacaagtccaaacaagatgctagaaaggatggaaaagatggaaaatcattgcccttgagagactataatatttgtataaatagtcacaatagaaagcaaatggtattcaatgaaaaatctacacaaagtgagttaggcagacagagttaggaaaaatgacttgcctggagctgtgtatgatgcctgcagtaaaggaagagtgctacagggtgaaaactgcacatccctgatcatattgctcattgtccttggcataagtgctcagaaaatgtttcataattatccacatgcaacatttgagatgcccatgcttgactgaaccaagaaggcattccaaaagtgacaatgttgcttcataaagggtttaatttcaggaagatgtacattgatcacttttatttgtgtttgtaacaataattagtacatctgacttttcaagtgcaaacagatgtgttgaactcatcagcccaggcactgtgagagagagcagagctccccagtttgctcttgtcatttgtcccgtgtgtcattctgtggttaagacagatttaaaattcatttcctggcctcccgtgacatagaaacagttcttaataaacaagggactcccacataaagccctctcagtgcgatctctggaaaagtggggaactggatatttttgtttaagaatacacagctctcagatgtaaccagagcatggcacttctttgccaaaacaggaaggtgggtcacctgagagctggcctcgggttaaaataattacatgagttctggggagtggtgagagcttcatatttttatagcacttttatagtaatatttatgtagtattttactgtatccatatggaagatattttgtatccaatgagttatgactaccattaattcatgcacattctttttacatttttgtttataataatcctaagaactatgtctttgatgtgtactgtatgcaatgtagtcagccaagagctttacagatattattttatttaatgcacccatcaaccctctacggtaagcaccagtggagctgacaaaagggacttgcttagaaacattaatgtcaggctcatagaaaaatcaattattgccaaggtcattgtgtacccaaacctaagaccatataaaaaacataataacttgacccataagatgaacttctagataaaatgaaacttttttccctaaaatctataattcttcaaccattatgaatgtactctcaaatgcatcgtttgaaacattcctataggccgggcaaggtggctcatgcctgtaatcccagcattttggaaggctgaggcaggaggatcacttgagcccaggagttcaagaccagtctagtcaacatgggaaaaccccatctctagaaaaatacaaaaattggctgggcatgatggcaagtgcctgtattcccagctactcaggaagctgaggcaggagaatcacttgaaccccggaggcagaggttgcatcagccaaaatcgtgccactgcactccagcctgggcgactgaggagactctgtctcagaaaaaaaaagaaagaaaaatttctatgtttggatctcatgaaatgtgcctgtagttaatcaggaagtggccccattactgacaagaaagaacacgagttaaatagcaaatagttctgtcagtagaatcatatgatgtgatttgggctaagatcagtattttttgcatattcatatgttgctagagaatgtatgatatcttataaatctcatcactttccattgacaagcagcattgagtccaagttttacttagaagtgcattcagccaagtaacaggtaagtatagcttaaactagaacttttcaacgtgtatggtgaggcccattgatgagccacaaagagatgtgcagagagatatgtatcccctcaggcttcaaggtagggaggagtcctggggcagctgaagcccccagcatagttcacctcaggtgccagcagtctcctctgtgttccccagagggcagtacaaatattaccgcccactgtgattgtcatgacacaaaaaagatgaagaagcaatggcttgagatagaataaaggatatttgtcatttacttaaagtccaggtatatgcagtctagggtgggtacagctgcacagtgacactcttatgtatccaggttctttccatctttctgctctgccatgcttcactctggtttttgcttttcttgtttgtggcctcatagttacaagatggctgccatagcttcagacatcacgtcctctctccagggacttctgcaggaaggaaatagaaaaagaaaaaaaaaaaggtggggagggagaaattcctcattgcaaggctttttatgggggaggttgcccagttgtgcccccagcagcatcctctcagcagctcatggccagaagtggatcgcatgactctagctgcaaaggaggctgggaagaggcctacctcccctgagactacttcagaggagagaaagatatctttttttcacccatcactaggttcatgcctataacccttataaaagaagacatattaacaagagaaaggcatacaaatgcatttaatgttttatacgacagaggagctttcagaaatgaagacccaaaaaaacaggcaaacctgtgtagttttatgctagagttgatgaagaagtggaaagtaagattggctgaagggggtatgatctaatggtaaaagactggtgaaacttagcaaggcttctttgtttagattggtcaccatgtccctgtgtcttcagagataagtatatttccttcctccagttatagggagggcacctcttaagtggggtcttacagcctactacagaggcaggccagaggattcttttattgcctgcttcagggaagaagggtgagagaaggtcagagagtgaccttcctaggtttattacctgttttcttttcttttttttttttctctttagacaaggtctggctctgttgcccaggctggagtgcagtggtgcaatctcagctcactgcatcctctgcctcctggctcaagcgattctcccacctcagcctcctgagtagctgggactacaggcatgcaccaccatgcccggctaatttttgtgttttttgtagagactggatctcaccatgttgcccaggctggtcttgaactcatgagttcaagcgatccacccgccttggcctcccaaagtgctgggattacaggcacgagccatcacaactggccaaggagctgttttctcaaatgctaagttgccatataatgggtagaatatcctgaatcccatcactacagatctccacctactacctaaaatcaaaacctagggttctgttagcaaagacaggacactatggcttttgtacaggcaccagtgattgtgccaaacacagactgtaagggaaaagccagaatgattttttttaatgaaacatattttctgcttcttaagtaattgtttagactctttaaaataccacccaccagatcatttacccctcaaactaaaagcctgttctggaaatggatttgaaacagagcatcctacggacaagagagcggtttgtgcaaatcttagagaaatttttctcagtattcatttttattgagacatccaagcagcattcatgattttgtagctcttgagttataaactagatataattctttgctttttttctcctattcaatcgcatacttagacattaatatttttaattattttttaaattagatgggctctgtggaatgttgcatgagatgcctcaagaatcaggccacagtgttggaaagttatcataatgcaaacgtctcacaccacaaattttaaaaggttaattttttttggttcaagcagtattaactttggatatttagaaggatttttttcacatttcctcagaattggtgacagagaaaagtattttatggtattgcaaatattatatcagaaatgtatggcactgagaggagaaactaagtataatcgtcacctttgatcaatttataatttttagaaagttggttcatagtactcccaatattgacgtgtaggaaagaaagaataagaaagaaagaaaccaccatttccttgataacttgaaaaatcatagatttgaatgacagaaataattgtgaaccaagttccagtctataatgaggaataaactttttctgctttgtgaattcattttctgattatgaaaattatacaggaactttatgatagaggaaatttggaaaagacaatggttattcttaattccactaccttaatacaatcattaatgcctctgtaaaccccatcagacattttcagatgtgtgtcattcattatatgattgtaatcacagtgtgattgccattttacattatacatatttctatggaacaaaatactatattctcttcatatttcttttcatatttttctaggttttatttttatgaaagtcaaatagttcttccaggactattattaaaaccaccaaccccattccattccccacccctatttcctcctcaccaaaggcaaccacctttttcatctgatttttttagttatttctctcaacaaaatacttgagttgctatttccagtttttttgttctcactttggaagaggatgatatagctcccttttatcaccccaccttcacagtaacccttctcatcctctctattctccaagtagagttgcatcataattcctattagattgtaatttaccttatgtcataaacatattcgcaactgtgccctgttgtaaagtttcattatatttccttatacttttccccaaaatgatgttccattctgttttctttagttgtctacatatttattaataattgaatctcaaactctttaaaatgtctaattggttcagacgcgtcggatatttcagcagagttactcaactgaataatctctccccagagtcttctgaccttgtctagtctgctaagtttggtgcacagatgttatcctgggaacttctttcacctttgttctgggaattcactttgtctctaaagttggctccactgcttcatagtgtttatatttccctcttcttggtttagtcctttgtttctgcagagcacatcccccagtatctttttgagaaaaggactcatgggaagttaattttttgagatcttgcaagtctgaaaatgtctttatgctaacgtcactcataagaaatagtttagcaaagtatagaattttatttcagaagtggttttcaaaggcattattccattgtcttcaggctccctaagttgctgttcagaagttcagatttatccgtttcctgatcatctgcatgttatctattttctccccatctctgaaagtttaaagatgtctttttcttaattgtcttggagttggtcttattttcatctgtagtaaagcattgtattcagtggaccttttcaatctgcatactcaagtctttcaggtctagaaaattttcttttttcctttttggtctttttttcttaggtctaggaaattttcttgatgatttcattgcctctgttttttcttttctctgtgtatctcctcatttgaaaattgaagccgctagactagtcttctacgtttctgttgttttttctctgtctcccatctgtttgtctttttactctattttttgtgggatttcctcaaattttcatacagccctctaattcaatcaattctactgttacgtttttactttccaggacctcttcttgtcctgataatttcttcctttagtatcccgttcttttatttcatagttgctgtaacttatctgaggatgtaaataatagttggggtctaagggttttttggcattttctaatccctgcataatcttaggttattctagttagcttttttcgatattttcgatctcttttacaatagtagcttctctcagatttctcataatcgttggttgtctgttcgtacttaaaagcgtgtcaccggccgggcgcggtggctcacgcctgtaatcccagcactttgggaggccgaggcgggtggatcatgaggtcaggagatcgagaccatcctggctaacaaggtgaaaccccgtctctactaaaaatacaaaatattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaagcgtgtcaccacaaatctatcaagacagaaagtaagttagcagttacctagtgctggggattttggggaaatggagtaactattaatgagcacaattttcttctcgaggtgatgaaaatattctaaaattggttatggtgatagttgcacaactctgaatataccaaaagccattgaataatatactttaaagcaactaattatatggtatacatatgatatatcaataaaactatttcaaacaagaagtggggcactaacaaaatgattaaaagttcaaagtgcgtggctggggcttgtcatctgtgggtttcactgtagggcgatttggctgggctgtgtagttggggaaacctggtatttgtctttcttcttgggttgattagatccccagaaaaggctctaccaatctttccagcctggatgataaaggctggctgtcagcttgatggaagccgagttggggaagagaccgtctctgaatctggcaggctagtaccctccttatctccttattttcagttggtcccttatccttgtgctgtgactaatgatccccaatctagagaccttctgttccacccactccggagaataaacctccattcttaaaatagggttgagaaaaggcagttgcatgttggtagaagttttgggagatgatttacctgctgcttaaccagactttcaaccacagatacttaacttagctgcctcctcttaccccgacacatgctatttcatggattcccaatgcttctaattcttcagccttttgagagttttgtgaatcaagtgtgttctaggcttttccctcatttttatgagtttttagaaaagaagcaaagtgggaagcatgtgttcacaccatttttacctgaacagaaatacatattttgctctctccaattattcaaggtcattacagtatgaactatcaagatcatttttttaatttaaaatactgatttgggaaaaaaaagacattaaataaacatttccttgtacacagaatactcctgttttgtgtaaaatcaaaagatttgagcacatttatcccctaactaaaggcagaaatgttatttttcatatgcaagtagaaaaatcaatcctctctgaattcagagaactggttaaatgcattcaaaatcataagacttatgattagctgttttaagatgaataggtaaagtaagcttctggccaagtcatgaagcatttctttccctttgcaaatgatttaaagtcctcaaattctgactgcctcataaagaacagatagattttattgttgttacttgctgtagaaaaattagaggtttactaattgctttacctactcttctcacatggttctttgattttaagggagtcattcagtccatctagactgaatttggaactcagagaattaaaattatgggcagggggacagtggccaagcttactattctttatgatacttgatcttgcagctgacttaattcctgttttcatttctggtccctagagctgcaccgatattcatttcatatttcttaaaggtttatcaggtaaataagagagagaaccattcatagttaacagcacaattgtcatatatattgacaacttcaaggcaattctaaattgtctccttctctaatgaaaacatttcaatatgacaaaaaccttgatccaaattctgcttgttaattaccatgatttctaagatctccagtctctaaaaccttatgattctgtttctttctcaacttaaaatgccacccttcttttacttttgaaaagaacctttatctcattgcatcgatgaaagaaacttatatttgatttagattattactcataataacttgacctttccaaagcatcacagccattcagaacaagctacatttgcagcatctcaaataaaattgtgaggactaatgtgcaaaaattattaacaggttcaagatggcaacatcagagcattaaactaagcaagcagtcctgtgtgtggctcacacctgtaatcccagcactttgcgaggccgaggcagactgatctcttgagtccggaagttcaagaccagcctgggcaatatggtgaaaccccatctctactaaaaatacaaacattagctgggcgtggtggtgcatgcctgtaaccccagctactcgagaggctgaggcaggagaatcacttgaacccaggaggtggaggttgcagtgagctgagattatgccattgcactccatcctgggtgacagagcaagactctgtctcagaaaaaaaaaaaacaaaacctaagaaaggaaccattctaagcccaggaatccatgcagttgcataggtcacatgaccctgtagtcagccctgaaattatctgtagaaggaagacacgtttgatgtccctgccaatgataatttgctttggttcagctgttacggtgactaacacttccccagatcagggacctttacaatggtagtgggggcattcattatacagtcattgcctgaaattccacatttcaggtatatcctgagttaaatcacacagctattacactttagacaatagatccttcaaccgtgggtggtcagtattgggtggtggtgacttcaggtgctttcttcctgctctgacagtagctttcaatgggtcaaattcttcaagccaaattaaatgaaagcttgagttctgatccacagagaaaaagaacttgaataaatatatatctcctatttctaagctcccgacgttttgtaaagctacttaattttcccccatctcacttgtttttcagctcaatccatctgagcacctgttattcatatcagaaggaaatgaaatcaatagcattttcttccccagtggcagtctttaaacttccttctcttttgccagtaagtcatcattcttctttaagactgctgttgtatccaggcatgtccaagatttccttatttgttttgaactttgaacctgatagacacttagaaattcacgtggttccaccctcacccatagagcatgttatactatcacagtggactgaaatgtttcttaagggtttataaaaggatgattatgatgccattaagagaagtaaaggcccctaagggaagtaaagagctaatatttattcatcatgagtaaacatccgatcttagctatctcagaacaggacatgtattaatacattgaactttgaataaattggcatctcacttctgtggttgccttgctgtgaagggtactctcctgggtctgccacaaaataagcagaatccgacccaggctgacctgactccccatatagcccaggaagctgatgagcctggcatgtcagctcaggctgagaattcttctccccaagaaagcagaatcaaaacccatgcatggaagttacaaagaaaggattgttctatataaggaagagtttaataatgtggttaaagaagaaataggctaccctgaaaatgctaagcctctcactgtagctgagcagccatctgggaagactaccgtagaggggagagaaatagcacagagctttttaaactagaatgcctgtaggtttccttgtaaacgctgcaattctggaattctcttagctcccaagaggaggttgattgatcacaataaatacagagcctgatagacggaaaaataagcctgttatatgtgtacaaaccttctctccctttccttatgagcaaagtgaaaccagacctgcaggcatgtggccttatgtaggcctgagccttaagctgccaccatttggcaggatgtgcatcctttgaggaaattgtaaggttatatggccatggttttcagcttggacaggtaacctagcatagaagctttcgaattagaatgccactctgctgttgaccagctacactactttacctccctgcaccttaatcacctcatctacaaataatatcgacttcacaagattattgtgaggatgagataagaaaatatatatgactatctagtacaatgaatagaatatatataagatacatattctatgactcaattagttctgtgatttaatttgaaagtctaaggtgaagatgggggcagagggtgtccctggaaaggctaacgttctaatagagtttaactcaccattgccacttctgatggatagtctagttctgcaagaccaagcctttctgcctgaactctagtacctcaatcacaggctgggaatgacttaaggaaacgaagccagttccaaacgctaacacacagctgtcatacagattttgtcccacaaatgaacaatgatataaatgtagtcaatcttaaacttctgaattaactgtaaagtgatacaagagctttgtgtttaaggatgagaaggttcagcctagttcttcagtggttccatacttaaaccatccaaaaatacaggtatgtatccttatctattgaaaagaagaaaaggcagcggggtgcagcggttcacacctgcaatcccagcgctttgggaggccaaggcaggtggatcacctgaggtcaggggttcgagaccagcctggccaacatgatgaaactccgtgtctactaaaaatacaaaaattcgccaggcatgatgcatacctggcacatacctgtaataccagctattcaggaggctgaagcaggagaatcgcttgaacccaggaggcggaagttgtagtgagctgagattgtgccactgcactccaacctgggtgacagagtgagactccatctcaaaaaaaaaaaaaaaaaaagctatttgtattcaaaaaacaaaacagtgggggtgtgtcagagggcacaggagctgactgaaagagctctcaatagctaaaattggaacaatttgagcaataaaataacacagttttgagttataacccaaagaataaatatccaagaggccatactaatattaatatatgattgaataaataaataaatggaggagaggagacaaaattcccatacagaagaattccaaatactgtatgtagctactccaccctgaaggaagtggaacacaacaccccatcccttaagtgttggccacacttagtggcttgcttccaaaaagtacagcatggaaagggaggtgggggtacctttgcagtagagaagcctggtaaacactacctcagccaggtaatcaaggtaaacattatcaatgataagtcatgttaatagtgcataaccttgacttaatatggtacttgacctctgtgatcttccttccaaaaacttacaaataccgtgtctaaccatgagaaaaacatcaagcaacccaaatcatgtgggacattctgcagtatacctgatgagtactcttcagaactgtcaaggtcatcaaaaacaagaagtctaaaaaaccatcacagtctatgagagcctaaggagatgtgacacctaaatgtcacatggtatccagagtgggactctggaacggaaaaaggcattaaggaaaatgaacaaaatctggatatagtatggaggttagttataaacaaaaaggcatgggtgcttcctctttcaaaatgacattacagaaacctgtaccacaatcatgcattatagtaacactttgttataatgtaaatgttgggggattgtgttctaaaactgtctcttgaggctttacttgaaatgatgggaaactcagtatacagctgtatgcagagaagatgaataagtaatctgtcaaatattaataccatgggtctttttgcagctgggtttaactatgattgatttattatgcagatcacattttcacctgccatagaatcccaatccatataaggttgaatatgtacaattttgaattttatagttcaaatgtcccagtttccagaatttggggttgggtaaaagttgtttttcatgcatatgtgccatttttggatacctgtggtagttgtttcaacctatgaatgaatcaagggcactgtgggaataaactacttccccacatattgtagctggacttttttgtggggacctttatgcaacctaataaatgatctctcataacagattgtagttccttgatgctccaactgaggagttttctagagcttccttccttgggtgagaatagtaggtgaaggtcattgctatagacaaacagaactccatcaggctgggtcctcaaatattttggcatatgtaacaactctgtggaaataataggtatcagatagagttctctgcttacaagcaagagaaactgaagtagcaaaggaaatcatgaggaagctaagaattagttcacataatctaaagaaaaacctcaactaccaagccaagggaagaatatgaaatacagcagctcagaggattcaaccattcattgagtaatatttatcgagcctctaccctctcccagacactgctacagggtgagaatccagcagttcagggaatctgtcacgccatgctttcatcaagcttgcttctagacaatctcagactcagggacagcatcttctagaagacattctcttcctctgggaagcctgagactcatggacatactggtgttattacttagctcctaccacttgacattcttcatcacactgcccaaggttcagatttctctgagagtatgatgagcctacattgatgagtcaaaggctcacccccatgggggtgaggtgctctgatgtgcattcccaacaggactacacagaataccagaaggattgctccccaaaaacccagtgagctgctcttaccaacagaagaaaggagtgctgagtgggcaaaaagttcactataatttgtattaatagtgtgaagaaagaaaagagaagactcagatctggctcagaattctgattaaagctatttatgttagtataaccttgggcatgcttccacaatttctctaaaagtccctttcctcatctatataaagtggaatcataatacccataccatagaatcgttttgatgtttaaatcaaggatcaaactagctatttaaggacctgttctggggccaggcatggtggctcacacctgtaatccccgcattttgggaggccgaggcaggtggatcacttgaggtcaggagttcgagaccaaccttgccaacatggcaaaaccctgtctctactaaaaatacaaaaattagccaggtgtggtggtgcatgcctgtaatcccagctactcgggaggctgaggcaggagaatcgtttcaatctggaggcagaggttgcagtgaaccgtaatcagcctgagtgagagagcaagactctgtctcaaaaaaaaaaaaaaaaacctgttctaataactgcttaataaaaattagttgtattttcacacagttgtgaaacatagtatctacagattattttccatgcatttctagcacatgatatttcaatacattctgctcttttttttatcttagcatgaaaatacttgtagggtggacagtgtgttaggatccttgtttatatatatatatatattttttttttttgcatgtgttgactataaagttttgcttagtaaatgtcacatcagccacttcaaaagaggcatcctatctcagctcccagttatgtctcatgaaagactttaagagtgaaatctccaagcactgaacctctccaagattctctactggatttcactctgcctgtcttgcctgtgtcatgctgggggttttatttgtagagggaggcattgtaagggaggttatatatttactatccagacaaacctgggttggaaacctgtgtctttgggcacagtgcgtagcttctgagggcctcatgtgcttcatgtgtgcaactgggatgttaatacctaccctgatgggttgttaaaactgtaaatgaggccgggcgcggtggctcatgcctgtaatcccagcactttgggaggccgaggagggcagatcacgaggccaggagatcgagaccatcctggctaacacagtgaaaccccgtctctactaaaaacacaaaaaattagccgggcatggtggcgggcacctgtagtcccggctactcgggaggctgaggcaggagaatggcgtgaacccaggagccggggcttgcagtgagccgagatcacgccactgcaccccagcctgggcaacagagcgagactccacctcaaaaaaaaaaaaaaaaaaaaactgtaaatgagataatgtatgtggcaggctcagagcctcaatcaagggaagctattactattattaggggtgctgattgtgtcatcatttgatcgcaggcacagtatgcttggaaatgtagaattttttattcaacagtactaggggaagaaaaaaaaacacagactcagatttttaaaacaagactttgccatttataagaaattgctagaaggcagaagaaaaatgctcaccagcccagagtctaggaccacccattttcttaataggtcaacattgtgagatatcttctgtacctgagcacatcctcccacccgaggcccttccgggaattgctttatgatctaccggaaagagagccctgttctcataagtaaacaaacttcagtggggaagactgataataaacattgaagaaaggtcaaatatacatttggaaacaaggggaatcagtgtttgttcagaagaacaaaagagaatgtgactttagaaaatccgtaaaagggtcttaatggctgttcaagtgagtaacattgaggacatatttgttgaatttctaattcataggacatgaaatttttttagttgtggaggttggattttttcattaaaaaaatagcccttacttaccccaacacccttactttagaaattggaaaaccagggtgcatagaagtgacattacttacttaacatcacacagataggtagtagcagaatcaagaccagaatctagttcctcaactctgaatccagtgacttttccattgacatgttcttaaatgttataaaggatgatggtaactttctaaaatcattgactgataaaatctaaaattgtttaaaggagcatgtgtttttccttaaattgcttctcactgaaactctgtgccatccagaattatagctagggttaattacatgttgtcaagaccaggcactacgccaagtcttttagatgcgtattcattgtgtacttgtaacaggattggcctaagctttgatgattaccactagggtttggttgttcctggcaattagtaggaaattgtcctacccaagcaatatgcatgcagtcatctgagataatctttcccacaatatgtggaaaagtgttggtaaggcagagtaggttgtgaataccaagatggatggaacttttgttcacccaactgtgaactttattccctcactatatatcgtattccatacacgatggtgtgtaccctttttcaggtttccatttttagaattgaagaaaatgggctgttgctttcaaaaatcatgttcatttaaattgtgtttttactctctgttaagaaatcacatataaacatatggatttgagcaccccctgcgatttttctggggtcccaccaggatctgtggctgcctaactgatatccacctctccagcatgttgccagcagccacagtgactccaatggaagcagcaacttcaaaatattatgctaaaattggctcctaatgttttcctcttgccttcatgcagtagcatgccagagcccacatcttcttgcttgctagagtcaaattttgcaagccagttgttaagaacagcgatttttattatttatgtatttatttattgatttatttattttattatactttaagttctgggatacgtatgcagaacgtgcaggtttgttacataggtatacatgtgccatggtggtttgctgcacccctcaacccgtcatctccattaggtaattctcctaatgatagagtgccccccactccccgacaggccccagtgtatgatgttcccttccctgtgcccatatgttctcattattcaattcccacttacgagtgagaacatgcagtgtttggttttctgttcttgtgttagtttgctgagaatgatggcttccagcttcatcaatgtccctgcaaaggacataaactcactcttttttgtggctacatagtattccatggtgtatatgtaccacattttctttatctagtctatcattgatgggcatttcggttggttccaattatttgctattgtgaatagtgctgcaataaacatacttgtgcgtgtgtctttatagtagaatcgtttataatccttatggtatatacccagtaatgggatttctgggtcaaatggtatttctagttctagatccttgaggaactgccacactctcttccacaatggttgaactagtttacagtcccaccagcagtgtaaaagcattcctatttctccacatcctctccagcatctgttgtttcctgacattttaatgatcgccattctaactggcgtgagatggtatctcattgtggttttgatttgcatttctctaatgacgtgatgatgagctttttttcatgtttgttggctgcataaatgtcttcttttgaaaagtgtctgttcatatcctttgcccactttttgatggggttgttttttcttgtaaatttgtttaagttccttgtagattctggatattagccctttgttagatggatagattgcaaaaattttcttccattctgtaggttgcctgttcactctgatgatagtttcttttgctatgcaggagctctttagtttaattagatctcatttgtcagttttggcttttgttgccattgcttttggtgttttagtcattaagtctttgcccatgtctatgtcctgaatggtaatgcctaggttttcttctagggtttttattgttttaggtcttatgtttaaatctttagtccatcttgagttaatttttgtataaggtgtaaggaaggggtccagtttcagttttctgcatatggctagccagttttcccaacaccatttattaaatagggaatcctttcttcattgcttgtttttgtcaggtttgtcaaagatcagatggttgtagatgtgtggtgttgtttctgaggcctctgttctgttccattggtgtatatatctgtttttgtaccagtaccatgaagaacagccatttgattgttaataatgggcgatcgaggcgggtggatcacctgaggtcaggagttcaagaccagcccggctaacgtggtaaaaccccgtctctacaaaaaatacaaaaattagctgggtgtggtggtgtgtgcctgtagtcccagttacttgggagcgtaaggcaggagaatcacttgaacctgggaggcagaggttgtagtgagctaagatcataccactacactccatcctgagcgacagagcaagcaagactttgtctgaaaaaataaaaatataagtataaaaactttatgtacatacatatgtgcacatgggtttttttcctaaatgctggttgttaagcctttacttgtacacaactccttctgagccagtcaagtctataacatgtgtttctttatataattatcttcaacaataatactaataactaaaatgtattgaacacaagggacagattttataacagtcagcctcactgaattctcccaaatgctccagggaccaggagacaatgaggagggtaaattcaggcacctccagcatgagcaaggacatctaataggtgccttccgaaggcaagcagatggtagacacttgcacatgttattatttacatcaaccctgttgtaaataacgagagtgatttttatcactgtgatagggataaagaacaagctcagaaagataaagtgactgcccaagcaagccccagctaagtaatgctggttagaaggggagaccacaaggcaagaactaaagccttccagtgcctgctcccgcaacagctcagacgtaatacaacaacctcatctgttgcagtgaactccagcctgggcgacagagcgagactccatctcaaaataataaaataaaataaaacaaacacattaacaagaaaaaaaaatctaaggagaggctgtagatatgtagatacatcaatgataaatattttgagagcatttttagtaatagccattaagaaattttatgtaaatacgatttagatatacctatgaaagatagacattatccaaaataactaaagcttaaatgggactctgaaaatggataatttagactttttaagaggaggtcaaaaacataggaaaagggtatatagtttcagtgacagcttgtaaacattaatatttgtatttacaaatggctaagcacattaatacataacaagaagtcaggtctataaacagtgtaaaattatggggagcgtatttgtggttcttaaccaagggcctaatcatttattagtttacatatatgtgctttctggaaggtaggatttattcagtgtgatgtggtaaatggttacatatctgacctaagggtggaattcagagctcctgaacaccagccaggccccagcctcctaagccagaatgctaacccctacagacagtctaaacactagcaccaagccaggaggcacaggcagggccttcagcagtgccctttgacccatatgttactcaacaatttttttcggggtgggggagacagggtctcacactgtcacccaagctggagcacagtggcctgatcttggctcactgcaaccttcacctcccgggctcaagcgatcctcccacctcagcttcccaagtagctggaactacaggcgtgtgccaccatgcctggctaattttttgtagaaatggggttccaccctgttgcccaggctggtttcaaactcctggactcaagaaatcctcccatctcggcctcccaaagtgctgggattacaggtgtgagtcaccacacccagccttcctcttcattcttgctaagatggatcattctggtcctcagtcattcttagaagcatactatgccatttctagactgcacatctcactgctttaccatttctctaagccagcatttcttaaagtataggctctagaatcacctgcttcagaaacaagttgtttaaaatgcagcttcctgttgtcaattctaatgcacattaaagcttgagaaccactatttaagcaattggagtgttactaatgtcagattctaacacgcctagccttgatccttaacttataggaagggtttgggtatataaaagaaccactgccagagattactaaagctgtaccatgatttagaaaccagaacaagtatgtctatccctaaactgcttacgttcctagtgactcaggacaggtgtcgacctgtatagcagagaccagtagcttctgtgacattttctgattagtcagatcagaacttgtaattcgtttggtgtcagcctagccacgaatgagagaactttcctgtcattctgcacctctttgaagctagcaaggacagaaagtcaattctgcttatgattttccaatagctctgaacagttataattacagtgtacatctgtgagagcgaagctgcttttctaatctgttttcatattattttttcagcagcttctgcagacctaatagtaatttgggttttgactgaaggataccacttacatgctgagggtgctcatttcaaccctgtgtgtttttagcacattgacatggtgacaacctgagtagagtctgaaagctaaggcacaaacactatctagcaattcctggtcactaataaaggtttaaaaaatgtttgttggattttactgaagaagggccttgctttttgttctgggtttttgtttgttaggttggctggttttgagacagttttgctgtgtcacccaggctggagtgcagtggcacgatcacagctcgctgcagcctcagccttgtgaactcaagcagccctcccaccccagcctcccaagtggctgggactataggtgtgtgccagcatgcccagctaatgtttatattttttgtagagacagggtttcgccattttccccaggctggtctcaaactcctggactcaaataatctacctgccttagcctcccaaagtgctgggattacaggcatgagccactgcacccagccacgtcttactttttaaagacagaaaatgtagtgtttagcaagaaatatgaattgtactttttttcagttgcctaaaatataaacttcctaaaagttaaggtgtttatttatgaatgcatgtcagtgagaagttcttttttcccaaggtggtgttatggagggaaagtcagtgagtcagcctatttgccgaggccagcttgtccttcaggcatttataccaccagtattagtttgctaagctgcccttacaaagtaccatgaactggatggcttaaacaacagaaatttgtctcaccgttctggaggccaggagtttgaaatccaggtatcagcagggttttccctctgaggttgtgaagaagaatctgttccatacctctctgctagcttctggtggtgtgctggccgtctttgacattccttggcttgtaaatctctgcctttatcttccatggagctttccttgtgtatttgtgtctctatgtccaaacttcccctttttataagaacaccagtcataccgaagtaggacacaccctattccactatgacctcatcttaactaattatgtctgcaacaaactcattcccaaatagggtcacattctgaggtactgggggctaggacttaaacatatgaattttagggagatgcaattcaacccataacaacatggctctgaataaagctttgtttttctgagtaatttttgtttgtttgaatctgacagcagcaagtatagagattgcagagtatctggcagcaaaccactatccatgggaattatgccattgaggtgtagtacagagaaataatagtgcttaggccaggaattgtttcctgttcactgtgtcttaaacctttattggttccattagcttacacagcaaaaggcatttccaattcagcatattttatttccagtatgccactctgatctcaaactttagttagagaagaccaactaaggctaagaatcaaaacttttggaagctagcaagacctgatcaaatccaaactcctgatttttacagagaagggaactgtggagtacaggaaaattcaatgtcttacccaaatacagtactcacagctacttagtgccacattgctaccacaaccccactaccctgcctcttgctgtagctccttctttcacatattgtactgctcctctgagccacaggggccatcggtgccctatgacagtggtccccaacccttttggcaccagggaccagttttgtggaagacaatttttccatggattggacggcagagtagggatggtttcagaatgaaactgttctgcctcagatcatcaggcattagattctcatgagaaacacaaaacctagatccctctcatgagcagttcacaatggagttcatgctcctttgagaatctaatgccaccactgattactgcctaaggcagagcttaggcagtaatgctcactcacccaccactcacctcctgctgtgcggcctggttcctagcgggccacagaccagtaacagtctatggcctgggggttggggacccctgccctatgattcaaaaggtcccaattcctgttgccttcatggtgcttttctctagctagagaacacagtcaaccctgttttcaatgtgtgctgtctacctgggaatgtttcatggatggcccatactgccattttttaaatctacctaagcctcacctctgggatctacctaaatatattctctcttaattccatggatatgagctctaggaagggaactaattataatgttagactctgccacatatgaacagtaaaacacattgtcctagagagcagaagccatccagtattgtgaagcttaatagaaattactttgatgggcctagcatggtggctcacggctgtaatcccagcactttgggaggccaaggcgagcagatcacctgaggttgggagttggagactagcctggccaacctggggaaatcccatctctactaaaaatataaaaaattagccaggtgtggtggtgcttgcctgtaatcccagctacctgggaggctgaggcacaaacatcgcttgaacccgggaggcagaggttgcagtgagctgagattgggctactgcactccagcctgggtgatagagcaagactttgtctcaaaaaaagaaagagaaattactttgatggtgaaggtttttattttggtttgctgttgttgttgtcttggatgttattttggtggcgtatttttttgcatttatatatttcataatcatataattattggcttcttttttttttttttttcgagacggagtctcgctctgttgtccaggctggggtacagtggcatggtctcggctcactggaacctttccttccccagttgaagcgattctcctgcctcagcctcccgagtagctgggattacaggtgtgtaccaccacacccagctaattttttgtatttttagtagagatgtggtttcaccccaggctggtctgaactcctgaccttgtgatccacccaccttggcctgccaaagtgctgggattacaggcgtgagccacccgcgcctggcctattggcttctttttaacatttattattaatatatatctcctcaacttttgggggtttttagggtttttccccagctttattgaggtatacttaacaaataaaaattatatatatttaaggtgatacattgtaaaatgattaccacatcaagccaattaacatatctatcacctcacgtggttatatcttttgtgtggtgagaacccttaagatcaactcttctagcaaatctcaagtacacaatacgtgattattaactatggtcaccacactgtgcctcagatctccagaacttcctcatctggcatacattttggccaacacctcctcacttcctcttctttccaccagtaactatcattctagtctctgcttttatgagttcagctttcttagattttacaaatgagttcatgcagtgtttggctttttgcgtctggcgtatttcatttagcataatgtcctccaggttcatccatgttattgcaaatggcagaatttccttcttttttaaggatgaatactcttcctttgtatatgtataccacatttgctttaaccattcatcagataaggcacacttaggttgttgccccaactttttgggaagctccctaagttggtgttctgaccatgtctgcttactttttggtttaagcccagcacttggaatgaagtaggcactcagtatacatttgaatggatgattggtagttttgtagggagaaaagcagatactgtttattatgctgacagttcattattaaagtaaaatttatatatagtaaaaatgcagaaatctttgtagttccataaattttgaaaaatatgtacccaagttaccatcacccagatcaagataaagaacattcccccatcccaccagcaagttcccttctgccccttcttagacgtgacccgaagggcttttctccttcgttttttcctggaagctttctacgtttaactttcacattttgtcggtgatccatctcaaattaatttctgtatatgatatgagtaggggtgtcgaaggtttctgttgttgtgctttaacaactattccttgttcctttgatgaaatcaaataatcaagacttgtatatagaaatagatttgtcattgggaaatggatctctgtatctctttttctcttttataattgaaccatggttgctggggataacttagaaacacaggaaagggctaattttctgcagtgattggatggctcaaggcaatatgtgtaggacaggttactccagtcagacctacgttcaaatccaaatgccaccagaggtgagacaagatagtcttaatactcaaatgtacaaaataaatagccagagacctcacctaacagggttctttttaatgagtaaatgaaataacatgtgtaatacagtcatcacagtataaacatcacagtcaacgatgcctgctagctttacacctgtgcttgtgtgtgtacatgttggggtatgatattggaaagaaaaacaaatctcatagcgatatacggtgaaaaaggtccctgaacttggatgagggttcctctttaaaaaggtttctccctccagccaccccatcacacacagagtcactcccctcaaagggagaggaggccctcttctcacctctgaggctgctcatggcaggagctcagtcactgccagttctctgagccattgtggcttctgtcctcacaatgaataaacctggaaacacactgtttgagtctcttcctgcctatgggttctaagtgctgctgtctgagctgtgcctgcagcaggcttcctgcttctggtgctcactgcggggaggggagccatcggttgataccaggagagagcctgctgctctgctgccttcattagaaacaggcagtctccttgtctaaaaatagcaaaagtgggagagtggggaagagcagcagccatgctcagggctgaaagtgagaaaggcagaaacaagcagatctctgaaagcctcctgtatggtggcaggcggctaagcattctgggtgcagtgactgtggtcaaagcttttctacttccctgggtccgtgttggggggttttgtagatgtgtccacacactcagccaagggctgagcatgaaggagccgctctgtcctggcaggagcatgagatgtgccacacgctgatactgtccaggctgcagcaggagcgctagtgctagtgcttgagaatttccacaccctgtagtatcctcacccactccctgccccaaccaaaggtgagctttttcccagtggggcacaaggtgttggtttgaccatcacttcagaagcgcctgggtcacgctggaatgggcttgcccttaagcagagtgtggctctggtactaaacaagtctttgcagccattaagtgagaccaggctgtatttgtgggtgttctctgcaggtagagctttcctgtctacatttgttatcagttaatgttctggtagctaaactaagagcagaaaaggaattctttccaaggtcttacgataaatctgtctatgcaagcagacctcatcaaagccccatgaaaacaggcagagtctcagaggtaagagtcctgttgatactcctgtttgcttatcccaaagagctttaccctctcttggcctttctttctcttgtactatccaaactgatcctcttgctggccttgtgagatgggctgggcatctttcccacccacagatgaggaaccaggagctcagtgtcataacttgcccagcattgtaaccagtaatcagagacgcagagcttgtatcaaggcctctgcccttcgcctggatattctctgaggtttcttccccacatgacagtttctgaagggcaaaaacctcctaacatgaagcagcctaaaatgtggcatgaatttaagcaaacttagggggcaaaaaaaagactccatttaactttgatttgggaaacatttttctttgcatgacccagcaattatgactctgaacccagagagggaaatataaccctaactcactgttggccaggcagtatacaatatttatatagtcacaatactataaactctatgtgtcaattttctaattttagagccaatctgtggacaaagagggagcaattttgttatagctgcaagataggatataaatatgaacagccctgacaaagtagagataaaagttgttcggtgttttttaagtgtgtctaatataaagtgagaggggaaagcagggacaaagatgaaataatgtggggagttaaaggatacggtgtgtggttgatggaataaaaaagctcactaggtatgttatttacagttacaaaataaaatataaatagcaaatgttggaagaagacacagggtagaagagggtaaatgtccctcatagtgaatcaatggatgctaccttaggttaagaatcttttaacccctgattcatcaaaagacatgaagggaatcgccagaaaatattaaaagagaaatcccaaaaagggctgctgcccctagggaatggcggagggtgggggtggggagggcaggaggttgttgcttttcatcagaagtcatctgtgttgtgtgctttattatgatgtttattacttcgattaaaacaaattgaggcagtgagagaatgacttttaaaagacaaaaactgtggatagtaccatatgttccctcaacaaatgctctcatgagaattagctataaaacactcattaggtctgcaaacagaaatcagagtgttccaggctataaaattatcaatgactgttttcagcagtccagccaggctaatgctctccaatgaagccaaactaatgttgctgataaccaaaagaatctttttttttttttctgtaaatgacagaggcctgtgtggcatcagggtgccattaacgttttctcctagagagacagccaggaagaaaaatcgctcctcctgtactgctctcacctgtgagaagtttatgacttgttcggagagcagagcacagagcccgggaagagtactggcagtttctgtgtttttacaagggaagaacatagctgagtagattaacagtttcctgtgtggcttgttgcaaattacatgcaattagccctcagacagcctgaatcgagagaattgtggcaaaacttgatggtgcagaacctaggcaggcagccagactcctaaacccagtcacgtaaatttgctgctgtaactggatcttcccaagccacaagtctgagaaatggtgggcactctgacctgaccactagattttcaggatattcctcctaagagaggtatccttgcttctaagtgacccctaaaacagaacctaggaaactctcagccagataaattagaaattgattctaaataggcttgtgcccaggaaatcaacaatgcagtaaaaatatcaggacaaaagcaagaatacttcccaaagtcagaaatgaggagcaatgaatattaaattgatcaatggcatagacatttaaatgaaaatcctttttttaaatgtatattactggccaggcacggtggctcacgcctgtaatcccagcactctgggaggctgaggtgggtggatcgcccaaggccaggagttcaagaccagcctggccaacatggtgaaaccccatctctactaaaaatacaaaaaaaaaagtagttgggcatggtggtgcgcacctgtagtcccagctacttgagaggctgaagcaggagaatcgcttaagcccgggaggtggaggttgcagtgagccaagattgcaccactgcactcaagcctgggtgacagcgagactccatctcaaaaaaaaaaaattatattacctttactgcttggggcatcttcaagagaagactttgctgtagactatggatgcatttatttgaattagatgacttattcttgcgttatctccttactcttttgataattacatttcattattttttaagccacaatggacatgcacatacatactcctgcatacagtttataggttcttgagcctaggtaagactttatgtcctatgtgaaacatttcttgattaggaaagttacacctttctcttcagtagtgcatataacctttactaatctctctttgctaaaaataatgtgacagtgttaaactgaaatatttttagtatctgttttggctgaggcccaaaacaaaagtaaatgtgagactatagcacttgcaaaggtcaaaactggtttttgaatggcagaaaatcagctctacagccctcagctgactacccacctccagcctttaaaagaggttattgaggccaagaaaagagtggcagttagaatgtgatctttagagagaactgttgatcagaggtgtctgtccccacccagggacacttgggagggcttgataagtgtcctgtggaggatgtggctcatgcctgagatcctatgatggcagagcaaggagagtttgctgtttggagttggcttctgctactcacttcctatcttttttctgtgtgtgtgttttttttttctccttagcacttttgaccaacataatacatattttaaatacttatctcattgtctgtcttctttaatactatgtaagttccatcaggcacagacttttaaaatttgatctctgtattctaggtgctagaatccattctaggtgcagtgtgcatacatggatactcaataactatttgcagctgggagcagtagtagctcatgcctgtaatggcagtgcattacaggcctgtgtggcttgttgcaaattgtgtgcaattagccctcagacagtctgaatcgagagaactgtggcaaaacttaatggtgcagcacatcggcaggcagccagactcttaaactcttggcctttgggatgataacttgagcccaggagtttgacaccagccttggcaatatagggagacctcatctctaccaaaaaaattttaaaaagaaacaccaggcatggtggcacatgcctttagtcccagctacttgggggctgaggcaggaggatcatttgagctcaggagtccaaggctgcagcaagccaagattgcaacactgcactccagcctggatgacagagcaataccctgtctctaaaaaatacaaattaaataactaaatatttgcatcctacattcattaccacaaatcactccaacaaccctactcgttctgtattattattctcattttacatatgggaaactggagctcttactcagaagggttaagaaacttacccagtatcacatacaactaagtccaagagccagaattgaaagtcagattcatctgattccaaagcttatgctctgcctgttaatgctttctcagctcaggtgcctgtttcctgaaaatgtattctcatccttttttgggtgctaggtagtatctaatctaagatttttaggcaagtaacatgccattctgtgctgtggtctcacttggtagatcctgcataatgaggataacaaatagaaagattaattaattggttatgtagcttacactcaataccaagacaataataatttcagattattcagaatacatttaatggtactttactgtataaatgcctgattattcatttagggctgtatattctcccaaattcttttatatgtataatttggtttaaatattaaattgttggaagcttaagtagcattattttcattgttcaatcttaatatccattgttttaaatatgttgttttagaaagcatattttgcttacttttcctcaaaactttctgttcattgttactcttcccaaaagaacaaagatctccacagctaacaccaaacatcatataccatatttgtttttgtgggtattctgtaattattttcaagctcctaggcacatttgcgtacactacttttgtttctgcaatgacaaatttctaaaatgttagcagcaatgactgtaaaaaagggtagttaattggaaaagagttcagatcctaactctgtttagggaccatgtaacccaggcaagccgctgcacctccctgggcctcatcctggaagtagagatgttgggcagacacatggggagggattgcgtgtatgagtgtaacaggctgggtgggatgctcgagtgaggtggggaccctgcagcaatgcagaggacatgctcggtctaaggaaggcagctgcaatctcactgctactcagaaatgtaggcttacagttggccactcttctcatgtctcaaaagaaactgggtttttgtgggaatttccttttcctcaatttggcaataattcaaactaaaatctcttcttctttttttttttttttgagacagagtctcactctgtcgcccaggctggagtgcaatggtgcgatctcggctcactgccacctccgtcttccggattcaagcaattctcctgcctcagcctcccaagtaactgggattacaggctcccaccaccacgcctggctaatttttgtatttttagtagagacaggattttgccatgttggccaggatggtcttgaactcctgacctcaggcgatccacctgcctcggcctcccaaagtgctgggattacaggcatgagccaccacacctggccaacagatctcttcttcaaaacagttcttccagccagactgggtttgtgggacagcagtgtgtaacctctgggcaggacatccccaggatggaggtgctctggcccatgcctgcactataccagcatgtgccctgggacattgcagatggctccccaggcctccacgggcctgcactcacagtctcttcaccagagagctcgaaatctcagaacccaactctctcatgtcatcaagccagagacatgagtctgcttttctgtctccttagatttgtctgttcttagacattttgcataaatgaaattatgtaatatgtggtcctctatgactggcgtctttcacttggcataatgttttcaaggtttcctcatgttgttgcatatatcagagctttattctttttattactgcataatattccattttatgaattatttgtccattcatcagttggtggacgtttgagttgtttccactttctggctactatgaataatgctactgcaaacattcatatacaagtttgtgtgtggacaagttttcatttttcttggatatgtatgtgggagtggaattggtgtatcatattgctttgaggacagaccaaacagttttctgaagtagctgtaccgttttatcaaatacattcccatcagcagtgtatgagggcttcagttgctctacctcctctccaacaagtttaatttttctgattttctatgataactatcccagtagttgtgaaagtggtatctcactatagttttgatttgcattttccttatgactaaggacattaagcatctttttatatgcttattgaccattcatgtcttctttggagaactctccagattctttgctcatttttaaatttggttatttgcctttttattgctaagttataagagttctttatataatctggatacatgtctcgatgagcctcatttttgtcacccaaatttaatgatattcaaaatattctacttactaagataggaaactattctgtttgaaaaacagtataaataacaacgttttaaaaaaaagaaagatgcccatttgattttatcaaattttgaccttatgatactactaagtaaatctgatatttcttttttctgtaatcatactatattttagctgaaataattgataaatatacctgtcaagtctcaaataatattctaattaatttttgtatgttaattttgtcttaaccatgccagtggcttactcatagcttccaaaaataaaaggtaactcttagattgaaaaatactttcaaagtgggtgggtttgcctctagggaggagaatgctggatcacaagagggcaggagaaagagaattactttctgctgtattttacacttatatgcatgtagcgtcatttaaaaaaaaataaattttggaggctgggcactgtggctcatgcctgtaattgcagcactttgggaggctgaggcgggtggatcacctgaggtcaggagttcaagaccagcctggccaatatggcaaaaccccgtctctactaaaatatgaaaattagctgggtggggtggcatacgcctgtaatctcatttactcaggaggctaagagaggagaatcacttgaacccaggaggcggaggttgcagtgaactgagatctcaccattgcactccagcctgggtgacaagagtgaaactctgtctcaaaataattaattaattaattaatgttggggccaggcgtggcggcttatgcctataatcccagcactttgggaggccgaggtgagcagatcatttgaggccagcagttcaagaccagcctggccaacagtgaaactctgtctctactaaaaatacaaaaattagcagggcgtggtggcaagtgcctataatccctgctactcgggagcctgaggcaggagaatcacttgaacctgggaggcggaggttgcagtgagccaagatcatgccattgcactctagcctgggcaacagagcgagactccatctcaaaataaataaataataaaacataaattttcagcaaaatttaaatgtggactattgtattagtccattttcacactgctgataaagacatacccgagactgggaagaaaaataggttttatggactcatagttccatgtggctggggaggcctcacaatcatggtggaaggctaaaggcacttcttacatggcagtggcgagggagaatgagagaggagcaaaagcagaaaccccttataaaacatcataactcatgagacttattcactaccatgagaacagcacgggggaaaccacctccatgatttaattatctcccaccaggtccttctcccaacacatgggaattatgagattacaattcaagatgagatttggatggggggacacagacccaaaccatatcaactatagattagatcatggtattatatcattttacatttcctgatttcgataattgtactgtattatataaaaggatgtccttgtttttaggaaattcacactgatgggcttatgggtaaaggaatgacttgtatgcaatttagtcttcccaaacagttcagggaaaaaatgcttatgggtatttataaataaataattacaaagcaaatatggtcaaatgataggaagggtatcctggacttttcagcattccttccctttttctgtgagtttaaagttatttcaaaattaaagtttaaaaaaaaatttaaaagaaagacacttccggaatattcttttatatataagagcttccagaatattcttttatatatttgatatatattaatatatttgatacacttaatattaggaaagaaataaaaatcataaataaaaactcaagaatggaaaaacttagttgtttttttggggttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagtgctgggattataggcgtgagccaccgcgcccagcctctttatgacttttgtaatcaggaaaaatacaagtgaaccttacttcttaagatctacacaatttgttgcgcatggtggctcatgcctgtagtcccagcattttgggaggccgaggtgggtgaatcacgaggtcaggagtttgagaccagcctggccaacatggtgaaaccccacctctactaaaaatacaaaaattagcgggacgtggtggcgggcgcctgtaatcccagctgctcgagaggctgaggcaggagaatcgcttgagcccaggaggcagagattgcagtgagcgaagaccgtgccattgcactccagcctggctgacagagcaagactccgtctcaaaaaaaaaaaaaaaaaaaaaaaaaatccacacaattcttttaacaagttttttttttaatattaaaaaggtcagggcttttaatatttcacatatcttcaattaataggtaaatatgtacaaagacaggattatgtgcagttcccaggttcccagacgcgggaaagacagagattataatgtcctcagtggcctcctgttcagcttggaggcttagacaggaacctcagaggatgcctttagatggggagttttcagaagaggtgagctctgatttaaacctggaaggggtcgcagaggaagaggagagatgaagcccaccttccccagccctgccctcagctctaccacccagggaagaccataggctgctgttggttccctccacatggccaatggccagccttctgccaactctcccaacaccaatatcacactcttctccattttctttttttttttcaaatattttgttccagcaaaaccttcccatggcaaatttccacaggttaaaaacataactttgattttaatggggaaaaattttgtatatccatgagcccctaaattaatacccaattttaacactataaaaatggagcaagctgggcacagtggctcacatctgtatttctggcactttgggaggccgtggtgggtagatcacctgaggtcaggagttcaagaccagcctggccaacatggtgaaaccccgtctctacgaaaaatacaaaaattagccaggcatggtggtgcacacctgtgatcccagctactcgggaggctgaggcaagagaatcactggaacccaggaggtggagattgcagtgagctgagatcacgccactgcactccacagcctgggcaagagagcaagactccgtctcaaaaaaaaaaacaagaggaccagttacttcaacagtttcaacagttaacactggttatatcacaacaaaacaatggtggcttctcttcagatgactctccaatatactgtctacctgcattcctttggcttttggtattgtcgtagttactaagggtgtgctccagctatcctcacagaggacataacacagtgctctgtgtttatgtggttcactgctactccaagtgtggtccttgaaccagcagcgttagcatcacctgggaacttgtcagaaatgcaaatccatgggctctatgccagactctggctcagaagctttgtgggagggatccaagaaatttcattctaaccagcccaccaggggattctgaggcacatgtaagtttgagaaccactgatgtaattgaaaaagaagaaaaaaagagtaaaaaggggaaaaaaagaaaaatcatcagtgctaatgatgcacaaggttatcttttgtaaactagggtagtgtaaatactgtaaattgaagcagcaagaactaatcattcaaagtcaaagataactaatgagcccctagattcacatcctcccaccactcacaaggcatgggacccacagatcccctctcccaaatgcaatgaggtatctcgtgtgctggtagagagagaaaatgcacttctagtaaaactgaatactatatattttttttttgagacagagtctcactttgttgccgggctagagtgcagtggtgcgatctcagctcactgcaacctccacctcctgagttccagtgattcttctgcctcagcctcctgagtagctgggactacaggtgtgcaccaccacacccagctaatttttgtatttttagtagagacggggtttcaccatgttggccaggatggtcttgatctcttgacctcgtgatccgccggcctcagcctcccaaagtcctgggattacaggcatgagccaccgcgcctgggctaaacccaaactctttaaactcaagtgaccatgtctccaggcataaccatatttccttcaaattctcaaaattgtttatccccaaaagctgcccacctcaccctctttaggactttggaggtgtctttagattttgttctgggggcctcatgcccatcattcatctttatttttccagcaaagggttaccttccagttcaacatttaccttggaagaggggaccatctacttgaccgctgagcccaacactctggaagtgcaggatgacaatgcttctgtgcttgacgtctatttagtaagtaattttttagtttcctctcctccacttctggtttgtaaatggatccaggccatggcttacacaagaacaagttcaataaaaccaggcatgcttgggttttaaaagaaatgatggcgccctttcacttctgcaaatagtgcttcttttcacaagcaatgttttcctacaatttattacacaaaagaacatctaggtcaatacgaaatcaccacgtataacaagagaacgaatcctctaatgttgaggcaaagtagggctccttagtgttattcccagcgaggaaatgtttccctttgactcagccgtgctccctgatgtttgaatcttctgtgtgttggcgttgctcccttggtaagttagtaggccgagaggctcagaactgggtcatgggaagaacccaaattcagtgctggagaatcttggctgattctctcctcagttgtcaccaaccagctgtgtgatttgggaaggaacctttctgactgcctaaggagggaaataatgcccaccctgcctaccttacaaggctgctttgaggatcatgagtgaccctttagtgcctgtcaaattacctgtatcagcttaatcgaactgttagataatgcctagaaagataccctgatgggctacactgtaaaagagtattttctgtgccaagtgcatcttgcatgtatgctacgtctttgtatgcctgcacaaaaaaaaattttttttgggggggggcagagttttgctcttgttgcccaggctggagtgcaatggtgcgatctcggctcaccgcaacctccgcctcccaggttcaagcaattctcctgcctcagcctccctagtagctgggattacaggcatgtgccaccacgcctggctaattttgtatttttagtagagacggggtttccatgttggtcaggctggtctcaaactcccgacctcaggtgatctgcccacctcggcctcccaaagtgctgggattacaggcatgagccactgcacccggcctacctgcacaaaattacataaaacaggggaagtgttcttttggaattttctgggtttttttaagttttgctaaacctgagccaatactctgtgtcgctcctggtgtacaagtgcaacttcaggaatcagcaccgagtgatgcatgtctcacagcagctccctgagcctccttgagcctgcattttatgcttttccatatccctgacctagcactgtaattcctcacaagtgctctgcagggcatcagtcacctaagatgctactcctagcaatactggagtagtatccaaagtcctggccaggcatggtggctcatgcctctaatcccagcactttgggagtctgaggcaggcaaatcacttgaggtcaggagttcgagaccagcctgaccaggatggtgaaaccccatctctactaaaaataggaaaattaggcaggcatggtggtgcatgtctgtagtcccagctacttaggaggctgaggtaggagaatcacttgcacctgggaggcggaggttgcaatgagccgagatcatgccactgcattcccacctaggcaacagagcatgaccctgtctcaaaaaaaaaaaaaaaaaaaaaaaaaaaaaaaagtcctggctgggcgcagtggctcacgcctgtaatcccagcactttgggatgccgaggcaggagcatcaggaggtcaggagttcgagaccatcctggctaacacggtgaaaccccatctgtactaaaaatacagaggaaaaattagccgggcgtggtggcaggcgcctgtagtcccagctactcggaaggctggggcaggagaatggcgtgaacccgggaggcggagcttgcggtgagccgagatcacgccactgcactccagcctgggcgacagagccagactccgtctccaaaaaaaaaaaagtcctccaggccctgcatggtctggtctcccctgcatctccgacctgccccctccctgggtctccctcttccttgctgatgctattctagccacactggcctccttggtgttcctctcacagaccaagcacatctctgccttgggacttttgtgtttgccattcctgtctgtgtattcttttccacctatcccatgctccctcacttccttcaggtctcagcccaagtacctctttttcagataggcttttcttgaccgccccctacgtaaaacagcaggtcccccaccaaccgttgtaaaaagattttttctctgaatatcctagtttttgcataaacaaatttttttgcactgagcaatgctccaccctaccattgcccccgctttaaaaaaaataagattgtagcagatcacaaaatccttacagaaaagttggtccacccccaaccaagaaaatggggaattaaatagggaaaaaaatacatttttggtcccatgttggattcatctggaaccagaaatcaggaaagcctttcagaaagaagctaagtaaaatctcatcttcatgagctaaggattcatgccactttcatgtgtctttacaaaaactagattttcaccagtcacggaggtgcaatattcctaagtgagccaaaactcaaattcagctccatgtgtggtcctgcctaaacttgaacccaggagcaccctgttgttgttattgaccataaatataagtctcacgtccatctcattggaatcatgtgtcttacaagagtgagggaaggatacagaaaggaaggaatgagggggttttattgagaatattttttgtaaaattctttcactgttttttcctgaattttttttttttttttttttgagatggaatttcactcttgtcgcccaggctggagtgcagtggcgcgatctcgactcactgcaacctccacctcccaggttcaagcgattctcctgcctcagcctcctaagtagctgggattacagggacctgccaccacgcccagctaatttttcgtgttttcactagagacggggtttcgccatgttggtcaggctgattttgaactcctgacctcaggtgatccgcccgcctcggcctcccaaagtgctgggattataggagtgagccactgcacctagccaaaattgtttaagtattcattaatttaaaacagtaatctattatatgttaaataatgtttttatgaatattattatattttccaaaacaaaaataaattttgtgagaaaggtggcattcttttatatttctgcaaatccctaatgtctggcttaatggaagaaaaaagattctcacatctgtttctgtatctgtcttcttgatatatataacacatcatttcatttctagaaagctccatcgtacatccatgaaagggaatgagaataaaaaggcaaacaacatctttgtattattaggaaaatagtttgacctcatggacccccagaaatgatccctacagagtttttctcatattttaacttagtctcttcacctgttgcaaaaccaagtgaagcataaattaattagagacaaataggcacctggagtctgtgctggtctctgcctctcattaatcgtttcccttgaattcagtgatctcagttttctcatctataaaatgaattattaaatcaggttcattctaaattacaaagagatatagaaataagattttccaaggtgggaagattgcttgaggccaggagttcgagaccagccaaggcagcacagtgatacctcatctctacaaaaattaaaaaaaaaaaaaattagccatgcttggtggtgcatgcctgtagtcccagctacttgtgaggctgaggctggaggatccctcaggcccaggagtctgaggttgcagtgagccatgatctagtcactgcaccccagcctaggcaatggagtgagacatggtctctaaagaaattgaaagaaaagaaagaaaagaaggaaaggaaggaaggaagggaagaagggaagggaagggaagggaggggaggggagaaagaaagagagaaagaaagagaaaaggaaggtttccaaagtatctaccgttgtttctccaaattttgctgtttaatcacctcctgtaccataaactttcacattctttaaacttaaattttatggcagtacatctagaaagtcctgcaccattaacttgtaattccagaatgtgttttcatgctggaaaattttattttttgttttgcgtgctcttctagatcagaaagggtacagctcattgccctcccttcagtattttcatttgcatctccatatgaaaaagcaaatggaggccgggcacagtggctcatgcctgtaatcccagcactttgggaggccgaggcgggcagatcacctgaggtcgggaattcgagaccagcctgaccaacatggagaaaccctatctctactaaaactacaaaattagctaggcgtggtggtgcatgcctgtaatcccagctactcaggaggctgaggcaggagaatggcttgaacccaggaggcagaggttgcggtgagccaagattgcgccattgcactccagcctgggcaacaagagcaaaactccgtctcaaaaaaaaaaaaaaaaggaagaaagaaaatggaaaagaaaagcacaagaaaggaaaaccaatcttgcctttgcattgtctcttttttccttttgacataatttgagtgctctgaatcacagccatctttatctgaagggcagttggaagcttctctagtgacttcctgtacagtgttgtcaccaaacgtggtcaggtttctcttgtaatgcttcttctcctttaagatagcatttctctattagtagttgtagcctaatcccctagtgcttttatttatacagtaatgtataataccatttacctttgtgtaaaaatacataagtttaaacccaaatgacgtatgcccaccagataacatatgaaatatccttttaaggatccatccacacattatgtgtgtgtgcattaggctagctctcctgctttttcctgtaactcaacatgaaattaaaaaggattggtgagttgaaaaggcagctaattgttccatcatccttagtgagacatttagttcagattttatgtatctagttattctgcatggctttttaaaggccattcaccttcacactgtagagtcccaagctatttgactcattttcaaatattcaaatcaagggaagtgttttctaagatgatttttatccagtgaccaaagatgtgtttttcattgaattttgagttgatgacacagattagggtatttaaaagaatacacagagatgagcaggctgtattgatttaaaatgggcaatcacgcagtcttcataatagagcaagattctactttgtaaatagtcccagatattctaaggcaccggatgctgtcacagtggctgttatttccgtttctaaggcggcttctttgcctgatgtagaatgcaatttggttttcgtggaaagaggaacaaccaacaaaaagccatttctgctgaaaagtgtattgggagagaatatccttttatgactagctgggaatggctgggtaagtgggagataatgggattgcttttttaataatatagaagtttgaaagatggctgccagaaaacagtgacttccttgcttctactattcatacccaaggttatgcccttacactttccatattaacatcctctcaataatatgtactttcatccagttttgcttctctgcaaaatggctgtttgaaatacaaaaatagctgtgagcaaaggagaagaaacagttaagctgttttttagccacgccagtattggagattagcgctctgatgggcagctgttggacggcttgattatttaatgtgttttcagggtagttaataatactctttgatcatgggaagaagggtggcagagaagtgaaaatgattgaattaacagcttatcatactattatgtatggaaaaagcgtgagaaagagaagaaaaacactttaaattaggtcacaggggtcttagaaaattcagtggaacttttttggcaaaagaaactgcatttctggatttgaatccctcagcgttgaggttaatgacttatattgggtctctttaatcattccttgttggagccagtatccgctgcttcaaggggtgtttatttgaaacagtggcatttcttattccttctcaggagagaactcgatcccctaccaaccaaagatgctgctcgggtttttggtagattttagtgagagcagagtaggaaggagaaaagacaaacactgcgtttggtgtagaaggcatttgaccagaagcccctttccttctgccaggtgatcacattgttgagaagtgaagagattttggaaaggataaattagggcccttgtttgtttccagaaatgcttggcccctaagttattgacaaataatatttctaagacatgtggaagagctgagaaaatggacctcccattgcccgagtctcacagcatctacaagttattcccattcttgaaataaaagtgacgcaagcttcaaattaatgaggcaacctgtcagtctagattaggaggtcacccataggatttttttaaaaaacaaacagcattaaactgctgtttaaggattagcgtagggaattccagctggagttataaaggcacactggctttccagttcaattaggctcagagttagcaattgaatgacagtttgcagggctgcagtagctttttttctttttttttttctgttaggtcctagctttacagtgaatcttggcttgcaggctagcttgatttctactttctttttttctttttttcttttttcttttcttttttttttttgtttttcagacaggatatctctgttgcccaggcagaagtgcagtggtgcaatcttggctcactgcaacctccaccttccagattctagtgactctcctgcctcagcctcccaagtagctgggactacagactcacaccaccatgcctagctgaatagagatgaggtttccccatgttggccaggctggcctcgaattcgacctcaagcgatccgcccacctcggcctcccaaattgggattacaggcatgagccactgcacccggctgatttccactttcttaaaagctagttctgctccagtttgcctgggtcttttattattatacatccaggcgcgggttgcccctcatttttcattcttttcctcctaagactggcctctcttcccttcccttatccctctagactcttcctattgcttctctttgtggtttctatttttgtcttccttgtcagagaaagccagtgtttgccattttctggaaactttccaactcttgggaatagtgtttgaggaagaacagcctgtaatggtgtgaacttggggtctgcgaggccctgagcctgcagaaaacaaacagcagacttagaaagaaccagattagaacaaacaagaacttttaggaaaacaagtttagatcacacccatggacctagtaaacaggactgttctcattcgtgccatttccccttctgggctctgagggggaatgggaaaatgcttaaggactattcggtttataaaaaataaagccccccaagtgtgatgaatggcacgagtaggagtaggcagctgagggcctggcttcccgtggtctgcttctgcctctgctggtttccaaggcctgctatcacaaatgaccacagacagaaatggattgtctcacagttctagaggccggatgtctgaaatcaaggtgtcagtagtgccacacttcctctgaaggctccaggggaggatccttccctccctcttttagcctctggtggctccacatgtcccttggtcctttgatctgcgtcactgctgccatgttcatatggccttcttccctgtgatgttctgtgcctctgtgtggcctctcttcttataaggatgtcactcatttgatttagggttcaccctaatccagtatgacctcatcttaactaattacatctgcaaagaccctatttccaaataaggttacggtctgaggctccaagtggataagaatattggggggacacaattcagcccacccctctaccttaccgagggacctgtgaattaactgctccttaccacacatagcctcgttttcttgttcacttcccttctccctggttgtcactgtgacgttaggtagatgtttccaaattagtttgtattcctcacaaagaggtatcaggtaaatgactatatgaacagagtcagtcacctgttggggacataatttgtgttcgaagtaaaatccctgggggtggactgaggcattggtattttttaaacctctacacacaccagagctgagatcccctgagcttattaacagggtccttcagctctgagcatcctggaattcttgtatgctaatgtaagggggaaccgtgtgactcccctggcaagatagctgtcccattacacgtgcctctaatgtagaagcaaagcctaggaagctcctacaccctcaagtttatgaactgggcttgccaatgagttcctgctttcagcaagccctctactgccacctactgataatcaaggcggggaaggagtgatggagcccctagagttgaaacgtaatgaagagcaagtgtgtgtctcaatggagttcccactccatgtacttgattgtagcctttcagtgttgtacgtgcaaggtcagcaggcggcgggggtatgtccttcagaggtcaaaggcagcttactctgacaggcccagctccaccacctttcaagttggactggaggctacaattacaatgtggcgcaaaaatgaaggtgttaccttccctcaggtccaagtgtgcccccctcatccatcaaggccagttctgcttgagcctttttgaaaggctcccttggcagattgggattcaacacagaaaatgcttctttctactgtttaggcagcaattttaacaaagtatcaacaaatctggggtggagaaagccattcttcaccttcggtcttccacaggtcctcgcctacagccatggaactcccaggtgattgtggcttttgaagtaactttagtagagaacagaattaaatataataagataaaaatatgtggggtttttttaaagacttcctaaatcccagtggttgctattttattagttttctagggctgctgtaacaaagtaccccagatttggtgtcttgaacagaaatttcttttcttgtcattctggaggccagaagttcaagatcaaggtgttggcagggtggattccttctgagggctgtgaggcaaggatctgttctagcctttcgctggtttgtaggtggccttcatctccctatgtcttcacatcacatcttccccctgtacgtgtctgtatccaaaattcccctttgcataaggacatcagccatattgaattagggcccaacctgtggcctcgttttaatctgattacctctataaagaccctgcctccaaataaggtcacattctgtggtgacaacagttaggacttttaacatagaaattttaggggaacacagtttagcccgtaacagctacttgggtgtttttgtaaaggaaaatgccgccgaggaaagtgctgagatggaaaaggcttgatgggggcacaacttttttttttttttttctttttttgatggaatcttcctctgtcacccaggctggagtgcagtggcgcaatcctggctcactgcaacctccacctcccaggttaaagtgattctcgtgcctcagtctgctgagtagctgggaattataggcgcacgccaccacacccggctaatttttatttttattttttttttgtaatgacagggtttcagcatgtgggccaggctggtctcgaactcctgacctcaggtgatccacctgcctcggcctccccaagtgccaggattacaggtgtgagccaccacacccagcctgggtgtgcagcttctaatttccaccctctgggtcttggcagagggcctctggtgcattccttcctgtgggtgagagagaagccagtggcgttgtcctcaggcagtgctccttttcaaatgaaaccagtaccatattcctccccccacatttttcaaatgtggctgaagcaggggtcagagtggattgtgttgcagcaacagatctatgtgatgtgttagatgataaggtgtatcagtccattttcacactgctataaacaactacccaagactgggtaattaataaaggaaagcggtttaattaactcatagttccacatgactggggaggcctcaggaaacttacaatcatggcagaaggtgaaggggaagccaggcacatcttacttagtggcaggagagagacagaagtggcaatcaccagacattttcaaacaaccagatctcatgagaactctgacatgacaacagcaagggggaagtctgcccccatgaatcaatcgcctcccaccagaccactcccccaacacatggggattacaatttgacatgagatttgggtagggacacagagccaaaccatatcatgaggtaaccacccagatttacaattagcaggagtcactcaagtgctgaaaagtccactgcagaactgtccaccagtataaatcactgatgctctcaggcttctcttgggtccttaggaaacaaattaatcagtcagggagctgtgttaaaatgttaccacattaacagttttgaaatgagaggccaaatcttaaatccatcccaggagacggcacagacgagtgtcagctgcgtcttgggtctgctctcaccttatggctcatctacctgctgcttagtgtgggatgctttaatgaggcatctggaggccggcaggaggcctggcactccatgtgctgccaacaccccagaattcaaccaacagtctaccagatcaggaacaaaatagctgtcttcatcccaattgtacacatccttcaaggatggcgaaagtcctgccttctgcctcaaggcttctcggttgaagccttgtagtccctggtccttggaagagagtaacttcacctctaatgctgagtccaaatatattttttaagtacaaaggtaggaaatttggacctgagcgtgcctaagtttcctttcggcaatgcagttccatagcactgtgattttcttctgttcacactgctatgtcctgattctgcagcactagcacgtgtatttgtttccatgcctaacaaaatggtgagcttttgggtccctgctactactggaatccaatacaacgagaaatcccccactgcactacatccccaaatgattgtgccttgtgaagtaattcccaatagaggatagatatgaatataataaaatatagagctttatttaaaaaaaagagagagagagagactctggacttcccagaacccaaaggtgataccttgtgtttaaaacttagggatctcaaccaggcatggtggctcatgcctgtaatcccagcactttaggaggccgagaggggcccatcacttaagtccaggagttcaagaccagcctgggcaacatggtgaaaccccatctctactaaaaatgcaaaaattagctgggcatggaggcgcatacctgtaatcccagctacttaggaggctaaggcacgagaatcacttgaacgcaggaggcggaggttgcagtgagccaagatcatgctgttgctctccagcctgggtgacaaagggaagctctgtctcaaaaaataataataaaataaaattcagggatctctgggaaagaaatcgggtgaacccagagatgaaggggaccccggagccaaggagatgatgttggggtgagatatcctgagccttaatatggatttgtggtgatgtgtgagttttgactaacgtgggcagagggaggcgggatgagttgatgtgatctcatggcaaccagaggaacatcagacaaaagaatcaggacaatagaaatagaaaggaaacagagcagacctggaaaaaaagagaattcagaattgatgacagaaacaggagctgtgtgtaggaaaatgaaacacgggactaagcctacgatggccgaaagaaaagctgatgctttcgtcaaagatatttgggacaaagaatttcaacttgaaaccaaagtgaggatttcctggacaccagagaaagctcttgctttaataaggcctcaggactgaaacctgaggtaattatagttaaaaaaaaaaaaaaaagggggggatatcaccccaagggttgactgctcagggatcatggagacctcacaggacttgtcagtgctgttcatcttggccaacctaactgtggtgaagttccgcctctctcagcactgccctaaaactccctcacaccacatcccagatgttcagaaattctcgatatgtttgtaagccagtcggttgatgggggcaagggtgtcaagggaaggcttgagaaaggcaagcaggagtggaaggaatgagtctaggaaaaaagtttcttggaaaagaaactcctcaccttctcatgcccttcctgtggctctgaaaagtaaaccgaggccatctgagttgggaagccctcctgggagtgtttcctgcctgggctcccctccaggggatccgacttcacagtacagtcagccccctagaaagggcttctgggttaattagtggacagattgcttttgatttgctgttttcccttattgctctgtattagtgtttaattatttaattttaaataactttttaaaataaatgttgaaaattatttaattgtaatattgaaaagctttgtaatctctgaccccttgtgtacatactattgtgtagtttcaatcatagaatcaagcattttattttaggtagaaataaaaatacacctttctctttcttataccccaacatatgtgtgggatgaataacactgggatttaggctgaaatactctacttttactttttatggcaactattaacgacactttttactgtcaggtatcagaattttaaatagttcatgaattctcagagtatctcagtgcataggcaaaaatgctgcacctttgtgggcgtgtgtgtgtgtgtttgttgtgtgtgtgtgtgtgtgtgtgtgtgtgtgtgtgtacagaggttcacctggggacagagctgaaatgtcactccagggtctgtagtctctgagctcctctgccaaagcaccagcgctgagagggaggaacttcaccacagttaggttggccaagatgaacaacactgacaagtcccgtgaggtctctgatccctgagcggtcaaaccttatttcagtctctacacccattcggtcaggatgggtctgaatcttggttgaccttgaggagaagctgctaatcttttgggcaataatgccctgaagagtccatctgcgtgctggggagcagaagggacttctgcgtgtaccacactttgaagaatgagctcaagctatgagttagtttccttccagggtagagaactgatgtttgtgtctctgcagtgatggctaatataggactcctgagttatgaatttgaaggaaggaaaattatggcaccttttatgctaaggaaggaataataaaatggtttctgcatacttctcactgtggccatgtttacaagcaagaagacgctgtgctttcagatcccacagatacctctccatctcattttaacagggttataaattaatgcaaaacagacacgttcatgtatccagatcatgtcatccaagaattacattacaacatgggtggagagttggcagtgctcacccaattttgacattcttgagccctgagggtgagagtgagtgtttataggagcttatagaaacttctatgacatccttagttttaaaaaaaaaaaactaaactaaacttcctgtgtgcatgcaaaggacattttatgaccaaagctggaaatcattctttatttttaatactgaggagagtatcttttattattataagaccctgtgtgtttttttattaaactataaatttaaccaattttatgagagacatcaaggtattaaattcttttcagatcgttcccgttgcataagtcaccaactgtttacagtattctgagttattcagtggtataaatttacagcaatttattttattttattttatttttgatatggagttttgctcttgttgcccaggctggagttcaatggtgcgatctcagctcaccacaacctccgcctcccaggttcaagcaatactcctccaagtagctgggattacaggcatgcgccaccacacgcggctaattttgtatttttagtagagacggggtttctccatgttggtcaggctggtctcgaactcctcccgacctcaggtgatccgcctgcctcggcctcccaaagtgctgggattacaggcatgagccaccacacccggactttacagacaatttttaatgggatcttgtggttgaaacagaacttcatagtcatctggcccaagctacccacaagtgcccaagtcctctctactgtgccttctgggtgctgggtcaggataaacagtttctgcctcagctctcctggggctgatccctaagtgacagcaactgctccttctttagtgaccactcatttctttctttttttttttctttagagacagggtctctctccgtcacccaggctggaatgcagcggtgtgatcatagctcactatagcctcaaactcctgggcttaagcaatcctcccaccttagcctcctgagtagctgggaccacaggcacatgccaccacacccagctaattattttattttattttttatttttgtagagacagggtctcactatgtggccaaggctgttcttgaactcctgggctcagccccacaaagtgctgggattatagacgtgacccatcatacccagcccactcattttttttactccggttaaaaagcacttctagcttgagaaaaaactggcttccatgcagttgtcctgggttctggcttctgggatcattctcaaccactgagtctcagcagatggcatgctgggcccttgtatctagggagggcttgcgtcatgtacacatgacatgtgctgggggaggacataaatttcaggatccttaatgaagaaagagtggagggggtgcagctttacaactctacgcccttcacacattctgagattccactcacctcccgaccccaggatcacagcatctgtgccactattgctggtgacagtgtcacatctttcagcaataccgggactaaactaatacctaagcctttcttccctgaggctagtcttcagagactcaaagacaactattatgccctgtctctacctctcctattttctagaccaaaaagcccaggcctttagccattcccctggggtcctggctccagggcccttcactggtggatctcctcaggcatcactcaggtgatgtacactgtccctctcagagtctggcactggaagtgagacacagaactccagtgtgatctatagaacgaggaaagcaaaactatcacctctttttgtttttattctgctttgttttttaagaacgcaggacttctaaatctaatcagtaggacctcatcattttatgtgggttgttttgtatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagtctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccatctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagctggctctgattttaaatagctaccatttaaatagctaccatttgctgaacatattgttaccacccagccacagtgatattgtttggaaaaaaacatttacaagttcaaggccatgttcaagttgttctttttggcttcagatctaatataccacagcacatcccctcatccctgtgcacttggagggcaggagggtgtcttagtcagtgttgcttccttccaagtcccgagcacagtgctgtgatgtagtcaggactcaatcttgataaacattggtgtaattaacaggtttcaggtccaccaaagaagtatatgctatgctgatcattgcagaagaatcccaaacataatgcaccccattttccagacacaagtgattgggagaaataacgaacttatgttgcgactcatggggagaggttacaaattgatgccaaaatctagtctcacacctgcttttttgctccccccagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaattgtggtggtacatcgattccagtgatttatggtctttccatttcttcttttattaaaaataacccaaatactcctcatttgagatattcagaaatcctaaataaactgaatttcatgatggataaaaatgggaaaaacttcaatagcagcttctgctgaactcatccaaagactttcccaaatgtcctggtatattagtcagctttcactatgttatgctatggtaacaaacaatcccaacatcataggagctttcaccaacatagttttacgtctccctcacatgtggggaccagctgcagctctgctccaagagtcttcttcattctggggtccagagcagcccctatgtgggacaggcaactttcatggcagagaaaaagagcaatggtggaaccaatgagagctcacaaagcttctgtctcagtgcagctgacagcatttctacttgcattccatccaccaacatgagtgacattgacaggtctggagtcaaaggtgtgggatgtacacttctcacatgggaatggactcagcaatgaatattttaattaattaatacagtttacaccacctggtaagtgtccctagcaacagagacgtaagaggttgagagaaaaatcattagaaagcaaaatgatcaaggctgcagaaagatattcctgatgagtaagatgctcagtgttaaatacttcgagttaaaacaagctgattcttgtaagcaagcatgctgtaaacttttgtaaatgtagcccagagccatagttactcagcataagtagcagtttcacctgcagagtcagtgctggaaagctaggatgtcttacatcctaggttaggatgtcaacagggaattctgcagaagtggatgattgaggatcctctgcctctctctagtattcatatgtgctaccactctcccttactacatgggttttcataggtgaatcccactcttcccccctcccatttgtaaatctacccatttaagcagggttcttagcctaggacccactgatttctagaagagtcatagataaatgttaatagggccatgaaatcatatacacaagttgggtatgcttttgtgtatatggggtgttttttttttcatgaagagaaagactatactttttatcaaattcacagtgacctggacccaagaaatgttaagaacctttattttaagacctaactcaaaagccgtttcaataccatgaggctgtgatcctcaaaactctatccccacttgaatcacccgtggcctgcctgtgttgtctcacctgtctcaaaaaacctcaacattttcaaccgttttttaatgactgaggtataacttacatatgctagagtgcacagctatgaattgtatagtccagtgaatttttacatatgtgtagacccatgtgcccagcacctaaagcgcatagaaaacatttgcagctaacctactggcttttttttttttttttttttgagacagagtctcgctctgtcgcccaggctggagtgcggtggtgcagtctcagctcactgcaacctctgcatcccgggtttaagcaattcccctgcctcagcctcccgagtagctgggattacaggcagctgccaccatgcctggctaattttttgtgtttttaatagagacagggtttcaccatgttggccaggctggtcttgaactcctgacctcgtaatccgcccgccttggcctcccaaagtgctgggattacaggcgtgagccaccgtgcctggccacctgctggctctttcatgtcccctctccaccaatgccatcctcaaaggtcactattatgacttccagcatcatagattagttttgccagttcttttttaacaaaactttattggtaatagttggttttttgttttgttgtattgagacagagtctcactctgtcacccaggctggagtgcagtgatgcgatctcggctcactgcaacctctgcctcccaggttcaagcgattctcctgcct

SEQ ID NO: 15585 - DNA, 36913 bp, Human
agatttattgtgaagagcgaaagaacgcgaaagaacaaggcttccatagcgtggaaaccgacctgagcaggttgctgctgcgggctaacgggaatgggtggggggcagggggccagcttttacacccttgtttgtccctgcccatttgccatttctgtcctatcagagtgcccttttttcaatcctccctgtgattggctacttttagattcctgcattttacagagcgctgattggtgcattttgcagagtgctgattggtgcattttacaatcctcttgctagctacagagggctgattggtgtgtttttacagagtgctgattggtatattttacaatccccttgctaggtatagagcgctgattggtgcatttcacaatcctcttgtaagacagaaaagttctccaagtccccactcgacccaggaagtccagctggcttcacctctcatcttctctgtgctttcttgaagcccttttaactaaactctattatgatattgctgggctgggtttttcttacatgacagttctccagagccgtgaacagtgcctgcatcagcaaaactgtcttataaacgcaaactcctgccctgaacagtgcctgcatcagcaaaactgtcttataaatgcaaactcttgccttttggggtagagtgcaatagagtttccctcttcctcctgattagaaggataccttaaaataaaaaaataaaactttagttatattgtggcttaaaaacatgtttttttcctaattgtgtgtttccttgggatgattgggtgaaaggtgctgacggagattaatgacactgaaaaaggtgagcacaacttacaatgaaaaagaggacatttttgtggcgcagccagtgaaaagggggaaattcaggaagctatgagaggcctatggggggacctaacctactctagggaatcagggaagacctcaaaggggaagtaatcttaacactgaacagtatttttttttttagacgaagtttcgctcttgttgcccaggctggagtgcaatggcgcgatctcggctcactgtaacctccacctcctgggttcaagcgattctcctccctcagcctcccgagtagctggcactacaggcgcccgccacgacgcccagctaatttttgtattttagtagagatggggtttcaccatgttggccaggctggtcttgaaaccctgacctcaagtgatccacccacctccgcctccccaagtgttgggattataggcttgagccaccgtgccggcgtgagtaggaattttacagagatttgaggaggcagagattgaggactaagaaatcattggaaatttgaggcagcggcgatatgataaagttctggtgaagaatctaagattcaaaaattttgaggatgtgaattacagaactgtccagaagtggttgattttttgggggccaagcatcagggggctcgcttataaaaatcatatgttctaatttttttttttttttttttttgagatggagtctcgctccatcgcccaggctggatcgcagtggctggatctcggctcactgcaagctccgcctcccaagttcaagcaattcttgtctcagcctcctgagtagctgggactacaggcacctgccaccacgctcggctaatttttgcatttttagtagagacagggtttcaccttgttggtaagactggtctcgaacccctgacctcaggtgatccacccgcctcggcctcccaaagtgctgggatgacaggcgtgagcgactgcccctggcccatatgttctaatattctaggttacaacgctctacgctgcaatctctccaccgttacagtttaaaaactataagtccctaccaccctcgcctactgtgcgtgcgcggcgcgcggcgcttcgggccttgtagtcttggacagacccccgaggcccatggtgccgtgcggcgggtcgttgcgcctgcgcggtgcgagcggcgggcagcgcagactgcgaggctcttttgttcggctgaggggagggccgttggccggggcctgcggtacgccgcttcagtgagggacgccactgcggccacccggcttgctgccttcctgggcgccactcccccaggcgacccgacgcgacgcgccagcagcgcagcaccgattcctctcgggctcttgggcgctgctctgaggtgaggagcccgctggaggcgggagagctgggggagggggcgcggcggcggcggcggcgggagccctgcgtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaaggtgtgctgattggaggaggagatgtgtggaataaattgggaaaggggacacggagggggaggggcaggcgtttgctgggcctgactctggaaggggaggagctgttaggataagtagggcggagatcccgagaatatttctataaggtatgtaagaaaaaaggggaaagcaggccgcccttgcatcctgatgggtccttacagtggggaggctgtaagaataatgtgcgaagaaaggatggaatacgcttttttcagttttccaggtttcctactaccttcactccatgattcctttggggagttaaaaaagtccaagtgcagttcttgctttgattcaaaattagttccgtacgtttttgtgtgggatcgtaactggtctcacaaaggtgatgaaattgtaaaaatatgtagatgagttaatagttgaggaacggcgtgaggtagtgagagattgtgagatcgtgtgaggtgcgagaaattgggagacataggaaaattatgtgagattgtgaggtaatatttgtttcgtgggcccttctgtttttagccagcttttccttgttggaaaatttgaatagagtgagctatattttacctctttttttttttttttttgagaagagtcttcctctgttgcccaggctggagtgcagtggtgcgatcttggctcactgcaacctccacctcccggattcatgcgattctcttgcctcagcctcccgactagctgggattacaggcacacgccaccacgcccggctaatttttgtatttttagtagagacggggtttcaccgtactggtcacgctggtctcgaactcctgacctcgtgatcctcccgcgtcggcctcccaaagtgctgggattataggcgtgagccactgcgcctggccatattttacctctttttcaaagtttcaaatgagggtttttcataaattggtgttacatttagacgtgttggtttaacgcaattgaggtggaatttacaaaaagttcagctataatcagttatatactagaacccctagcccagggtaaagtagcctcctcaattgtgttaagagtcacatcagcagtttggaaagattgtgaaaggtccaaggctttggaatagattcaggaatacaatggggaaattaatgccggtgttcctccctaggtgccttatagacttttatatgaaagtggtgtgattgaaaagcacttgtattgaaaccggtggcaccttaatgaagcttcacgggagtggaggacctgaagtcgtttacggttttccctgtggtgatatttttcttcaatggctgctgtatcctaaattgtttctcattaaaaaaataaatagtagggtcgggcgcagtggctcaagcctgtcatcccagcactttgggagtctgaggtgggcggatcatgaggtcaagagatcgagaccatcctggccaaccaacatggtgaaaccctgtctctactaaaaatacaaaattagctgggcctagtggcgcatgcctgtagtcccagctactcgggaggctgaggcaggagaatcgcttgaacccgggaggcagaggttgcagtgagccgagatctgcaccactgcactccagcccgggcaacagagcgagactctgtctcaaaaaaaagaaaagatagatgataggtagatagatggtgtgtgaaataaatagttttgaatgtaaatagaagcctagtggtaagtaagttaccctggtcttctgcatttctgaatacaggatacctataacttacaaactatacctctaaagaaagatagcactcattcttgtgcccattttaaggactaggaaaatgtttctctttgttgttcacaccatttgaaaataattcattaaattttggcatcctctagtggtttatctagcaaaacctcccttttttaaaaaaaaatcctatctgcagtggtgtaagagattttgcattagatttggtagattttcacttcataggttctttccacgaagagtttctggtgtagaaggctaattgctagtttatgggctcccataaaatggggccatactggccccgtctctactaaaaatacaaaattagctgggcgtggtggtgcacacctgtaatcccagctacttgggaggctgaggcaggagaatcgtttgaacccgggaggcagaggttgccatgagccgagatcgcgctattgcactccagcctgggcaacaagagcgaaactctgtctcaaaaaaagaaaaatgaaaaaatggggacgcacctcttgttcattagtgcctggcacatagtaggccgttcagattgttgatgaatgaatgatgaataggggagctttgagatccattctgagaactcagccaaattaatgtgcatagtagtttgcttgtcctgtgtctgtgacatttggcagagttaagctgttgctttgccatgtttgtcttagcctcagttagtttctttttgtttgtttgtttgtttgtttgttttttgtttttttaagacagagtgtcgctctgttgccaggctggagtgcagtggtggcatcatggctcactgaagcctcaacctcctggacacaagcagtcctcccaccacagcctcttgagtagctaggactacagtctcatgccaccatgcatggcttcttttttgtggggacagtctctgttgcccagaatggttagcttcagttttgtactcactctggtactaaatatagaaaaggtatacaggctgtgcaactggccgttttaaatacctcaggcctcagattctgggttttgtcagcaagcaaatagcttgaatatatctgttttaaaagaatcttgaaaaatcttctgtgtcctttgtattgacctgagcaataatttaccagtagcaatgtctgttgaaaaattgaatagcctttccaaggttatttggagaagttactcagatatggacaaaatttagatcttgtcaatatttgcatagaataacttgtattaaatctttcctgcctttagcatttatactttgatgaccagaagggggcaacctaatttgtctgtgaaattgtgccttttaaaataatagttgacactttgagtgcgtaacagaactatggtattaattttttttttttttttttgagacagagtctcgctctgtcgccaaagctggagtgcagtggcgcgatctcagctcactgcaacctccgcctcccaggttcaagcgatcctcctgcttcagcctccggagtagctgggactaccagggggccccgacaacgcccggctaatttttgtatttttagtagagatgggggtcttgccatgttggccaggctggtgttgaactcctgacctcgggtgatctaccctcctcggccacccaaagtgttgggattacaggtgtgagccactgcgcccagcctatagtattaatttttaactgacaagaatggtgtatccttatggggtacaatgtggtggcgtttttttttctttttttgagacggagtttcgctcttgttgcccaggctggagtgcagtggcgcaatctcagcttactgcaacctccgcctcctcggttcaagtgattctcctgcctcaggcctcctaagtagctggaattacaggcgcctgccaccacgcctggctaattttttgtatttttttagtagagatggggtttcatcatgttggccaggttggtcttcaactcctgacctcaggtgatccaccctccttggcctccaaagtgcagagattacaggcgtgagccaccacgcccaacttgtggtgggggtttttgaacttttatttttctcacataaatagaggcagggactcactatgttgcccaggctagtttcgaactcctggcctcaagtaatcttcccacctcaccctcccaaagtactgggattacagacatgagccactgcacctggcccactgtggtggtttttgtttttcttttctttttttagacaagtcttgctctgtcacccaggctggagtgcagtggtgcactccactcagctcactgcagcttacacctcccgggttcaagtgattctcctgcctcagcctcctgaggagctaggaatacaggtgcacaccaccatgcccagctaactttttttgtatttttagtagagatgaggtctcaccatgttggccaggctggtcttgaaatcctgacctcaagtgatccacccacctcagcctctcaaagtgctgggattgcaggtgtgagccaccatgcctggccactgtggtgttttgatacgtttccaatgtagtcataattctggtctagctttctaaccacttttattttatcttaaattcacctttgaaagatagcttgaggtatctctgtgtccatactaacatttgtagactcttgtggcctctcaacccaaaaatctgtgtcaaaatatccatgtcaacatactcaaggggttttccaagtttcagaacacatctcagataaaattcaaaatgtattcgcacaccagcattctagcctttgatcctctggaattcaagggctggtgttcctttaaaaatgaaactcctgactgggcgtgatggctcacgcctataataccagcactatgggaggcctagatgggtggatcacctcaggtgggaactgaagaccagcctgaccaacatggagaaactccgtctctactaaaaatacacaattagctgggcgtggtggtgcatgcctgtaatcccagtgactcgggaggctgaggcaggagaactgcttgaacctgggaggcggaggttgcagggagccgagattgcaccactgtactctagcctgggtgaaagagcaagactccatctccaaaaaaaaaagaaactcctgctaactgtgtgtggcataagttcttgttttctgcttagtcaagttttccatctggaaagcatttgcttcgcaaacagccacagcttacagactacaagcagtttagaaacaagactaccacctgaatatactacacatgccttcacctgccttttgatgattggtatgtagttgctgattctttcaacaaaaggtacttctttcttgttttctctttagggcttatggatcagatttatcttgctgcttattcccttaaaagcttatagctttggaattctattccctgatgcttctgagacagtcatcctcttttttttgagatggagttttgttcttgttgcccaggctggagtgcaatggtgcaatctcagctcaccgcaacctcagcctcccaggtagctgggattacaggcgtgtaccaccatgcccagctaattttgcatttttagtagagatggggtttctccatgttggtcaggctggtctcgaactcccaacctcaggagatctgcctgcctcagcctcccaaagtgctgggattacaggcgtgagccaccgcgccccacctgagacatccatctttattgtccatatagggttcaacaacttgttcaggttccagacctacctttaattgtatgtgcaagtaaaaatagaaacagaatgctttgggaaccccaaagaaaagagaaatattatttagctaggttgggtaggcttcatggagaaagtagcatttttaagctgggtcttgaagaatggataggattttgactgttggccctgtacaggagcacactactttcttttttctttctttttttttttgaggcagagtcttgctctgtcactgaggctggagtgcagtgtcaagatcttggctcactgcaacctctgcctgcctggttcaagtaattcttgtgccccaccctcccaagtggctgggattacaggcatgcaccaccacacctggctaatttttgtattcttagtagatatggggtgtcaccatgttggccaggctggtcttgaactccaggcgtcaagtgatccacccgcctcgacttcccaaagtactgatttataggtgtgagccaccaagcccagtcaggagcacacttttttttttttttttcctttgagacagagtcttggtccgtcacccaggctggagtgcagtggcgcgatctcagctcactgcatcctaaccccgttttccggattcaagcaattatcgtgcctcagcttcttgagtagctgggactacaggtgcgccatgctggctaattttttttttgtatttttagtagacacggggtttcaccatgttgctgggctggtctcaaactcctagcctgaaggatccacccacctcggcctcccaaagtgctgagattacaggtgtgggccacagagcccagcccacactttttttttttggagacagagtcttgtcctgtatcccaggctggagtgcagtggcacaatcttggttcactgcagccttcacctcccaagttcaaggaattctcctgctttagcctcctgactatctgggattacaggtatgtgccaccacacctggatgatttttgtatttttactagagttggggtttcaccatcttagccaggctgatcttgaactcctgacctcaagtgatccacctgccttggcctcccaatgtgctgggattacaagcatgagccactgcgccctaccaagcccacacttcttttttttttttttttttttttttgagacagagtttcactcttgatgcccaggctggagtgcagtggcacgatcttggcgcatcgcaacttccgcctcccaggttgaagcgattctccttcctgagcctctggagtagctgggattacaggcatgcgccaccacacccagctcattttgtatttttagtagagatggggtcatgttggtcaggctggtctcgaactcctgacctcaggtaattcgcctgcctcagcctcccatagtgctgggattacaggcgtgagtcaccatgccgggcctaagcccacacttcttaatacttaatagatgagcaaagctatggaggaaacataggatatgttcaggttgtggccaggttatagtctttgacaggaatgtagattttgtgagggaagaagggacataattagtctggaataagaaccgaagaatataagtgttacactgacgactttggccttttgttttaaatgggaggaaaccttgtagaaaatatttcctattcagtcagctccagcccaaactggtttatatgtgtcacattgcctttgtttacaacagttcctgaagccaaattgccctaccagtacaccttttcaaatgctagtaaagcctggtttcaaactcagcttttcaaaatgtttactgatgccctcgccagttcttcctccaacctcctatagtgcgtttatggctactttttattgcttatactgcttttggtaattatgtatgcttgccatttcggactctcacttgaacttgcattgtttacctttttgtaaatttttttcgagacctgtcttctgtgtcttttttttttttttttaattttatttttgagacagagtctcgctctattgcccaggctggaatgcagtgtcgtgatctggcctcactgcaacctctgcctcctgggttcaagcagttctccctgctttagcctcccaagtagttgggtagctgggattacaggcgcctgccatcatgcccaactaatttgtttctttcttttcttttcttttctttttttttttttttttttgagacagagttttgctcttgctgcccaggctggagtgcaatggtgtgatctcggctcactgcaacctctgcctcctgggttcaagcgattctcctgcctcagcctcccgagtagctgggattacaggcatgcgccaccacgtccggctcattttgtatttttagtagagactgggtttctccatgttggtcaggctagtcttaaactcctgacctcaggtgatctgccgacctcggcctcccaaagtgctgggattacaggcctgagccaccatgcccggcctaattaattaattaatcttttagagatagagtctcgcagctgggtgcggtggcttacgcctgcaatctcagcactttgggagtctgaggtaagtggatcacgaggtcaggagttcgagaccagcctagcaaagatggtgaaaccttgtctctactaaaaatagaaaaattagccaggtgcagcggcgggcacctgtaatcccagttactcaggaggctgaggcaggagaatcccttgaacccgggaggtggaggttgtgagccaagatagctgcactctagcctgggcaacagagcaagactccctctcaaaaaaaaaaagagagagagagagagatggagtcttgctgtgttgcccaggctggtctgaaactcatggccttaaccactccacaacccttgccttggcctcctaaactgctgggattacaggtgtgagccacagtgcctcgctaattttattttttttttaatagatagtattaaaaggtagaagatctggtcgggcatggtggctcagtcctgtaatcccagcactttgggagggcgaggcgggcagattacccgaggtcaggagttcgagaccagcctgaccaacatggagaaaccccatctctactaaaaatacaaaagtagctgggcatggtggcgcatgcctgtaatcccagccactcgggaggttgaggcaggagaatcacttgaacctgggaggcgaaggttgtggtgagtcaagatggcaccattgtattccagcctgggtgacaagagtgaaactgcatctcaaaaaaaaaaaaaaaaaaaaaaaagatctggctgggcatggtggctcacgcctgtaacctgagtactttgagtggtcgaggtgagtggatcacctgaggtcaggagttcgagaccagcctggccaacatggtgaaaccccctctctactaaaaatacaaaaattaggcctggtgtggtggctcacgcctgtaatgccagcactttgggaggctgaggctggtggatcacctgaggtcaggagtttgagaccagcctggccaacatggtaaaaccccgtctctactaaaaattcaaaaaattagctgggcatggtggcgcgtgcttgtaattccagctatttggtggggctgagacaggagaagcacttgaaccctggaggcagaagttgcggtgagccaagatcatgcccccgcattctagcctgggcaagagtgagactctgtctcaaaaaaaaaaaaaaaaaaaaaaaaagggcatggtggcgggcacctgtaatcccagctacttgggaggctgaggcaggagaatcggttgaaccccagaggcggagttctaaagtgagccgatatcacaccacttcattcctgcctgggcaacaagagtaaaattccatcttaaaaaaaaaaaagctagaagatctgcagttatgaactttgatagccattaactgactagatcttcaacctaaacgggttaaaagagggggaaagaaaatggaatggtaaaaagaactagatggaaaaaggaatgaagtaagaagtgatatgcaaaataattgtcatcttctccctgcctcccattccctcagtctagtcgaggtctttccacctggccatgtttcttttcctcagataaagcaagctcattctcaccttaggactttcaaaccaactattccctaaccttggagtgcttttcttattttggctgagttgtctccttgtagttcgggtttctgtttaaatgttattctaaagaaatttgctttgtaacatttatcagtaatattttcttgtttattgtctgtgccatgctttgcaaacacatgtgtgcacacactcaatagtgctcactcacttgtctgcactagaataataaggtctaagagatcaaggattttgtctgtcttgtctaccccatttttccagcaccttacacgtaataggtgcccagtagataattgttatgtgaatgaatacaataggagcatgttcatacagagttaacccagtctggggctctagggaaggaattctaaggaagtgacatttaagctaaggaaattggttaagtgaaaagttgggcaaagcgcaaggtaatgatgattgataggtgtaggtgcaggggccttcagctcaaatgcccacagataatgatgtgaagagatagattttcattttgaaatcactggctagtgttgaaaatgaattggatcaggagttatccattgcaagagatgatggtggcttcgaatagagcagcagcagtggggctagaaaaaagtatgaattggaagatatttaagatataaaattaccaggatttagtgagagactggatatggaggatgaggaatcagagctgattcccatatttttgtcttgagtacagcaaaagctatatgaattctgagactgtttatttaattgggtgattggctagaaaaaaatatatacatgtaaataaaaactgaggttgaaatcacaatcttcaaagtttcttaaggaactttactgtgtggattaccaaaactgatttttgtacttacataggtcatcagaaatcttaaaatttttgtcacaaatagccgggcgcagtgactcgtgcctgtaatcccagcactttgggaggctgaggtgggcagatcatgaggtcgagatcgagaccaccctggccaacatgatgaaactccatctctactaaaaatacaaaaattagccaggggtggtggtgcacgccctggaaggctgaggcaggagaattgcttgaacccaggaggcggaggttgcagtgagccgagatcatgccactgcactccagcctgggtgacagagccagactccatctcaaaaaaaaaaagtcacaaataaatttcgttaaaattttctgtttgtatccagaatttacttcctttctttactccttggaaggtaaattccttttgccatttatttatttatttagagacagagtttcactcttgttgcccaggctagagtgcagtgacacgatctcggcccactacaacctccacctcccgggttcaagtgattctcctgcctcagcctcccgagtagctgggattacagatatgtgccaccacgcccagctaattttgtatttttagtagagatggggtttcaccatgttggtcaagctggtttcaaactcttgacctcaggtgatccgcccacctcggcctcccaaagtgctggggttacaggcgtgagccaccgtgcccggcctccttttgccgtttattacacaaactttgtaactttattctcctccctgggctagataaatggaaaagcaaaagaaattcctgcacttccggtatatgcaatgtgatttctgtttctggcagctcttctgtctcagtcctccagaaataaggtcttggtttctctgttttgtagttcttggttcattcatagtagccatatctgggttcttcttgagtgttttctggaactgctctgctgtttggagaaaccaagtcatgaatttcagccagatctgtaggacaaaaatgttgttttctcattgacttttctcagtgcactgggtttcagagagctatctctgaatatatactgctctagtagtgtataatgaagaagtagaatgtatgtgcaaatatataaatagataattaatgccaggagtcataaaagctaacctctcagggccgggcatggtggctcacgcctataattccagcactttgggaggccgaggcgggtggatcacgaggtcaggagattgagagcatcctggctaacacagtgaaaccctgtctctactaaaaatacaaaaaaattagccgggcgtggtggctggcgcctgtagtcccagctacttgggaggctgaggcagaagaatggcgtgaacccgggaggcggagcttacagtgagctgagatcgcgccactgcactccatcctgggcgacaaagcgagactctgtctcaaaaaaaaaaagaaaaaagctaacctctcagttatcgcatgagggtcattaagtctgttttacagatgaagaaactgagttatatagtaactatacgtgactacctataaacataaagttgagaggtcagagaagtgaaagatattaggggccaaggcttggaatcgtgacagttgtgctttgcttattgtcctggtgtttgattaaacaggtctttcactgagaagcagaccacataggaaccctaatcatgcttctggtgctcctgttacctttcttctggtgaaagggatgctgaggatcttttaagcagtgcccttccagtttcattgctgtacaacaaaggtctagactggatggtgttgaatgtgatatagaggaggttttgttttcaagcacatcagttgttacttcccttactgcttcatcgttattctaaatgtgatggagaaaataaaatgttcaccggcattctagcgaactatgagaactgatttttttttctttttgaaacagagttttactcttgttgcccaggctggagtgcaatggcacgatctcggctcaccgcaacctctgcctcccaggttcaagcgattatctcagcctcccgagtagctgggattacaggcatgtgctaccacgcccggctaattttgtgtttttggtagagacgagatttctccatgttggtcaggctggtcctgaactcccaacctcaggtgatccacccacctcggcctcccaaagtgctgggattacaggcctgagccaccgtgctgggccccgagaactgatttatgtctgcagtaatgtgtgtaatttcacttgaggaatatggtttttgccaatcctcttacagcagtagcttttatccaagaatgttcatcaaaatcacctgtggagctttgaaagatgcagatgcctggccaggcgcggtggctcatgcctgtaattccagcactgttggaggccgagatgggcggatcacgaggtcaggagatagagaccatcctggctaacacagtgaaaccctctctctactaaaaatacaaaaaaattagccgggcgtggtggcaggcacatgtagtcccagctactggggaggctgaggcaggagaatggcgtgaacctgggaggtggagctttcagtgagccgagatcacaccactgcactccagcctgggcgactgagtgagactctgtctcaaaaaaaaaaaaaaaagatgcagatgccagcttttaaaattgagctatgaattaattactcttgattcagatttatgctgttcctggattccttgggatactataaacaagttttggggttttttgttttgttttgtgttttattgagacagtcttgctgtgtcgcccaggctggagtgcagtggtgtgattttggctcgctgccaatgtcaaaacagcattcttcattataataaaggaaaccatacaatggaatactatggcagctgttagggatggagatctttatggaataatgtcaaagatacattgcattgtataaaatggtaaactggtgcttgcttaagcagcacatgtactaaaattggaacgatacagagaagattagcatggcccctatgcaaagacgacacacaaattcatgaagcagtccatatttttaagtatttttttaaaaaaatcaaaagtaagaaatttttatttatttatttatttattttgagatggagtctcgctttgtcgcccaggctggagtgcagtggcgtgatcttggctcactgcaacatccgcctcccgggttcaagcgattttcctgcctcagcctcctgaatagctgggattacaggcatgcgccaccacgcccggctaatttttgtatttttagtagagatggggtttcaccatgttggtcaggctggtctcgaactcctgacctcgtgatccacccacctcgacctcccaaagtgctgggattataggcgtgagccaccgcacctggcaacaagaaaaataaattttttttttttttcagacggaggctcacactgtctcccaggctggagtgcagtggcgcgatcttggcacactgtaacctccacctcccaggttgtagcaattcttctgcctctgcctcccaagtagctaggattacaggcgcctgccaccacgcccaggtaattttttgtatttttagtagagatgggggtttcactatgttggccaggctggtctcaaactcctgaccttgtgatccgcccgccttggccttccaaagttctgggattacaggcgtgagccactgcgcctggccacgttatatatttttgtaattgaatgttaatatatgattttaattagaaaaaattaactgctttaaaaacaccacttcctcatgtattcgctgtggagtggggtctaggcatctgtatttcttcttttttctgttttcttttttttttttttttttgagactgagtctcgctctgttgccaggctctggagtgcagtggtacaatctcagctcactgcaacctctgattccccggttcaagtgattctcctgcctcagcctcccaagtagctaggactacatgcgtgtgccactatgcccggccaatttttgtgtttttactagagacagggttttgccatgttggccaggaaggtctcgatctcatgacctagtgatctgcctgccttgacctcccaaagtgttggggttacaggcatgagccactgcgcccagccttttttaaaattttttttgagatggagtctcactctgttgcccaggctggagtgcaatggcatgatcttggcttactgcaacctccgcctcccgggttcaagctattctcctgcctcagcctcctgagtagctgggattacaggtgcacaccaccacgcccagctaatttttgtatttttagtagagactggggtttcaccatgttggccaggccgatctcaactcctgacctcgtgatccacccacctcgcctcccaaagtggtgggattacaggcgtgagctatcacacccaggcaggcatctgtatttctaaactccataggtgattctgattctcatagaggtgaaggttcttgactcagagttcgctttcctctgaattcttttcttttttttttttgagatggcgtcttactctgttgcccaggctagagtgcaatggtgcgatctgggctcactgcaacctctgcttcccaggttcaactgattctcctgcctcagcctcctgagtagctgggactacaggcacccgccaccacgcccagctaattttttgtatttttagtagagatggggtttcaccatgttagccaggatggtcttgatctcctgaccttgtgatctgcccacctctgcctcccaaagtgctggaattacaggcgtgagccaccgcgcccggccatttttgtttatttattgtttttttctttttcgttttcttttttttgagacgaagtctcactctatagcccaggctggagtgcagtggtgtgatctaggctcaaggcagcctccgccttctgggttgaagtcaagtgattctcctgcctcaggctcccaagtagctgtgattacagatgtgcacgaccacgcccagctaatttttgtattttttagtagagacagggtttcaccatgttggccaggctggtctcaaactcctgatctcaggtaatttgcctgcctcagcctcccaaagtgctgggattacaggtgtgagccatcatgcccagccctgaccaacattttaaatgcctcaccttggcatttagctagaaaccctactggtttagtttcttaggtctgtaggtgttaccatggcctcacatttataatttggtttttcaaactggcaagaaatcagaatcgtggaagttcctagcatagcacttcatagttcatgtttatggtggcagccaagagctgtggccatactggcttcttgaagccttctcgtaccctttcacagtacaaactatttcaaaccaaaatgaaatgcctaagcttgtgtctgttatgttactgccttctgcagtcaagtagcattgttgcttctttacattttctagctcctcagtgcaggggtggagggtgggtgaggaaaatcacaacagtactctttctcttaaaattgagctatgaattaattactcttgattcagatttacactgttcctggattccttgggacactgtaaacaagttttgggttttttttgttttgttttgttttttattgagacagagtctcgctgtgtcacccaggctggagtgcagtggcgtgattttggctcactgccaatgtctgccgcctgagttcaagcaattctcatgccttaatctctcgagtaactgggactacaggtgcatgccaccgtgaccagcctattttttttgtatttttagtagagacgaggtttcgccacgttggccaggtttttcttgaactcctgaccttaggtgattctgccctcctcagcctcccagagtgctgggattataggcgtgagccaccgcgcctggcctggtttcttaaaattgacattttctcagtagttctctctctagtctgcttgctagatgtttaacttaaaaaattctacactatgtagcacttgtcaatttaaaagactcaaaagactgctggggcattaaaaacccagctttgtttctgtctgcaggtttaataaacaatgaataccttcatattccagaaaccaattaaaaatcattgttttttttttttaacagagccatacctttcaaggtcttttctgagaaaaatcattaccagtcactttcttatttaccagtgacaaattgtagggaggagtcatcttaagagacctctgtgtcctttccttatacaggctggagggatgttaccctgtaggtttttggctagctgctagttttatgtgttcaacagggcatttagcctagccttgctagatggccttactgaagtgcagtgcttcgtttaattgtgtgaccttaggtgatctatttcatctaaatttggtctatttgtgaggcagagataacatctgaatggcttatctcacaggatggttttgaagattaaatgagataatgtggtagcactttgtaaactgtaaagtataatgcaaatgtaaagtattatttttctaggaatcttcaaatgtagcagactcagcaaatgtttaggtaaaaattatggcaatgctagatttctttgtttacaatattgtgatataaaccatacgagttggctaagtaggacaactgaggatctcaaactgaggtttgagtacatactgtaaaaccatactcccctatttgtagtccagtcaactcagttactagcttcaactagtaactcttgagagtattggtttttttttgtttttttttgtgagacggagtctcgctctgtcgcccaggctggagtgcagtggcgcgatctcggctcactgcaagctccgtctcctgggttcacaccattctcctgcctcagcctcccaagtagctgggactacaggtgcccgccatcacgcccagctaattttttgtacatttagtagagacggggtttcaccatgttagccaggatggtctcgatctcctgacctcatgatccacccacctcagcctcccaaagtgctgggattacaggcgtgagccaccatgcccggccgggagtattgtaaataataaatgagtaggcagggcgccatggttcatgcctgtaatcccaacacttggggaggccaaagcgagagaattgtgtgaggccaggagtttaacagaagcttggcgcccggcacagtggctcacgcctgttatcccagcactttgggaggctgaggcgggtggatcacgaggtcaggagttggagaccaggctgagcaacatggcgacctgtctctactaaaaatacaaaaattagctgggtgtggtggcacgcacctgtaatcccagctactcaggaggctgaggcaggagaatcgcttgaactctggaggcggaggttcagtgagcatgatgattagcaccactgcactccagcctgggtaacagagcaagactccgtctcaaaaaaaaaaaaaaaaaaaaaaaaaaaggaaagaaagagaagcctgaacaacataggaacaccttgtctccaccagaaaaaattgaaaaaattagccaggtttggtggtacaagcctgtagtcccagctacttgggaggatggcttgagcccaggaggtcgaggctgcagtgagttatgatcaggccaccgtactgggcaacagagcgacaccctgtgtctaaacaaaattttttaaataaatgagtaaagtgtttgtaatagtacctggcacataataagcactcactattattagatacttcagtgaaactttgcagataaacatggctggttgaactacatggttctactccttttgaaaatctcacacaagtaatggtcaaaggattttttttttggaggggggatggagtttcgcttttgtcgcccaggctggagtgcaatggcgcaatctcggctcactgtaacctctgcctcccaggttccagcgattctcctgcctcagccttccaagtagctgggattacaggcgcccaccaccacacccagctaattttttggatttttagcagagacagggtatcaccatgttggtcaggctggtctcgaactcctgacctcaagtgatccgctcacctcggcctcccaaattactgggattacaggcgtgagccaccacgccacctggccaataagaagatttttaaagagacaagaaaaataggaaaaagacaagtagagatgtcagaaaacagctggaaaactagttactgaccagaaaaagctaaaaattaagtaggactggatttaggaagagccaagaaggtacaacaaaccagtttgtgtcacaggattctggaaaggccactaggtacccctgacaataggggtgcaggtggaatttacaaagtggtaattgaccaggcatgatggcttacacatgtaatcccagcactttgggaggctgaggcgggaggatcactggagtccaggagttcaagaacagcctgggtgacatagtgaaaccctgtctttaaaaaataaataaataaataaaaattaggccaggtgcagtggctcattcctgtaatcccagcactttgggaggctgaggcaggcagatcacctgaggttgggagttcaagaccagcctgaccaacatggagaaactctgtctctactaaagatacaaaattagctgggcatggtggtgcatgccaataatcccagctacttgggaggctgaggcaggagaatcgcttgaacctgggaagccgaggtggtggtgagctgagatcgcgttgttgcactccagcctgggtgacaagagcgaaattccgtctcaaaaaaaaaaaaaaaagataattgtgtcattaaaaaaaaataaaattacctggcacagtggcttacgcctgtaatcccagcactttgggaggctgaggtgggcggattacttgaggtcaagcgtttgagaccagcctggccaacatggtgaaaccacgtctttactaaaaatacaaaaaaattagccaggagtggtggtgtgcatctgtagtcccagctactcgggaggctaaggaagaggatcatttgaacctgggaggtggaggttgcagtgaactgatattgcgtcactgcactccagcctgggcgacagagactccatctcaaaaaaataaataaaattatagatcatttttccttttttttttttttttttttttttgagatggagtctcgctctgtcccccaggctggagtgcagtggcatgatctcggctcactgcaagctccgctacccgagttcacgccattctcctgcctcagcctcccgagtggctgggattacaggtgcccgccatcacacccagctaattttttgtatttttagtagagatggggtttcaccgtgttagccaggatgggctcgatctcctgacctcgtgatctgcccacctcagcctcccaaagtgctgggattacaggtgtgagccaccacgcccagcctctttatcatttttttaaagacagtcttgcttcctcacccaggctggagtgcagtggcacaatcacagctcacagcagcctcaacctcctgtgcttaagcgatcctcccagcacacccagctgattattttttgtagagatggggtctcactacgttgcccaggctggtctcaaactcctgggctcaagcagtccttctgcctaggccttccaaagtgctggaattacaggtgtgtgctgccgagccctgacctctctactgattttgacaaatagctttcttgaaaccctagagaactaattgtaaacaaaaaaacacgttgggaaggctggctgggaatctccagtaatacagtatctctggatgtagatgctctgggatgagccagtaaagaaagctcaggaagaagcggggatctgttttctatattcttcttatttgagttgctcttaagacagtacttaaaaagtaaggaaagggccaggctcagtggcttaggcctgtaatcccagcactttgggaggccgaggcaggcagatcacctgaggtcaggagttcgagaccagcctggccaacatggtgaaatcttgtctctactaagagtattaaaaaaattagctgggcatggtggtgagcgcctgtaatcctagctctttgagaggctgagacaggagaatcgcttgaactcaggaggtgaaggttgcagtgagctgagagtgctccattgcactccagcctgggcgacaagagcgaaactctgtctcaaaaaataaaagtgagtaaagatcgaagtcatgagaatgctttactttagatttccccatttgggcgctttctttacctaacaattatgccattctatgactgttcctctctgaggccatgctaattaatgataaagggaggataagcttgcagtaggtagagatcagttagaagctatgctgaccctttcggctcatagcagaaggatcaggtggataatagtcagtgctgttttattttttggccagatctcatgccagtaatcccagcactttgggaggtcgaggcaggtggatcgcttgagcccaggggttcaagaccagcattggcaacatggcaaaaacccttctctaccgaaaatacaaaaattaggcagtcctcataacctggtctctaaataagcaaataaatagattaaacttttcaaaaagaaatgctatttatttttctaagacaaattttatatatatatatatatatatatatatatatatatatatatatttttttttttttttttttttttttttttttttgagatggagtctcgctctgtcaccaggctggagtgcagtggcgcgatctcggctcactgcaacctccgcctcccgggttcaagcaattctcctgcctcagcctcccgagtagctggcactacaggcgagcgccaccatacccagctaatttttatacttttagtagagatggggtttcgccatattggccaagctggtctcgaactcctgaccttgtgatctgcctgcctcagtctcccaaagtgctgggattacaggcgtgaaccaccgcacccagccttgtagatggactctaagtgcattctgtctatacatgccagttttacagtgtttagaaaacttaatgattacactaagtaagcttcctttcctaaggatgctaggaataaccagtttaacctcaaattggtattattttaaactcaagcggagacgtaactcttccttgtcttggattacctgccatccaggtaattctttggccagttttgttgatcaattttgtttcattgatacagtgccatctactgacaaaaattggtaatcataaggctttaagtctgtcagaagtcaaagagttgggtccgggcacggtagctcatgcctgttaattccagagttttgggaaaccaaaacgggcagatcacttgaggtcaggagttcgagaccagcctggccaacatgctgaaaccccatctctactaaatatacaaaaatcaactgggcctggtggcaggtgcctgtagtcctagctactcaggaggctgaggcatgagaatcacttgaaccctagaggcgtaggtgagccgagatagcaccattgcactgcagcctgggcgacagagggagactgtgtccccctcccccaaaaaagtcaaatttggatgaaggactaaataaaatagatttataagggactaaaatttcaacactggaaaaacccttagatgttacctagcttgatgatgtattttataaaggagtaaactcagattctattatctttgataactacagttctgttttccccacacttgttttccaaatttttacagggttccagtttagagaatttcatgatcattctggcatttttatgactcttccttagtttttagaaataaattggaggccaggtgtgatggcttatgtctgtaatcccagtaggaggctgaggtgggaggatcacttgagcctgggagtttgaaacaagcctgggcaacatattgagaacttgtctctactaaaaatttaaaaaattagccaggcatggtggcgcacacctgtggttccagctactcaggagactgaggcagcgggatcacttgagcccaggaggtcaaagctgcaatgagccataattacttcactgcattccatcctaggtgatagagtgagacactgtctcaaaaaagaaaaaaagttgtaaaataaactaaatacaataagttaacaagaaatttgtgaatcgtaagttcaattcagaaaagactgcataaagaacaagagaacatggctgggcacagtggctcatgcctgtaatcccagcactttgggaggccatggcgggtggatcacttgaggtcaggagttcgagaccagcttggccaacatggcgaatccctgtctctactaaaaaaacaaaaactagctgggcatggtggcacacacctgtagtcccagctactcaggaggctgaggcaaaagaatcacttgaacccaggtggcggaggttgcagtgagccaagactgtgccactgcactccagcccggctggagtgagactccatctcaaagagggggaggtgcggggccggggctggagctgggttcggtggctcacgcctgtaatcccagcactttgggaggccagcacgggtgaatcacgaagtcacgagtttgagaccagcctggcagcttgaccaacgttggtgaaaccctgtctctgctaaaaatacaaaaattagccgggcgtggtagctcacacctgtagtcccagctactcaggaggctgagacaggagaatcacttgaacccgggaggcagaggttgcagtgagccgagattgtgccactgcactccagcctgggctggagtgagactccgtctcaaaaaaaaaaaaaaaaaaaaaaaaaagtccaggcacggtggctcacgcttgtaatcccagcactttggaaagccaaggcaggcaaatcacgaggtcaggagttgaagaccagcctggccaacgtggttaaaccccgtctcttctaaaaatatagaaattagccaggcgtaatggcgggcacctgtaaaaccaactactcgggaggtggaggcaggagaatcgcttgaacccgggaggcagaggttgcagtaaattgagatcacaccattgcactccagcccagctcacagagttgagactccgtctcaaaaagacaaaaacagactgggcatggtggctcagctctgtaatcccagcactttgggaggccgaggcgggcggatcatgaggtcaggagatcgagaccatcctggctaacatggtgaaaccccgtctctactaaaaatacaaaaaattagctgggcgtggtggcgggcgccggtagtcacagctactcaggaggctgaggcaggaaaatggtgtgaacccaggaggcggagcttgcagtgagctgagattgcaccactgcactccagcctgggggcagagcaagactccatctcaaaaaaaaaaaacaaattcaaatccagtactttgatgaaaaggaaaacttggaataggagaaagtatgagtcagagagtaatatgtaagttttattgatatgtgcacatttttaggaggactgcttttcttttttttttgagacagtgtctcactctgttgcccaggctggagtacagtcgtgcgatcttggctcacgactggctaatttttgtatttttagtagggacagggtctcgccatgttggccaggatggtcttgaacccctgacctcaggtgatctgcccgcctcggcctcccaaagtgctagaattataggtgtgagccactgcacccagcctttcaatttaatgcaatattttagctaccgtgctcttttacaacggtttttttgtgaagatggagtcttgctgtgttgcctaggctggtcacacactactgggcttcaggaattctcccacttgggccttccaaaatgctgggattgcagatgtgagcctgcacgcctggccctagctaccatgctttatggtaaaaggagtattgggagccttttaaaattaccaagaatgggtataaaagttttaaatggatacacaagaataaagaagtttgctgtgaaggccaggcgtggtggctcatgcctgtaattccaacactttgggaggccgaggcaggtggatcacctgaggtcaggagttcgagaccaacctggccaacacatagtgaaatcccgtctctactaaaaaaaaaaaaaaaaaaaaaaccaaaaaaaaaaaaaacaaaaattagctgggcttggtggcacacgcctgtagtcccagctgcttgggaagctgaggcaggagaatcgcttgaacccaggaggcggaggttgcagtaagccgagattgcgccactttgcattccagcctgggcaacagagcaagactccgtctctcaaaaaaaaaaaaaaaagtttgctgtaagattaattggggctgttttatgagctttctggctggacatatcagaaaactattttgtatcgagtgtgagaagaagcctaacacttactataagcagcatacaatattatcacctgtcatgtccctggttttcttaccatccagatattatctaaccaataagagtgctccctaatgccctttttatttcatttatcattttagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagagtaagtttcactgacacaggtaaatgtagccaccacgtgtttatcaggagtctagagatgtatgagacctccagtgctatgatggatacagtgtgactcagtccccaccttcatggcttattgtttaattaggaatatggcctactgcttataatacaaagcagaatgacttctttttaaaaattatttcttttgagacgaggtctcgctctgtcacccaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgttgggactacaagcatgagccactgtacccagcccatagtgattgctgagaaacagttttgtgtgtggctatagaccaatttaaattgacaaataaaagtcatttgcctttgaaggaagccagtttcttagctttctatttatactaaaaagcttccccattccccaagaatttcagcttttccatagacatctgaggtcttgtcctcttacgattatccttagtatgagtatacttatttgagtgaaagtgtgacttgctgtgccctctggtttcagtgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagaggtaagaatagaagtaagaatttttactagcccacaattcaaactactgtcaaagtagttttgttctgcttcttccctgatattagcagctgtctcttcttagtcctgaaatcttaggtaggctaatgcctacaaagtgagagtgtactgtcatgaagccacatgatctcttactttttatccatggtacaggagcagtaaatggaaaacttgctggggacagatataagggcaagtgaattcattcttgtaaaaaatagttttcaatatttaatcattaaaggtgtgaggtggctattttgacttaatcagtatcttaaagtaagttgttttttgagagtgaagagatagttgtaaacattgattttgcttgggctgtatgtcccttttcacatagggaaaatctcatgcgcttcagacattgatgaataatcactccaaaggattctaacagctctcttacttgagccaaggtattggtgaaatattggcaaaagagtttgtgattgggccgggcacggtggctcacacctgtaatcccagccccttgggaggccgaggcgggcggatcacaaggtcaggagatcaagaccatcctgactaacacggagaaactgggtctctactaaaaatacaaaaaattagctgacgtggtggcatgtgcctgtggtcccagctacttgggaggctgaggcaggagaatcacttgaacctgggaggcagaggctgcagtgagccgagatcgcaccactgcactccagcctgggcgacagagtgagattccgtctcaaaaaaaaaaaaaaagagtttgtgattacattaatcagagacacaggaatggttccagtctggataatagtcccatatagataaaattgttctacccatcttgtttttacagtcagaaaagccacgaggctttgctcgaggtttggagccggagcggattattggagctacagactccagtggagagctcatgttcctgatgaaatggtgagtcggccagtggctctgtgtggttgttttttttcttctcccattggtttcatgccagaggaaaagagctggaccttcgaaattccaatcacccaagtgtgaaattgttaagatggcatagtccttcgatagtgaccctcggcctgactgccaccctggactcatgagttacaggtaggagcccttaggaatcttgggtctttgcccatatttttaggaggtgggagacaatctagagtggaaagagtgtgggaaggaattacatttcacttctgtaaataaagggggagaaaatgaaatgtgattggaccaccctctccttctaccacctccttaataaagatgaggctggccccagaatcagaaattctgctaaattctcagggttaggaaagaatctgtagttcttccttttgtccttaattgttggatccctttcaatttgtgcagattctacaattacaggatcagccagcaggggtcagcaaggctccttaactgctatcaagcatagagcaagcctgcttttttccattatgagtataaataccagtgatagtaatactccatgaaacagcctaatgaagatagttatcccaacaatctctgtaattttcctactctgtcaaaagaaggccattcttcctatttcttgctcattctccccacaaagtggatctcaatgattgtatttaaaatttggaaggaataattctaagccattgccaatgaaggcagcattctagaaactttgtcctttaaaacacacacacacacacacagtctatggagctttgtccttttgtcagtccagaacttactctgaaactcgtgtctgtactaattatcctcttttacagtatggctggaggggcctaactttagcaccactgaaagccagagtcacaactaactaacctattctcttctatgtattccctaggcagttactggagctgcccctcttttagctgatttattgttaacctataagagaaaagttcatttttaagatgctgcttattgggtgggagaagttatactgtgagttactcagtttagctagaatatactttttctgcatgtgaccagtgtgagttacagtagtatctccatattgcttaagattgtactcctttggttgactcactactgtctttttttttttttttttttttgagacagtctcactctttcgcccaggctggagtgcagtggcacgatctcagctcactgcaacctccgcccctccgggttcaatgattcttctgcctcagcctctcaagtagctgggattacaggcatgtgctaccacgcctggctgatttttgtatttttcatagagatggggtttcaccatgttggccaggctggtctcaaactcctgacctcaggtgatccacccacctcagcctcccaaggtgctaggattacaggcgtgagccactgcacctggccgactcactgctgtctacaggttaaaactggatttgattataagacaaagtacattttaaaaagttattttactggagaatagagatttttgtatatttctaaaagtagtaaatatttctggggagtgaaatgactaaatttaactcagagggtgttgttcagctgtcagcaaatggcagcatgcttcagattcccatttccctcccattctcttgggtccattgttcaaaaacatacattatcagcttactcttctgctctatgggactatgtggctctgatttcctgttattaaggttctagagatttggggtggtgctttgtcagagatgtcatcaggtgtctcctgcttgctttacgctactgcttctgtctaggacattcctaataacctgaagataagagtttgttttttttttaaatgagacagagtctcgctctgtcacccaggctgaagtgcagtgaggcgatctctgttcactacaacctccacctcccaggttcaagcgattcttgtgcctcagcctcccgaatagttgggattacaggcgcacgccaccatgcctggctaatttttgtatttttagtagcaacacggttttgccatgttgaccaggctggtcttgaactcctgggcctgcccaccttggcctcccaaagtgctgggattataggcgtgagctactgctccctgcctaagagtttactcctaattcccttataatgtgtatgattttcaaattttgaaaacttttttttttttgagacagagtctcactctgtcgcccaggctggagtgcagtggcatgatctcggctcactgcaagctctgcctcccagtttcacgccattctcctgcctcagcctcccaagtagctgggactacaggtgcctgccaccacaccaggctaatttttgtatttttagtagagacagggtttcaccgtgttagccaggatggtctcgatctgacctcgtgatccacctgcctcggcttcccaaagtgctgggattacaggtgtgagccactgcggccagccacttgaaaacattttaaaattcagaaaactacagctccctcattttctactcccgatgttgaaacatcatttcaaagcacctggaagttatgcgaggatagcatttggaagtgtcagtgtaattacgattatgcaaaaagtgtccatcttcatttgctctggccaatgccagatgtggtatttaatcctattacgggccgggcgaggtggctcatgcctgtaatcccaacactttgggaggctgaggcaggtggatcacctgatgtcaggagttcaagatgagcctggccaacatctttagtagagatggcaaaaccccatctctactaaaaatacaaaaattagctgggtgtggtggcgcacacctataattccagctattaggggaggctgaggcaggaaaatcgcttgaacccaggaggtggaggttgtggtgatccgagatcatgccactgcactccaggctgggcaacagagtgagattctgtctcaaaaaaaaaaaaaaaaaaatcctattacaaagccaagatttctccatgggttcttatcagctgggatatggcttttggaggagtgtggtaacttctcttccctcagagaatctaggtatcctctcttccctcagagaatctagagagtcatgctttttggggccttgcccagatgttcagatgtgattggttaagtccattgacctggcttttgacatacacgaatccccagagggaattttcaacaggagagttaactctgaggatgtcacttgacatacaattgccagtaaatgctgcttgggccacgttttcattgttccctagcctatttttctaaaattaccatttttaaagcactgtcccctgggttatccaacttaggatagaccaccagcacctggtctcaaagtctctctttgctttattctgcaggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaatgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctgatttctgtcttaagtcttaccaggaacccttcttgccttataggttcagcctgttggaaatggcttcctcacttgaatggttttatttcttgaacactgtaggcttgaaaatctagtgcctggcctgaatctttaagtggtcacaccatgttaatttagtaaatacttactgggcatttatcagttgctgcagaggttgtaaagatggtcgcatcatgctgtcttcagtactgccaaaagtttattgagcactctgacctgatagcacttccaaactatggtatatttggaaacatgggtttttaagttaggtttagatcctgcctatggtatgtaatagattatatgaccttggctaaaatctacttctccaaaattttccaggaatttggccctgtgtttgcgcactgatttaaaacgtcattttctgcctatgattttttttttttttttttgagatggagtcttgctgtcacccaggctggagtacagtggtgtgatctcggctcactacaacctctgcctcccaggttcaagcgattctcctgcctcagcctccagagtagctgggactacaggcgcgtgccaccacacttggctaatttttaaatttttttagtagagatggggttttgccatgttggccaggctggtctcgaactcctaacctcaggtgatccacctgcctcggcctgccaaagtgctgggattacaggcatgagccactgtgcctggccttggacttgcctttatttttttttatttttttttttttagtcttgctctgttgccaggctggagtgcagtggtgcgatctcagctcactgtaacctccgcctcctgggttcagcgattcccctgcctcatcctcctgagtagctgggactacaggcgtgcaccaccacacccggctaattttttgtattttagtggagacagggtttcaccatgttggccaagatggtcttgatcttctgaccgcatgatccgcccgcctcggccttccaaagtgcgggattacaggaatgagccaccacatccggccaacttgtcatttttgtaacagacataggatttccactgagaacaaatcagtgtaacagttgagtactactcactcgtgcaaagcatttgtttaaaataaactgatgtgtagataattttttcagaaagcctcctcaggaaagttctcaggagacataagtggagctggggagccttactgaaggtctgggtcacagacaggccttcccgcacagaggtctgagtgtgtgccctggtggtggttgacagtagcacagcagtcggtagctaattaagggagtttaagtggaggtgttctggttctgttctgcaccatcagatgcactgaaatgaaactacagccttggtttgtatcccaaatggactgctagtcagctttggtcttaacctttggaactgactgacttgtcatttgtggcattcctgagctgttgtaaaaactgtatcattctcccccagagaaaacagtaatactgataggcatgcagtgaaaactgagttgaagctaggtagtcacaattttgttattttcaaaagccaattggcatattactagatcagtagtttaaggatcaacttttttgattgttgaggccacaaattcaaactgttataagtaggcacaacaaatcttaggtcagcttgagaaagtattcagagaatatttctttgttttttgttttttcttttgagacagagtctcgctgtcacccaggctggagtgcagtggcacaatctcagctcactgcaacctccgcctcctgggttcaagcgattctcctgcttcagcctcccgagtagctgggactacaggcatgccccactacacctggctaatttttgtagttttggtagagatgaggtttcaccatgttggccaggctggtctcgaacccctaacctcaagtgatccacctgccttggcttcccaaagtgctgggattatagg

SEQ ID NO: 15586 - DNA, 6404 bp, Human
ccatacctagatatggaatatttatccttcttcattatcagggggtttaaatttgttttcttaaatgcttatcaaacactcccacagagtcaggttaggaagtaattggaggccatctagggatggctattttgccattaaggtacagccaagaagttgccctgagtttagagagccttggagaccacgttgcaaccaaataagttcccacccttggtgatccaagctcagtcccctgccaccttccctagtgtcttgtaccatcttcagtgggcagaacttggccagaaaaaggagcccaaaggaaggacaaggcagaggagggtcagcctggcctgacatctgactttgttccatgccctggccccttcttgtccccaggtgtgaaggttgtcacccttcactacttggcctgtgtatgtatattagaatgttgggaatgcactgtggccctgtctcccagcctgggctcaatgcttattttccttggatgaaagagccagagacatacattctctgacacacctaaatttgtaaggcggcaaagctgatgatacaaacacggggtgtgggagggaattgtagcgatgctgagatacagacagaagggagaggggatgctggctgatggctggaagcagcctgctgagtccccaagagaacgcaaacgaccttctctccctatcaaactaaagcaaaaaccaagtcttgggaaagaattaattttaaaaagaactggcagctcctacagagacttagaagaggagtgaggatgcatttcttcccagtggtctctgactgcctcaactatcaggagggttcaaagcccacaactggaagaagaatgatttcttccttgtgcccagatttactgggacatccctgattcctgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgccttccaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacagaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtgggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcaaactgctcctcccctcccccatctagagtctagacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccacccacaagaaagtgggtaaaaagcccaacccctgctctaaaaggctcaaccctgtggctgagccttggccgggtttctttctctcccggcgactgcagggagcctgcagggagccagcagggaggcagccgcccgccgccatggcggtctcacgcccgcgctcccgtcggtcgccgggaggtggcgcgctctgctcagaggccaaagccaaccttctctctgtttctcccccttctccttttttccccctctctcggaggctcgcattgaatcggccctaacgattctcggatcgtcattatttgtaaccatagagcatgaattacctcttgaggtcatcagcgagaatttacgactggtcaacaaaagcacgtgattccctaacgcccccccaccccccttccaacccccccccccatatttggccgcatacatagcaaaacgaagtacagtgcatcgctataattcattaatac

SEQ ID NO: 15587 - DNA, 6280 bp, Human
cccacccccatccacacctctaaatggcaaaaattgttttctttggagcctagttgcacactactgtcgctggccactttgcccaggtcagagcagctctctctgttctgagccctccagagcatgcctcctcggtccctgcagcccccacctccaactcccctttctccatcctcctctcccccaccctcatgcttctactcagacttctctgtccttctttttaagtactcacgcagatgttacactgacagaaagtttctagttccagctccgggctcagttgccatttctctgctaaccagccttctcctcctggctgggcagcagagagagaggagggggaggggaggccaaagccatgggagttctccaggcaaactttccacccaacttagcgctttccctctgtccccatttcccatctgtttcccagctctcccagaatcacccttctcttttgcacccccacccccacccccaggcctttttaagggatgtgaaattttggctgttcgctctgctttcccaaagagccaaattctttgatgcaatcggagggagctgtcagggggctaagattgatcgcctcatctcctctccatccgtctgacccacttatttaaaaatcttcccccagatcgacttttcattttctgctttgaggcctagtttcccaccaattgcttggggctcagagtcttgtgccctctccccatagtaaattacaacactctaaacttcagactatcttggtctcctcaaaataaaataaattttaaaaacattttcccccagcagccagaaatggaatatcatctcagtggtcattatttccacccctaccatcttcagggaattcttccttgtcagggattcttttttttttttttttcttttttcttttttaactagcacaatggcaaaaatgggagggaaagtctctttgtcctaggggaaaatctccccaccacactcatgcacacacataacgctgatctgaactttgagagtgctctaagttaaaccaatggctacctcagttcttgttcatgtccctggatatggatacagatacaagcttgaggcttgagtgggtacatgcacatcttagactctgcctgtttttgggggatgtcacagagaagcatggaagcctgaaagtgaggaaagcaggggtacataaggggcagaggcagtgctgcaaacactgggcagagaagagaacccagaccatacagcgatggaggccagaggcccaaaaatgccccttatgctccatctcactcctatgtgtctgcctgggagttcctgtccatttcccaagatttaactgttgtttttggagggtaacagggatagtggtgtgatgattgtaaatctctttcttattttcaccttaatactgacctttttcaaagagtggaagcctctttcgactccctcttcctccaacgcggagatcctcactcatcttttcctggggaaggggagaagggaaggggatgctgctggccacgtaaagaaggccttaatttactctattaaaatacttggaaaagaggaaggtttctcccttagagtctcttcttttccaggcttctgaaaccttctaaccttcgaaggggatgaggaaaaggttcctctagcttttctggagaaacggaggcattggggagagagcatgtgaggcactggtgtaggaatgggggctcatggtgtcctggtcgtggtcctctggtgtttttgaatcaattaaaccaaataatgctctctgttttccaccaggcccagacgagcgattggcggaggccggtcccgtgaccacgaattccctgtaatttcgctggagtcctgggtttaatagagagagtccccatacgcttgtatttatcagcaatatacaattataaaggcccaaaattaaaaaaaagagagaccgaaatctccccctcccaaaatcgctccattacataaatcggggggggtgcaggagggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcaggtcggtaagcgtggtgggggtggggtgaggggcagctagaagagggggagaaaaagcagtggaaggaggtttaaaaaaaatggtggcgagcctgttggggttccttaccccctccattcctgggatggggaagtagaatatcccactggggttcaggcctggccgctaacagcgtctttttttttttctgtctctctctctctttctctccctaaggctgattttggaagctggttggggaaacgcctttttttctgctagaagaaaatgatttgattgaggttttcacccgtatctgtgtaggggaatgagtatgttgttgctgggatagaccctagaagcagaaaagattcggtcctttctgccccaactctaggagaagaggaagaattcagagctagggaggaagaggggtgaagaacaatctttctgaccctcgctccggttgagttggaaagttccgaattgaggggtccactgggagggcttgggagggggatctgaggttccggcgccgaagggagccgctctccgccccctgcgtggcccgtgggcggctctgaatgctttgccctgacccgggccggggctgtagactagagagggagagaagaaaacccaaaagcagtaaagcgagcggctttggggtgggggcgggggtggggtggcgaggaaggggagaggtgatactggttttggaggatggggtagtccgaactgaggttgggctgagtacacggcccgctatgacgccgagcctgttttccctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaacgagtgtttgtgttgggacctaaactctttccccgcggccccaaggccggtcctcacccctccaggacctgtgcgaagttgattaggttcagcggcccatatggcagcaaagcctccagggccggcgaagtccgggtggtacaaaggtgacccgattgatggccgcttcgcccacggctccggcaaaagtcgggagtttgcaggaagctgggtcacctccccgcccctcagcagagggtctttggtcctgagcgggtggttctggggcctctgcttggaaatagagatgggcaggtcgagggagagagtgtacagcgaacagaggagggtgaaaggagaggaagcctgtggacagtcttcagggtcgtggcgggggcagaagtttactggaattgggaacaatccaagggcttcctaggcttttgcttcttatgaccgaagccggtgtaggacctttttccgaactcaagaagcctagggacgcgaggcctggggcttgagccgggcctctttgggagctgtaggtggctctccaaggagtggagtggggtcggggattttctcgggaagcagggtcccgcacccagggatggtaactggcttcccagtgggcaagaaaagaggccagctgagaaatgtggcgctgccgggacacccatggactcgggctgctggggtttgggagaccatccaagcagcagccgggcgagaagcccagggtggcccggcagcgtcgcgaggcgctggacctgcggggagagaaggaggagcgaggagagcgggagggagacagggaagcaaagacgatgctcaaaatggcgctggggccgggcggcgggcggggggggggcgagggaagaagctgtggccgccatgacagccgctgcaggaggcgccggcccagccgggatctgcccccgcccctgcgtcctcccagctggattttccagaggccagggaagaaggggagcctggggggtcccaccttcgttttagttagtttgatttttttatttttaaagtggagcccaacggacgctgaggacgcgagatggaaggagagtccgggtggatgtgggaagggaaggagagcggcgggtctgcgggcctgggtgtgcctcatccagtctgacttttgattcttcgctgtgggatttgaagccaggccagagctttctctgaatgcagacccaccagtcttgaccaacaacttcattttacgtatcaacaccatgtcctgtctatcccccaccacaccctgcctggttccttgtaaacctggtaagcgggaagcaaggatcgatctcccccatctgcctcctggtttgttctgggaaggtggaggtttaaaggtccccggaaagccatccatcctccttaggtttctttaatatttctcccgctcagaaacagacactacggggctatctccccggcagatgctgcccttctcaaaaagcagtttatttcctgggcctccagactttcccctggaccaacaggaccgggatttagagtaccagtcacccagaggcagcaattgtcaggataagccaggagccaacataggttgtgacacagaggactagacaggccctttgcatattttaaaatgggtccctcagtgtgggaagtacacacctcttagttagctggaacttaatcccttaaactgtcttaatatagaattcatctcgtgcattaatcttacatcatgttaaattgcacttatttctctcataaataaatatagaacaattagatgtgttataataatgtcatgtatcttattttccctcataaaatatataggtatgaaataaattcaatatattaaagtagtaatacacagcttattggcttatgtgtttattttccccataaataagggaatatacaatatattaaaactacgctatacatctcattgggctgtgtgtttatttctccataaaatat

SEQ ID NO: 15588 - DNA, 6707 bp, Human
cactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccacccacaagaaagtgggtaaaaagcccaacccctgctctaaaaggctcaaccctgtggctgagccttggccgggtttctttctctcccggcgactgcagggagcctgcagggagccagcagggaggcagccgcccgccgccatggcggtctcacgcccgcgctcccgtcggtcgccgggaggtggcgcgctctgctcagaggccaaagccaaccttctctctgtttctcccccttctccttttttccccctctctcggaggctcgcattgaatcggccctaacgattctcggatcgtcattatttgtaaccatagagcatgaattacctcttgaggtcatcagcgagaatttacgactggtcaacaaaagcacgtgattccctaacgcccccccaccccccttccaacccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcagatattcccctggatgaggaagcttcacatcagccatggtaattctctctctcttttttgtcttctcggctttccttctctgcgttttggggtgggatgggggggacaaggagagcttggctttaccctaaatatagattcatttttctaagggggagaagtatctaagaggggcctcatagcttcgtagacagagccaaaaagggtctctctgttaagaggggggtatttttaataatttgtttccagcttcggcttaggtttttattagcgcagctgaaccagctttaggataaaggatggggttcatataatgtggggaagggtcctgcttacccctgaaattttgagactgtcgctagcaaagaaggggtgaacagtaaaaggagctttccggggcaaaagtgcaaccgctctcctccctcccggggcgagcggccgcctgagcccagccaagggtgaggcactaggagcgagcaagagacaaagccgggcgcactggctgcctgcagaagtgggggatgcagtagaaaggggtgcagaaatcgagcttgaatgtgggcatctggagtagagaggattggagctgtggtgagctgggtgccgggacgcctgggtcctgctcccccgccccctcccacccagtgccccctcccttaaccggaataatgttgccttgcggctttcctctatctgctccagatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttgatcttaggtcttcctgtggctccctctctcctggactggttatcttgttattattgttaataataataattattattattttccttccatgctcccaactcccttctgcttgtcccaaatccgccagtgtttctgaatgtttgtgtctgtggttgcagtctttcccccaggaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactccattgcccttccacttgtcttttctccgaggggtctgcctctcccatcccgggcacaccctgcaccattctcaatagatctggggtgcagggaagaaaaagtaggctgctccccaacaactcttctcagccatgtaagtcactggcttggtcaacagtgcttgggccagggaacagaccttcatgcctgggggactccaaggcccagaaaccccatgtggggctggggcagaggaaaggctgagctagacttcatcctggtcttccactagctggccaaggaagcctctggaaaactcttctgggaaagtaatttgggcctaagtcctcagcaggaggctcctggccttttgggagtggtagaggcctgcccagccccctgtctcctactccaagtcccaattcagctctgccaccaactaaagcaaaaaaaaaaaaaaaaaaaaattcagctggatttcaaaggatttctctcaccctcagccttccctacccttatcaagggctccttctctccaagggcccaactgatcttccctcttgattaggagttagggtcctttcagaaagacccctggttccctttcagcctggcccagggctagggcccagtctacctccatccaagtcagcctccaccctgagcacaagagtcaagtctggacacttacccggtcaatcccttccagcttggcccaacttcttactggacttggagggagggggagctggtgaggaggaagccgagggtcgtggaggctctacttggccctcctttcccttcaccccttgactttgtctccctttgtcgatagcaaactatcccaaaagtcgctatgacatttagatgtcaaatggataggggttttatctcgaagttagatcgtaaaaatcgccgagaagtcagacagatacccctcactggctcgagaaagtcacgtgaggtccataaagttagttttatggttttggggagttgacaccgcgcagtatatttcacattctccagaatgttaagtgacactttaactgctcgctgtggtggggaagggggcagaggtaggtgagcactctcccagcctggagcagccggaccagcccagaaggcagcggcggcccaggccagcattcccgcagtaagtcgctttcagctttcgcttttaccccttgcaattctggggcctgggactgggggaagaaaacttgtttccacctggggctgtggggtgatgtaggggaaatttagcctgttttatgcacccagttctaagggactgggtgcctgaaatgagtgctctcagtttcttaaggcctcatcggtcgggggtgcctgatttttaccaacaggagtgtctgactttgtggggaaaagggtttgtgtgggggatccatgctccctcagtgccagcggaaatttagggaccaggaaggaggggtgtatattgctgaaagaaggggccattggtgggggccacttcactgctggatatcttcagacaactatccccccatcctccggaaagaaactttatgacattcatttgtcggaggtgtgtgggggtgcaccgctgggcacttttatctggatacatctgagctgagaaaaagcaccgggtaggcggctgctgtgggctaccttgccctggggtgatctctggctttccgatctttgaagcccataaaaagaggtccctccggttatctttggcttcatcaggcttctctgggatggggagcacagcgctgcttttgcctccaccttcagcctgttggtctcaagctaatctttctccttggctcgaagtaggatcctgaagtcagactagggagcagacagagagggcaattcccccaattcaaaacctaattcctgaaccaggagtgggggaagggaagagcttcttctcttgcctagaggtgttaggtgtttaagtagaactctggcaagccctcctcaaataaaatcagctcaagaatacaaatccctcaactgtcgggaggaa

SEQ ID NO: 15589 - DNA, 5484 bp, Human
tgacagagtaagaccctatctcaaaaaacaaaaacaaaacaaaaccctccccctcaaaaaaacagagttgggctaggcccacaattattagagaagagaaaggcagtgtgatgctggtggtatagagcagaaagcaggagaggcagctacggtaaggccaagcaaaacaagagggaatgggagacaaagatggaggggcaagacacagactgcaggggacaactttggggtcccttgcagaggaaggagtattcgccctgccctttttggggtgtggaaacctgagaagttttgagggtcctccttaaacctgtcccacctgcttccctttcctctcctgagctccgttgtttacagagatcactccctgaactcttgccctcctggacttgccctagcttcggccccaggcctccggccaggcagacaccctgacaggttacaaatgagcgtgggtgttggattgccccaagctcttgccctcaagttgtccggaggaggagagtcaatgggctctacctaagggcttctcttctagtcccatctgggtttggagtctgagagagtgaagaagacacatcctgtgtccctccgcaacagccacacagaacaaaaaggggcgagactccactcctcactctggagtcttagaattcagagcctcagggcctccaccccgattctcccactctctgaccaaactccctttatcaatcctagaaaaattactgaaatctggaggaatctttaagatttaactggtattaaatttatgcatttgaggtttggaaattttttttttttggaaggagatggagggtggtgaaggagagacaggtaggagggaaccaggagaatgcaggtctccactagttttaaacacttcaagaagagaataaaaaattcccctcctcttcaccccgctgtaaacatcacctggctgtgctcattgtggctctctagagagatatagggagttatttaagtctgagtgagtgagccagctacagctatggatggctagagagaggataaatacatctagagagatgagaggtagggaacgaatataaatatggagaaagatggacgaacagagagatggattgagacagagagaatataaagagaggctgagggagagaaatggatgtgtgaatgaggagagagcatttatgcaaagagagagagagggaagatggggcatttctcatccttttctccacatttctgtagtcctgccttgctccctgaaatgccaatttcccacccctggcttcatgaattcttcctctagattctagatcctgccccacacccttaggtgtttttgcaccaccttcccccacctccccaccacacagtcatccatttggcccaagataacatacctcacccggctgtcctagcccaccaccctaagacaaattggaagaaaggaacatggtttgggagttctgggcaaagtatggaagctggattccccacctccaggtccacagacttagggggaaggtttctctgaggggtgggaagagtgaggggcagctggcttgaatttgtccaaatctaataacccaggagcctattgaaggccttgggggttgggagggaaggaaagtcttgaatattctcctaactttttccccctctccctctggtcccttctttccaaaagtctttgaagaaagatgtttttgacgcttccatgtcgctctcagatggatgggctgcgggtgattgaagtgtctttgtcatgctaatgcttggggggtgatggatgggcgctggggctgccaaactctggcccgcttagcccattggcctgggagagatcacatgtgccccctcacccccactccctacccccttcctagggaagcgcttgcccaggcgagcgggtcaggccatggattcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctctgcgccctcggggtatgctcctgccgcctgcagccccagctacgggccttctcagtactaccctctgggtcattcagaaggagacggaggctattttcatccctcgagctacggggcccagctagggggcttgtccgatggctacggagcaggtggagccggtccggggccatatcctccgcagcatcccccttatgggaacgagcagaccgcaagctttgcaccggcctatgctgatctcctctccgaggacaaggaaacaccctgcccttcagaacctaacacccccacggcccggaccttcgactggatgaaggttaagagaaacccacccaagacaggtagggctcagatgtggccaccccttctccggggcccaaagcatctctgcttcccctgcagtgacatgtcctgggtctgggctgggttcttctctttcagcggctctggtagacacaggtaagagcacaacctacgtctcaggtcaggtgaggtctccccacccagtatgtaaccggtcaccccaggagtaagtttccatacacaccccacttcctgatctgtgcacccagcacagacccaggacctggtgtgcatgggggatggaagtatggggaaggctgctccagacttggtgatcaccatgggggtacctggtggtccctgggaactttgacaactgtacttgggcagaatggcaaatggaggtccagagccagccccgggaggagggaagcggaaggagaaagaggtgagagaattgacctggcctttctccctgccccgcccctagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagagggaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttattcggttcagtgccttcgagctttgaggagtctcctcacgcactcttatcctaactcccccttctaggcctgacacagaaccttaaattttcttgtgtgggaggtgtttgggtgcagccatattattatcaatgcttaatccagtcaccacagaccttacaatagcaccagctgccttgtgacagaccaaaaagccccccgcccccatctaaccccattagccctctcctggcatatttatattgcactaatgcagccttcagaggttgttttctgagacctgcctcctcacaccagcgacctcatcactatgtcaccaaagtgttttggaacttggtattccagagacttctggaacgccgtgcaaggcctgcccccagcaagccacaaccaggaaggtgcaggcacgcccccactagctcctcccctatttattgcctcctggaaaacccaggaccctcttccccatctccacccctacccctgggggcagcccagggagagccaggcacaatgagggctcccaacagctgcaaggatttatctgaacctttgagaaagaggaggagccatctaagtttctggaaacctgagccccaagtgagcccgggttctctctgtacctgcaactacctcatttcaataaagtctgtgttttcccttcttcctgcctgcttctgtttctccattcaggggtagaagaggcctcatactccgtgcaccgtggagaagaggtgaagaaagagtggccattggctggttgggctggaatgaactgagctttaagatctcagctggataaagagaaggacttactgggtgtggcctaagcaggattgggtcccaggcattcaggcttgacagttgtcagtcccttggttattgggagaatccagaaaagcatggaagaagtctgtggaatgaatgcaattcccagagatttttctttttcttttctttttttctttctttctttctttctttctttcttttcttttttttttttttttttttttttttttttgagacagggtctggctctgtcgctcaggctggagtgcagttttttggtttgtgttttgttttttggttttgtgttttggtttttgtttgtttgtttgtttgagacagggtctcgctctgttgctcaggctggagtacagtggcataatctccgttcactgcaacctctgcctctcaggttcaagcgattctccacctcagtctccagagtagctgggaccacaggcgcacaccaccactcccggctgatttttgtatttttgtagagacagggttttgccatttcgcccaggatggtctccaactcccgggctcaagtgatctgcccgcctccgctttccaaagtgctgggattacaggcgtgagcccccgcgccgggtcagcccagagggtcttgagaggaagacgggaaagaagagaaacatctgtttggagaggacaaaaagagggtgttaaaaagaggaggaagtgtgggggaaggcgacgtgaactctaccccttcccttccccctcacctgcctccctcccgcccagagccaggcctggcttagactccagaggggtcgctgacaaactccaaattggcacacagcttaacacccccactcccaccccagcccagcgcccttccacccagccactcctcggggacgtcaggagtggctgcctgagtccggccgcagccggccagcctccgcaaggcctttccgcctgggctcaaggtgaaagcc

SEQ ID NO: 15590 - DNA, 7786 bp, Human
agctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgtgtcctcccaagatgtgtgtcgggaggtggggtggggggcaggcataaaggtggagtgcaggcctgctgagcatactttttttccctcggactgttgttgttgggggagcaggaggagaagggagaccgctcttccctgcctctccctctcagggacttggccaccttcgctctgttctgaggccatggctctctgccttccttccttcgctgcctctgcttctctggtagtcacgctccactgaggcatccgcctccgggaaccgggagagcagcgcgcccgggccaacctccacccttcctttctctccccaccctcccaaccccctttttcttttactttcaaacctttttttttctttttctttctttctttctttcttttttttttttttgccaccagaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggcagcggcccttgagcccccagccccaatccacagggctcggctttcccattcattattgatcatattttataaatccaacgccacacaattttttccacattaccgggagccgtggggagacggcccggccattggcggaggggacgtcacgtgggcggggtcacgtggtccggagaggaaaaagggggtcctttttggtgtaaatctggactctaattctgtaatatatcaaggaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggtaacgccgcgcaccgagctgtcctgagccccaggggccggggcacattaccctgaaggcgcctccttcccggctgggcgcccctttccgcgtccagagtgctcccagccggaggtcggccctggaaggctgcacccactgggccgcgacccagcaggccatccccgcccccatatttgctcggtgctctcaggctcgctctgcttcccggcggatctctcttcgccggcaccacggcgctgcgagcccccagcccgcccccacccttcctctcggccttttagctttaaatatttatcagcagcgccggcacgggctggagacgaggccgtttgtcttgcggaggaaggccggtgtttgcagagaatagccattagggtctcccccttctccccccttcccagctaaggatctcagccctgggtgtgtccccctgccccagctcggataaggtatgggggagggggccatagcgctaagcaattctcccctcccccttcctctccagccaaccccgctcccccattattcccatcaggacaattagaggtgggctctagaggcctggcgggaggagaaaaggacccagccagggacacagagctagagaggcaggtggagggagggggctgaggccaaaggagatgatcctcctgatcccagtgaacctgggtgggggagtggaacaggagaactagaaaggggcagaggcttcatgggagtgcagctggcttcctgaggtgctcttcctagggctcctaggaacccctaaagaactggccaagtttggaggtgtcattccagataagtgacccttttcttgggggaggggctaggactctctggagccaattcaaaaattagagagtgcagttcacctagccagctgctgcagaaccccaagaggctgaggttccatggggtccctgccgagtctgacccagacatccttttctgcactgttccaaagcagacgaacttaggggctagccccaaagtccagaagacccaagactcatggtcagaggcacccaacccagcgatggtcaggggccagaagcagcccagctctcataccatcagtattagtggttataggtcccattacctgctccatagtttaactgcctttccagttgatttatcaaagccccattttttctgctcatcagcatttcagcttggcttttatctgacttgaaactagggcccctagcccctcctcccttgtctccttcccaggagggctgacatcagcacctctttaaagtctcctcaggttctggtcctaatgcagaagttcccctctacccttcagtccccaccacccagatactccatgttccatcctatcccaggctgctgtctctccttttcccctgtgcattcctggaggcccaaggattgctttagagagctgggctgtctaggcaagcaggcaagcaggacagcctggccctggctgaagcttagccactcactggaaaagaatcatcagagggtcactgctgtcagaccaactctttgctccaaggaaatctgcaaattcttaccttctcattccacaacatgctggggatgagttggggggactgggcctttgaggcccctttgtctccttttcttcttgggaaacgttcttaagctaggcctggcgccccactccagggtcacttgcatggtttctcttggtctctactggaaagaccatcagatcagcattcagaaaagggggtttagggtccttgaccccagagagtgaaaggaggattaacctcccctcatcccacttgcaccccttaggtgcagagcctttaagagccagcagattactttcctgggttcagaagctccaggctaaaaaagacttcttggatgaaaaatgggaatgtttgctttgagaagcctgtagaaagttcagcaattaggggagtttgcagctggagtaagggctggggtatgaaaagccagaatttggtttagtgggaaaatgggcttctttgcccatcgcccattgacttcaaatcacatacacggtataagagggaggtggccactctcttggcgtttcctttttttttttttttttttttttttgagacggagtctcactttgtcgcccagactggagtgcagtggcgcaatctcggctcactgcaagctctgcctcccgggttcacgccattcttctgcctcagcctcctgagtagttgggactacaggcgcccgccaccacgcccagctaatttttttgtatttttagtagagacggggtttcactgtgttagccaggttggtctcgatctcctgacctcgtgatccgcccgcctcggtctcccaaagtgctgggattacaggtttgagcccaccgcgcccggccggcgttttctttactcactgattttcctctgaatactgtgtgcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaacagatgccctattttctgtgtcttcctaaagctgggaaggggttcagggttagagatgagtgggcatcccagagctccttggctctgacttctgatgcagcttcatttctgtgctgagtttgttctttttcttggtgcctcctgctctggggggctgccaagtagtgaaccccgatattgcactcatgcattccctttacacccttttacacccattgacatacatgatgcacacagtcacatgtgtttacaggctgacatcaaacatacacactgtcacagtcacaaagagacactcatacccatatgttaacaaacatacaggcattcacgtaataccagcttcacgcccagaacataggcattcatgttcacacacgctcacaagtaaacacacattcacactcacagacacattgataccaacgtacattcacacattggcttataaacacagattcacatttgcccccaagtaaacgcactcagaagcccacatgcttagtcacacaagctcacaaaacaacaaaacaaaaacctcacagtttcacaaacccgcgtcctcattcaggcctggaaaccaagctgcgggatctggatctgggctgcagcccaggcacaaagacggagctgaaatccaagctgctaggccccacatgaaggaagagcggaaggaaagggaaaatgaacacccaaattcactctggcttcttgggtggcgttgcgtagaggccaggcctgggagtagaggcctctcagtcggcgcagagcagcctccaactagggcgctcacggcttcctgctcgcacggcaaacattttcgccaagagctattcctatattttatttcgatttattttactttctttgtcttaatttatctcgttctaaattgatacagacgacccaaataaaactttaaaatagggggtggggaagggaatgagtccgggagcaagatcctaagaggtgcgagtttaccaggccggtgtggccgcatcccggccgctctcggagcctgaccacgccacgcccggggcttcctccgagcctctcttcccgctctctgcgccgccgccggcagcctggaaccttctccgctgcacagagagagaggggggaaaatgttgggggaggttatttcgtttccagaattcgggcattggtaggtcaacttgaaatacggggttatttcaggggacctgaaaaacctgggctgaatttttattttattttttgcttccaaacatccgctgattgcaggaccaaaacttggaggatggtgtctatgcggctagacccgctgaattgatttttagcatttattcgattataaactctggattgtttaaatttaaacagactttggatagaaagagggaagagggttggttttaggataatctgttgaatttgaatttgtatgtaaaatgcttttaaacctgcagtttcccccattaatgaccacgtaacgccctggagagcgcatggagctgtcataggaaacctggacttgcctgcatttgggcgggagaagccaggatccggctttaccctcccccagtttctgggttccggaggcgagaatcaggttgtcagactatctgccttggcccccatccaggccacttttcctcctggggcaaaaactaagccctagggaatctaaggcccccacgcctgcaatgctgcaagcctcacaggtgggggtcctgctgtctacagggctaggaatgagggggccagttcagagggggagaggggacactgaagctttcattttgcccttatgcaggtggcaactctagacaccgtttcctgctcctgcctcaccccaaaattgtctcagaacagtccctatgcagaggatttggggtagacctttactagaagagggagcagagctcctgtggagagtggggaggttcggaaaagaacccccttcccagctgtaccgttatggtttttgcactctgatttcctgcccccccaaatctc

SEQ ID NO: 15591 - DNA, 6588 bp, Human
attataccaggaggcctagtgactagctctggaaagcgtatagcattggatggctgaggggaattaagaaattcaagtagcagtcaattaaaaaaaaaaagatgttgacatagcatggtggctcacgcctgtaatcccagcactttgggaggcagaggcaagatggtggctcaaggctaagagtttcagagcagcttgggcaacagagtgaggctctgtttcaacaacaacacaaaattttaaatagccaggtgtggtagtgtgcctgtagtcccagctactcaggaggcttgcttgagcctaggagtttgaggttacagagtgctatgattgcaccactgcactccagactgggcaacagagcagaacccttttcctaaaataaaaaaaaacaatggcaaatacacatgcttatttattatatatcaacagcacctttcattaatactagcacacgttccatagatatttggtacaagtacaatatatctccactcatggcattctggtaaagtgatggtccatgttaaaaatagctcattatcatgggtaaagggacttacttaaggctttatttcatagaaatcaggcatggctatcaagaagaacagaaatgcctggaaaacagactccagtgggtcacttcttggaaagaaagtttaatcagtattgacaaaaaagggggaacatgttccaggactatttgtgttattgaaagcaaggaatatagtgattgaattaaaaggggagaaataaaagcagatattgcattgcttcccagtggaaatactgtttgaatcatgtggtaggctgatcggactctattctggggtttcagttttctggacgtgtttctttttcgtatcctaggctgattcatgatagttttgaatgatagttatttttcaatttttcctttgatccccgaagactcttatttgtgtcaatctttatttagcctggccatcaattagtgtaaaacaaggggagatgatgtggattcaataaggtaagaaactgactagccagcgtcacacacaaagttatcaaacctggttcttagaatccacgttctcatgtctggctctttgttcaaagggaaaaaaaaatcaataggatggctggagggagacatttccctatcctcattgaagactgatgagctgtcagtctattacgtggtatcctgttgaggaacatgtgaacaattggaagagtttatctgatgactgaccagttgtgaaatttagcacccattaattgattcttaatgtgagaggattaacttgggaattgtgagtttctacgtgtggaaaggaaaacatattccctttactcagttactgtgcaaaaatcaataaccccaatttgcatgtaagtaagaaacaatatgtcccttgctcaaaaaaattaacatccttctagctcttcctttcttctccttacaactttgatatacttcttcgtgtgtgtgtgtgtgtgtgtgtgtgtgtgtgtgtgtgtgtgtgtgtgaatagccttcctaaaggcctgggctttttctaaatgtatgcctttaatttttatccaaaaacttctcttacagcaacatgtcttgtctattctattccagcacaaggcagatgcacagcaaatgtgagctgactctagtccttcttctgaaaacagccatgggaaatttaggcaaagaatgtgttgtctttgctaatactgctctttaagccccagacatagctaaactcttagctaattaccccctgggtcccaggctttcactggggccttttaaaatacacaaaaccaaagtgacggcaggaggccattagcactacataattcaagcaaacaataaatgtgtttattctgcctggctactgaccacctgccttcccatcccgccaggcaggtatctatatatacgatttcctttttcccagtcctgcagagaatgagcctctcctttgggcctcatcatttacaaaagaagcttgggcccctgacagcatgcatctcctcttatttcagctgctggtactcctgcctctaggaaagaccacacggcaccaggatggccgccagaatcagagttctctttcccccgtactcctgccaaggaatcaaagagagcttcccacaggcaaccatgaggaagctgaggagaagccagatctgtttgtcgcagtgccacaccttgtagccaccagccctgcaggggaaggccagaggcagagagagaagatgctgtccagatttggcaggttctggaagaagcctgagagagaaatgcatccatccagggactcagatagtgagcccttcccacctgggacccagtccctcatccagccgatagatggaatgaaaatggagaaatctcctcttcgggaagaagccaagaaattctggcaccacttcatgttcagaaaaactccggcttctcagggggtcatcttgcccatcaaaagccatgaagtacattgggagacctgcaggacagtgcccttcagccaggtatgtgttctggggggagagcaggtaagagtttgcaggtggtagtggacagctgggatggatggagagtaggggaaaaggctgtcaggagcctgactctagcttaactacagatttggtccttgggcattcatcataggatttggcaaagattaagtttccttctggcctttccattttttcttggcattgtggaaatgctgcaagaatgatatgatgatactgtcaatatcagtaatcattcattcacactgaagacacagagctctgttttatttatttatttttgcattggaggtgatctactcagagatataagtcagactgtaccctcagttaggaaactgagaatttagagtaatcaccagaactcctctgtagctatctttctgcactctattaatatgtggatgagcaggtcaactccatttgttgataaagtggggtgcattggactccttcccaaatactctcatatccatttacgatggtcttaatccccatagtccatacttaattactttataggtttatgagggacttctttaatagcttgctaaagctatcccacaacctcaaagtacgttgaggttctcaggcaaaagttgtcatatcatttctagtattatgatagcaaaaaagtgattttctttcacttattttctcatatgagctttttaaaaaatcaatcttgatgtgagatcatatctcctccccttagaagtacctttctcctgattcatgttgtgttggctgatttgtagttattatgatcaattccatgctattaagacaaagggacatcctactgtctacttcctctggcaatatctacattccaaatgttaaattaaaattgagaacttgcattaggtccttaaacatgaagatattgaaccaaaaacatgcagggtagagtaaaattttatagtcgagtaatgctacccaattaagcaagcaatagaatagggcaattgactgttcaaggcagttaagtattctgcctgaaaaggcaaggatatgtagcaatggcaagtcaattatcaaataataatgactactctgttggccatgtgcaattagaaaattacccctaagaatcaggcaatcaaatttcttttgaaattcttcttttgaattctattgctaattaaattaaaactaagatgtttgactcttacatattttgaaaggcatataaagctaggtgcttggagttatgagaggtaaaggtgatgtaatatacaatgatttgcaggcatatgcattgtaactctgcttgcatacaacttcatagacttgaatgtactacaggtcttgcagaataggatagaattaaacctagaatgttctgatctattctacgatcaatgtaacaaatatgtattgggagcctactatgcacaaagccctgtgaggaataaaaaagtaaggcacattacttatgtaagataattaccattagaatttttcaatcgctcacatccaattagacaaaattgcttaaggttttgcacgaataatgtagagtaaaatattttttatgttaacttagggattccctaaaggctgtttaataatttactcaataaagaaaatttaattgaggtggttctgtgcccttatagataccatcacttgcatattgcaaattgtatccaaaattggaaagctttgaaatttttaaattatcctcagatttacagtccatagcttctgcattatgtgtgttaaagaaataattcaaaataacgtaatggaaatgtgtttgctttttagactataacccacgaaggctgtgaaaaagtagttgttcagaacaacctttgctttgggaaatgcgggtctgttcattttcctggagccgcgcagcactcccatacctcctgctctcactgtttgcctgccaagttcaccacgatgcacttgccactgaactgcactgaactttcctccgtgatcaaggtggtgatgctggtggaggagtgccagtgcaaggtgaagacggagcatgaagatggacacatcctacatgctggctcccaggattcctttatcccaggagtttcagcttgaagagctatcccactattacctttgaaaagcaaaaccacaacagcaaagatgctgattattcagtctgaaaatgttaagtgggtacataacattttcagggaaaggtgacttgaaacgtagttttaaattagaacgatagaggaaatgatattagtctagttattggtacacgtttgagaccttgtctcagctctgccactaactagccgtagaatgttaagttgtaaaacctttctccatctaaagattttcatctataaatgacggacccgacctagatgattgctaaaatcctttccactactaatattccgtgatgcattttctccaagtttgggtaaaagccctccatctaaagaaggaaaagaaataagcgagaccataaaaatgggcttctttaatgtgtgtcaaatcaccagcaagcaaagaagcaagatagagagggaggaaggaaggaaggaaggaaggaaagaaggaaggaaggaaggaaggaaggaaggaaggaaggaaggaaggaaggaaggaaggaaggcaggcaggcaggcaggcaggcaggcaggcacgcaggcaggcagggaggcaggctacgtgaaatatttgtaggaaagattctcatacttatagttacttttgcaacccaaacagtgttttacttgacttctatctgatgattaagtctttccacagatgtaaggagtaacttgcttggttgcctcctttttaacaatactcctcatataaagtacttaatgtcaggtctctgactttgaagaaggaacagtgatgttaattttagtagtttatatagggaagaggaacaatcactggtagccaaacaagtacctatattatgaggaaggaaaaatacatgactactaccaggtttagagatcaatccagagatgctaatgaaagtaacccccaaaaattcaatcttcaggcaaaattatttactcacatgcattttgaattaggtagtaaggtttctatgtttgaatgactgttttttgctatttaataaaactttgtattataaattttattcagcaagtaccaaaattacaggttctgaaaatattctggatattttaatgcattaaattttagtatatgaagcattctgaaaaatgttcttatatttttcccttacttgttttgtctcataatttaaaggtactatcaggagataacctagctggaagcatttctggaatgtcttcatagacttatgacactggaccaagggtttcttctgatctgtaagcagccttctgtttaagtctctcaatcacctctctcctgtctgtgttaatttttacacatatatggtacagaactgccttttcccagccagactgctttttctattaagttattcaaatttttgttcctaaaaattattttaataattaggtttcttttacttttagtgcacacacatacacacatttcccagaataactgttttttttaaataaatcaatttatattttaattctattcctctttaatcacaccatctaacatgacattccaaagaagcaaaggcatttatatttagtgtatattttgtaacacatcaacatgaatgtgagttacacagatgcacacatggcatttacattggaatatattatcataccctttggtggtcaaaggcaacctagctggccaagatatgctcataaggataaaattgttaagcattaatgatatctcagctggtcaatatattttggtgccaaaagctatcaaacagctgtcatgattgcaatcgcctaaccctgattatgaaaacctatctctgccaattggactgtccttctcctccttacatgcttgtaaatccgtttcatccatccttgcaaatagactctcaagcccaaaccccaaacaatgatctgttttattcaaattttggtctgcgcttcccttgcatgtaaattctagatgggatagttgatagtggtatcaaaccttacatttatagaataattgcat

SEQ ID NO: 15592 - DNA, 16963 bp, Human
tggtagaaggtatctatccaggcccggcacagtggctcacacctgtaatctcagcactttgggaggccgaggcgggtggatcacttgaggccaggagttcaagaccagtctgtccaacatggcgaaaccccatctctattaaaaatacaaaaattggccaggcgcagtggctcatgcctgtaaacccagcactttgggaggccaaggggggcggatcatgaggtcaggagttggagaccatcctggctaacacagtgaaaccccatctctactaaaaatacaaaaaaattagccgggcatggttgcgggcgcatgtagtcccagctactcaggaggctgaggccggagaatggcgtgaaccctggaagaagaggttgcagtgagcccagatcgcgccactgcactccagcctgggcgatagagcgagactctgtctcaaaagaaaaaaaaaaaaaattagccaggcatgtagtaccagctacagtgtgcctgtaatcccagccactcgggaggctgaggcaggagaatcacttgaacccgggaggtagaggttgcagtgagccgagatcatgccactgcactccagcctgggtgactgagcgagactgtgtctcaaaaaaagaaggcatgtatccaaatcacaaggttaaaagagataaagcatgcgagtaaaataaagcaagccagtcagtgtgggttgcttcttcctcccagtgaaggagctctttgtcagaggtccttggatctgtccaatctgtacctggaaaggttattacctgtaggatccttacagccacacctggcacactctgtgatcactaccaccatctttgttgctattatttatgatcatgattatacaatgggtttcttttctttctttctttttttttttgagccaccgcacccggcctgtatgtttctaaccttcacaaccccaatgtaaataccagctgttctgaatccttcagcctgtgccacataagcacagacccaaaaacattgtgtaacctcagatcaaggtccagaactttgtcccctaacctcctgcgggtctatggatttttttttttttttttttttttttttttgagactaagtcttggtctatcgcccagccttccaggctggagtacaaatggcatgatctcggctcactgcaacctccacctcctgggttcaagcgattctcctgtctcagcctccccagtagctgggattacagaggtacatcaccacgcccggctaatttttgtatttttagtagaaacggggtttcaccatgttggccaggctggtctcgaactcctgacctcgtgatccgccaaaagtgctaggattacaggtgtgagccgccacgcctggcagggtctacggatattattagcatagtcaggacttcaattttctttatcctgaaaaccaggttaacaaaaatccttaggagaaggtaaaatacaccatggtgctcaagcactggggacctggcacgcactaggcgctctgcatgcccacaggagtgctctagacggcttctaagcttccttcttggaattccaatctaataaatgagctaactccgccccagccccttagtccctccctgcaatccacctacctctgcagacatcttcttccaaggaaccttgcttgggaaacccacaccagacacatccatcatggcgtctacagccgcatgggcgtgcgtccctctgtttatatggccagagccccgcctcgctccgcccctttaaacttggtgggcggaccgaggcggggctcagaccaggccccaccccgatcagccacgtccatcgccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgcgggggccagccctgcgcgtggctggggatgaggtggtcgtggtgatagcctgtgtccaggcatccgcgcagggcgggccctcaaatgacctcaccttctctcctaggtgattctcgggccgatgttctcaggaaaaaggtaatggcttcgcggggctggggtggagctccttcctcttctccggggaccccttgtccctcccctcccctcccctcccctcccctcccctcccctccccttccctccccttcccttccctccccttcccttcccctagaaggaccagcacagcctcctacagctcccgcctggggtgctcctcccttgaattcagtccaggaggaagtctctgccctcttctgcccaggccaagcccctcgtcctgtgtggacgccactccctcctggagctggtgacagctgcttacagcttagctgtcttccccaccaagtcctctgagaaggtggcaaccagttgtgtcccctgtaggccaggcctttttgtacacccctattcaatgtggctgtttccttctaaggccaaggaaacgtagtcgctttctaaaccaaggagtctgaagccgtggagcctctgctctcctgaggtgatagaaccattccctgacccgggtggggctagtgagtttcttgagtaaactacccacgcaccattctttttgttttgtttttgttcttctagaggtaggatcttgctatgttgcccaggctggtctcaaactcctgggctcaagcaattctctcacctcagcctcccaagtagctgggactacaggcgtgcacccccccgcctccacccagctaattttattttatttttatagagctggggtcttgctatgttgcccaagctggtcttgaactcctggtctcaagcaatcctcctacttcagcatcccaaagtgctgggattacagatgttagccaccatgccctgccccaacattcttttatggccctggggatcacttcagctcaaaccccttgctcaggaagatgtggctcagagttggacttcttggacccagaagcaagtgcttttgacgctgcacacaaagactttctgaaattaatttagaaaagctgtatgccaggtgtggtggcccacgcctttaatcccagcgctttggaaggctgaggtgcgttgatcacttgaggttaggagtttgagaccaccctggtcaacgtggtaaaaccccatctctactgaaaaaaaaaaccaaaaattatctgggcatggtggcagcctcctgtaatcccagctactcgggaggttgaggcaggagaatctcttgaacccggaaggcaggggttgcagtgagctgagatcgctccactgcactctaacctaggcaacagagcgagactccaccccaaaaagaaagaaagaaaaactctgaactctgggaacaactctgggatgaggttactttggaatgcagtcgcaggttccctctacatgtagcctttgcttctgccttccccactacatcttggagaaggttactcctcccacacttcctgggaccacctgagtaccattcctggacctcttccccatagagaattctgacttccaaccctctttgtagggatattataccctgcctgctctgccctgctcttttctggctgtggtgggctcagtctgcataccactagggacaatgaggagccaggcttgttggggaggggtctccttctcccactcctcccgccgtggacctcacctgaccctctctcctcttgcagcacagagttgatgagacgcgtccgtcgcttccagattgctcagtacaagtgcctggtgatcaagtatgccaaagacactcgctacagcagcagcttctgcacacatgaccggtcagtccctgccccctgcagtcctgtccagtggaaaatcacaaggcacaggacacactgttaggactctctttaatggggatggttaatcatttgaacattgaatgattcaaatcagcacactttccaaggtgcttggcaaggtagcgcacactctccactccctgggctggagccagtggttctccactgagggtgattttgccgccagggtccatttgacaatgtttgaagacatttctagttgttgcaactggaggggggaggggatgcttttgggctttaatgtgtagaaatcagggacactgctgctaagggtcctatggtgcagaggacggcccccatgcaagaacgagctggccccaaatgtcaggagcctgccagtgttcagaaactctgccgtagggtttcagcttcacacaggctgcagactggtttggtttggcctgcacgttgatttttgtttaattttttagttgtccgttgttggctggctcccccgtcacctggcagccttcacgcttccctgttttatgtgtagctgtttgagctcgctggacatttccgcctgcaacctcagtttgggagttaaattcacttccttggcagcagatgtgggcctgatgtttctgagcctgagacgctttgcttggtcctctggacttgtccacctgggcacccagtggcaaagccatgctgtgccacacattatagggcttcagcctcagagccctggctgggagctgtatccgagagttgctatggctgtgcagagaacagatccacccggcgtgtggccttcggtgggagctgaggggctcctgaagccagatgctggtggagtggagggtgcttggggcttggagttgcatgtgggaatttaaccgcacttcgtgaccatgctgtctgatgtaggtcatttacttttccaaatttgcttcctcattcctaagatgcgatgtccacggcacagggtggtgttacacctggtggggacagggaaagcagaggaggtcacttcgttccagctgttggaagtacaacttctggagtcagtcagatccgggattaaatatgagttctgcccgtgtgtcacaagtcatctctaacacgggccacagaggccaaggctgggccagcagcattgatggctcgagaggctgcccttgcaggggccacagctggcctcccacctgccctcactttgtctttctctgtttagggagggaagagggaatttaaaatgcccaaaatactgtttcacacattctttccagaactcgaagtaggattatagcaaggtaataacgaaacaatagttgtaaagtatgtttttttgtttgtttgttgtttgtttttgggacagggtctctctctgtcacccaggctggagtgcagtggctcaatcatagcttactgttacgtgaccccaaacccttgggctcaagtgatcgtcccacctcagccccctgagcaggtgggactacaggcgcacaccaccacacccagttaatttttacatttttttcacacagtgtctcgctgtgttacccaggctggtctcgaactcctgagttcaagtgatcctcccgtcttggcctccccaaagattacgggcatgagctgctgtgtctggccagaatacaggattttaaaaatttatgttttgcaacataattaatataaagacaaatataacccaggcccagttctagttattcattcttctgaattttaaaaggaaacatttggctggcccctaatggtatcatgggccctggtacctgatgaagttggcctagtctgcccccagctcctgaacagtggaagagtttttagtctcattgagctttgtactggacattactaatttctaatccaaagcatcaagtgaagtggcttgtataaataactggttttcctctgggaggctaaggcgggtggatcacttaaaagttaggagtctgagaccagcctggccaacatggtgaaaccccatgtctgctaaaaatacaaaaattagctgggtgtgatggtgtgtgccagtagtcccagctactcttgtggctgaggtgggagaatcgcttgagacccttgagaattgggaggtagagattgcagggagccgagatggcgccactgcactccagcctgggtgacagagcaagactctgtttcataaaaaataaataaataactggttttctggacgagggcctttcccataggtgctaacttctcaaagcccggctgggtgaacactgagcctgctttgcaggtagcaggtggtcacgacagtgccattccctggcccctgcattgtggcttctggcctccctggccctgctcacgctctggctttctcttcccaggaacaccatggaggcactgcccgcctgcctgctccgagacgtggcccaggaggccctgggcgtggctgtcataggcatcgacgaggggcagtttgtaagttggcttgtcttggcatcactcttcctgccagcttccgctctgtcctcccgttttccctcgctgacttggaagttatctgatcttttagtaaaataacaaggttaaatagctacaactagtgttggaataccctctgaaggcccctttctagtttccctgtcatagtgtcatagtcttgtaggattcgttttacttttttttttttttttttgagacggagttttgctcttgttgcccaggccggagtacgatggcacaatctcaccgcaaactttgcttcctgggttcaagcaattctctcctgtctcagcctcccgagtagctgggattacaggcatgcgccaccacgcccagctaattttatatttttagtagagatggggtttctccatgttggtcaagctggtctcaaactcccaacctcaggtgatccgccccgccttgaactcccaaagcgctgggattacaggcatgagctaccacacctggccattgtacctttttaaaaatacatatatctatttactggcaagatgcagtgactcacacctgtaatctcagcctgtgggaggccaaggtggacagatcacttgagcccaggagttggagactcacctgggcaacatagtaaaaccccatctctaccaaaaaaaaaaagaaattagccagtcatagcagcgcacacctgtggtccctgctactcaggaggctgaggcagaaggatggagcctgggaggtcgaggctgcagtgagtggtgatagcaccactgcactccagcccgggcgacaaggccagaccctgtctcaaaaaaaaaagggggaggtggggagtaatgtttggtttgcctcatggttccttttgcttgtttcttatacgtttattttcttgttgttgaagtaccttttttagtagtttttgcagccaggaggtatagatgggaagctgccagtctttgtatggaaatctttcttttgtcatctagtttaagctgggcagcaagaggtaggttgatcttgtgtgggtttgggttttttttttttttttgagacggagtcttactctgtcgcccaggctggagtgcaatggcgtgatctcggctcactgcaacctctgccacccggattcaagcgattttcccacctcgcctcccaagtaggtgggattacaggcacccaccatcatgcctggctaatttttgtagagacaagggttcaccatgttggctaggctggtcttgaactcctgacctcaggtgatccacccgccttggcttcccaaagtgttggaattacaggcatgagccgccgtgcccggcctttttaatttttattttttttgagatggagtcttgctctgttgccctggctggagtggagtgacgtgatcttagctcacagcaacctccgccttttgggttcaagcagttctgcctcatccttccgggtagctgggatcacaggtgcgtgccaccatgcgtagctcatttatgtatttttaatagagatggggtttcaccatgttggccagctggtctggaactcctgacctcaggtgatccgcatgcctcagctcccaaagtgctgggattacaggcgtgagccaccacgcctggtcttgatcttgttgctttgaaaagtagcagcgctggtcattgtgtttttgctcagaggaaggccgccatctctctaatgttacctctggtcaggtattctatctgttctctctcagcacaatgtgtgtaggggaagctttgtttcatttatcctgctttatagctggtgtgccttttcatttctggggaaggaatgaagccattatcacttcaggtatttctctcctcatccatctctgaggtgttctgggttccatcttccagagtgtgttttgtttcagtgactatttttacatctgctgctctaattcatcatgctccgttttgtttgacaagttactgttgggttatttttaaatttatgctgttccttccattatgttcctgaaaatcttttcttagacttttccagatttttctatttcctcaggaacatattctgtggttgagtttctgggttattttctgttatcttagttttctttcctctgctttggagattttatttttgttagtttatcacaaagaatgaaactgaaactctctccaaggggtttagcagacttgacctcttaggtacttttagggttgcctcgaagtacacaatgtggtggtttgatataaacataacaggaatttatttctcgctcacagaccccctacgtggttccaggccggttgatggggaggccgcccacgaggcggcttaggtcgccctggctggctgtatacagacacggaggggaagagacgtggcggagcccctgggtgtgaggttttcatgggcctgaccagaagctgcaaacgtcacttctgctgatctttcaaagactagaacctgggcacagggccacctatacgtttagtatacttagtccagttcgttttttgtttgtttttaaaaacagtcttgctctgtggcccaggctggagtgcagtggcgcagtctcggctcactataacctccatctcccaggttcaagtgattctcccgcctcagcctcctgagtagctgggattacaggcttctgccaccatgcccagctaaccttttgtatttttagtagagacggggtttcatcatgttgaccgggctggtctggaactcctaacctcaggtgatctgcctgcctcagcctcccaaagtgctgggattacaggcgtgagccaccacgcctggccacacttagtctagttctataccctggaggaagaataaatgagttggtttggtgagtgcttcgaggtctctacccgccctgcctcccagcacagagccaggccgctctggcctgaataccctgcccggacgtcacagggcctgtcccctcaaaaggccagtcctgccttcctggttctgttcttgcccaacattctgtatgagtcacagctgcaaattccattcccgtggggaggctgacgggtcccttcccctgtgcggggcatctgccctgtggagttgaggctgccagtgtccgctctgggttcccgaccacccggcagctggcatctcctccccgcttgggtatggccattccgtttctgaccttcagaggtgcgcccctgagcacccccatgcctctgcgtacgtggagacgtcgttgttgctgccccgtgcttgagggactcctggcgagaaagtgagcccaggctgggaatagggctgcagctgttctcttttgctcccaaactgtggcctcagaatgcatccagggattttgcatcagctttggggacatggccctctcagaacaaggaagcttcagctttggcaaggctctccctccttcagacctgccgctgtgagttgttcaatagctctgttctcctggctctgcgtaaaccttgttgacagaggctgacccagacccccgaggcagaaacctttcccttctccttcctcgacatccaaatgccctgagtcaggagccagcgtatgaagtcctgtcccctgttcagcctataggagggatttctcggtctacttcctccctggccagcaagtaaaacttgagttcattcagtgagtatttattacaccctacccagacatcagcattctgccctggcctctgtgtgcccttgttctcttcaagaagttccgggtcaccagcctgaccaacatggagaaactccgtctctactaaaaatacaaaaattagccaggcgtggtggcgcatgcctgtaatcccagctacttgggaggctgaggcaggagaatcgcttgaacccggtaggcgaaggttgcagtgagccaagatcgccccattgcactccaagcctgggcaacaacaagagcaaaactcagtctcaaaacaaaacaaaacaaaagaagttcagggtcttcccattgcaagcagttctagatcgaggagaggggttcctagcatgggacccagcagaaggactgtccttcgctccttcattgtctacgtggacagtggatgaagcccagccgaacctgccttgttcccgttttctgggtcagcagggaaagcctttcacagagtagccaccgtgccatcctgaggaaggccctgggtcagaagcttctgtgcttctttgtaccccgggcgagacacacaggtgctcacactgctctgtagaaactgttggcatccaagagagactcacctggaaatctctggaaaacctgaagctcctagctgggggtgctgtgcttcagatgctggtggtgggtgggcacccttgcatcaacagctgcacagtgtgtggtgggcttgcagggtcgcttggcaatagtaggagctctgatttatttttttaaactttttttctggctgggcacggtggctcacacctgtaatcccagcactttggaaggcctaggcgggcggatcacttgaggtcaggagtttgagaccagccaggccaacatggtgaaaccccatctctactaaaaatacaaaaattagccaagcgtggtggcacacacctgtaattccagctacttgggaggcagaggcacaagaattgcttgaacctgggaggcagaggttgcagtgagccaagattatgccactgcactccagcctggatgacagagcgagactctgtctcaaaaaaaatagacaaagccaggcgcagtggctcatgcctgtaatcccaacactttgggaggccgaggtgggtgaatcacgaggtcaggagatcgagaccatcctggctaacacggtgaaaccccgtctctactgaaaatacaaaaaaattagccaggcgtggtggcgggcacctgtagtctcagctactcgggaggctgaggcaggagagtggcgtgaacccaggaggcggagcttgcagtgagctgagatcacgccactgcactccagcctgggcgacagagcgagactccgtctcaaaaaaaaaaaaaaaatagacctttttgtgttttctgttctactacacaagtaatacaggttgagtattccttaacctaaatgcctgggaccagaagtgtttcggatttcaggttttcgaatatttgcatgttcataatataatgagaccttgggaatgagccccaagtgtaaacacaaaatccatttatgttttatagacatcttaggcacatagcctgagagtaattttatgtatttagtaatttggacgtgagccacagtttttgactgtgacctgtcccatgaggtcaggtgtggaattttccacttgtggtgggcgctcaaaaagtttcagattttggagcctttcaggttagagacatgcaatctataataagtttaatctaggaaaagttagggtctggcacagaggctcacgtctgtgatcccagcactttgggaggctgaggcaggcagatcactggaagtgctggacgggtggggaagtgccgggtgcaagaaccaagctctttgactatggacctcagcctgaggttggtcaagaggtggagtgagtgggggctgaggaccttcatcctgaaaccctgatgcaggagagtctggggtctgccttctaccctcatgtggcgggtgaaggagcaaggttctcaactcaggagggttcttcccctctccattcccacccaggggacatctcacaacaactagaaacaattttgtcgcagctggggggtgggaggtgtgttcctggcatctatctaatgggtgggggcgagggacgcagcccaacaccctacactgcacaggacacagcgagatccggcctcaaatggcagccatggcagcgtcagccctccagggggcgcgcccctggcgcaggtggtgtgccggcccacagctccttgcaggctgggagctgcattttcgtgacatgtcatgagtcctcagagaaaaagagggaacgagtgcatggtggggaggggccctggcgtgctggagtctctgggtttccttctccagagacccctgcagtcagctgagcgcaatcagtcacgttgggctttgcttggatctcactggaatttttcgagccaccccttagtcctcaccttgctaagccctcacgtctcaataacctcaaacctcagtacctgggctgagaaagcctgagtggccctgggagagagaccctgcacccaaggacaaggacatccctgcttcacccaacccaaaggccagtctggacatatgaactcaaccagctaagagtgatatgattgattgatgagaatcaccagagcacttgccagagtttcagcttctccctgggccaaagtgaagtttgctttacacagtaaatgtgctctgtgcaggtcctgaatttagaaggctgtgctgtgtcatcctgctctgtaaatggccagtaggacccccgccccttctcaaggcacattacccgtttaaaacgggggaggcaagagcacaaagcgcccacctattcaccgaagagcatgtatataacttagggccttccatccttaaacaacaggaccttccttgctcttaaggaaaaggaaacaggttcagagacgttaattcattgccaaggtcacacagataatgggtccagcgaagagtggtgtccgagcccaaggcagcaggcctttggccactgcagtgttaaacagcacagctggtgtggaagtccggtgctgagtcctgggtacctggactcggagggaagctggctgcagggggaaggggctgcgcagttgtggatgtacctgtcgtctgctggggggcgtgcgggtggacacagtcccccggcctggggagcctcgtgggagaattaagagttactccgggccaaatggccggagttgtcagatctggcagcgtcttcgctggggctccagggagctgctgctggggtggaagctctcacactctttctccacgtgccctttccagttccctgacatcgtggagttctgcgaggccatggccaacgccgggaagaccgtaattgtggctgcactggatgggaccttccagaggaaggtaaggcgtctgatccaggtctggagctgggattgaggagggcaagaggcttctggatgggcacagagacaccagctctgggtgaccagggctcagccaccacagggttacggccgagctgctcaggccttggctgagccaagggactccatggtctgtgcagactgcgtgccatctgttgcggcaggtgctttgaattggcaaagggacagagccgggcatggtgctctgggggttgggggaaggactaaggtcagagcaaactctcctggcttcagtgcttgtgaatcagagggtttaaaagaaaaacccacctggtaaggtggctgagcgccctctgtctttccatgggagcgcagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggacgcacatttctctttcacctgggtttccctgggtctcatggacagctccaacttgatttgggtggggattttcttccagatctttttttcttttgttttgagacagggtctctgtcgcccaggctggagtgcagtgacgcaatccctgctcactgcagcctctgcttccccagttgaagtgattctcccccgtcagcctcccaagtagccgatattacaggcgtgtaccaccacacctggctaatttttgtatttttagtagagacgagttttcaccatgttggccaggctggtctcgaactcctggcctcaagtgatccacctgcctcggcctcccaaagtgctgggattacaggcgtgaggcactgcacctggcccccagatctttctgtagtaatactgatctcttaaccacaacccttgaactgagaaatgatcatggggtgtgtcctaagcagaacatcatctgccttcctgtctgggccagtgtcaggacaaaaatgggtgtacagaggagcccggggcccagttggaaggaagaggcactgtcctgcccgctgggcctgtgaggtcaggttttgtttgtgaaacaaactcttggtaattcaggagtcaagacatctctcagctgtgcctcagagatgggctgttggcagctcacttgggggcaagcatcgctggggtaaggtgtgtcctgtgcaggcagggtcaccactcccagggcctccccagcctccctctccccttcgctagtgatgtgtcccaagccaaagccatcgggtgaggctgggagcagtgccctgttagttcgtactggggatttttaaacaatcgggacttgccgatgacagctccctctgtcattgctcaaaagaagaagccagaagttgctttagggccttgacctcttccagagatgggccttatctccgaggggtgggctggacggccaaggccgtgtcccaggaaggctccagaggtgctgaccctggaggaaggtagaaacctggtcttacctatggtacccctattcagtgcaagaaaggggcattcaccgacaactcccaggtacccccacccccactctaggaagggagcagcaggaccctggcactgcaggccagaaaaatcatcttgtttacaagctgagcacagttactattttaagatgttgatgaaaggcttgtgcggaatgcgaccccagacagagggaagggggccagccaggcaggctggagggggcggattgccactgccttgttcaaactacaagttccataaagccagcccctaagggtgtacccagagtggagtcttcctccaacccctaggctgtggctcaaccaatgactggagactgaatgagaaaacatttattccgtctccaaacagcatcccaggccgggcatctcccccacgattttataatacactcggcacagacagagtctgggagccatggggcacccctgccctccccaggcttcctaagtaacaactgcagaatatttacataaagctgggtgttgtcaggcaaagcccttccctgctgccaggggtgggagcaaggaggaagtgccatgagcaccagccccgccctcacaccacgggaggcagcccagaggccaccggcacagggtggtggcccccagatcatacagcagtgggcacaggggaagcaaacctgagtgaggacacaagagcctggtccggctccgctgcacagggcaggtgtgatggcccccacgagtctttggcagagaacgcaggtaacagcggctcccacggcctgacccgggccggggggaagctgaggcacttgtcagtagcacatgggcacctgctggcttctagccactgcaggcggggctgaggtcattaaaagcgaggaaaaacactagctaaaaaccctttcctaaaagtgccctggaggagtgagcggctgactgaagccctctgggcacaggcacttggggtgtg

SEQ ID NO: 15593 - DNA, 76118 bp, Human
aacgtagtctctatcaaggatgagaaattgcgcaagaggccaggagggtcctgtgtttccacaaaaatggcaccaaggacagttctttgtagaagtgaaacatatgttttgcatttttctcgtgataatgaaataattcttttttttctggtgccattttcccaaaagtgggaaaataaaacacagactgagtaattaagccaagtgtttaatggaaaacaggtgcaagcttgtgcccaaaccactctactcattcatattacctgcctagcacttgtaggaatgtaagatttccgtcctgtgatgagttccttgaggtcaaggactgcttctttctcttggacgtagttgtagctcctgtgctgggcatcttaccgtgacatccttggcacgcatttgattcactgattcattgcagtggtgaaactgacatagcttgggggccacgaggagagccaccagctgccaggaggagtcagagaagtcttgtgggaagagctgagcagtgttgcacaagctgagtttcctaggcaggaaagtggaaagcagaacctgcgtcagtggagagtcaaagcagccagcgtgttcagggagcagctgtgtggatttttgagagggccttgtgtgtgttgggccagatgaggggaagcagagaggaggacagtggtggcagactccagtgatgaaagcgaactggggagctttgccatcacatctttatgaagcattttatctttggatactggagcctatggaaggaagggtttttttgttttgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctcgatctcctgacctcatgatccgcccgcctcggcctcccaaagtgctgggattacaggcgtgagacactacgcccggccggaaggaagggtttttaagcaagggagtgttgtgatcagagttgtattttaggaagagagtactgccaacaatgttaagaaatggattagagagaagcaagactgtaagtagaaagacacataagacttttgaatctgtcaaggtgaaggtgtcaaattgacattcagaaccaggtgaggggtgggcaggcagttttaggtctcacttcattttcttagcccaagctatagaaagggttgagattgtatgaggagatgagagagcaagaagaaaaggctataatggaaccatggagaagccagaagagtggtgtaagaaatcactgggcaaccactgagaagcagggtttcagacaaagggaggaaggaatgtgaggaagggagggccagaggtgaaccgtgccagtgccatggcgacagatcactggacagggcttgagatgaggcttttggatttgactgaagaattctaatgtttgctgctttcgatttgtctagtttctctcattagattttagtaatacctgggaagaaaacatagcctccacttttctcacacttagtaggtgctgaaccacttctttgcagtggtttcaggagggtcaataaggatagaatgattagagttttcataaagtgttctataagtacaaattattttggacatgaatcatatttgaaaatcaatatgtatatctaagaccatgctttcagactgaaataaaattataagcagtgttacttcaaagatacatctgccatttgtgtttaaaattcactattatagtgatttttttttatttgtttgcatagcctggcacctgtgtttgctctgtttgtaccattttactgctccataccaagagtccaagtggcacaaattctgggtccgttgtccatcacaaacaagacattgatttatatattgggactgcaggtacagtatgcatttttatgttcacttttctttaaccagatcttttttttttttttttttggtctttttctcatttgatctccttgaaaacaatggtttttttccccccataatcttggcttcatgatctatatcaaatgtttaaaggaagtgttacagaacaagaacatcaaggtatagaagatactagaatactttcatagtctttagaaatctgataagagctttcactgtaatttgtatctgtggaaaatattttcatttcattgtacaattgcatgtgcgtactttttaacaatcatagtatgaagtggaaacaaatgagaacaatcaaaaagtagaaagtagaaaatcagtgtcaaaattaatttattgaatacagtgtcgcaaataaagctctgaagaagaaacccggtgtgctctaccaacccgagctttggggttttcaagaagcattgtcagcttgattatttccttgtttgtgaagctgtgatggtagcgtcaccatttgctaaatggtttgctgtgaagactactagagtactactgtccaggttacatttgaaaagcttctttgccaatcctcagcgaatgtcaattgctccctgctgggctccaggtctgtggtaggagaatgattttcagttttctatctgtactacctgtcacttttcttttactctcacggcttttgatgtagttttattctacagcttcctgtgtcaccatgtgtcgcttggccttttgatccactgattaatactcataacattccttatcccacgcactctaaccggatactggcgtcacttcagaatgccttcctccctccccttttaacctttagcatttcctctcacttctccagtctgctgtcatgtgttatcaatggctcatctggggcgttttcttaccacttttacaaccgtttctcatgaaatctttttattctccatctctcaacccccgtaccgttacacgccccctgatcctacctgatatccatgtaaccaaatagcccgtttctgcatttgattcttatgagtaggatttgctatagcagatttaatatttttaaagttgttgtgacagaggccatgtggaattcgaagagcactccagacctccctcaggagacccaagttctagtcctagcatggctgtctccagccatgagacttgggttgagtcatggaaaccctctgagcctcacattcactgtatagttcttccaactctaaagctatgtagaatctttgagaatgaaaacactgttttattaattgtggagtaggagttcagtgtggcattgtggaaagtctttggagccaggttgttgaatttcggtttaatgacttggtctggtaatgatttgctttgtcacttactttttctgagcccccatttccccatctatcaaatggggatgataatatctaccttacagaggtattttaaagatagcatgaagtgtttagtgtaatctgaacagataataagagttaagtcaattggttactattaattaataatttatatctctatagctaccactattcatttttctgagattgtaaatgtatttcttgttttgtttttggcataaagcaagtagtatgtttcatctctcggggaaagggggtcttagttggatgaagaggcacagcatggccttcatcacggggccattgtagtaggttggtgcaaaagtaattgcggtttttgccattaaagtaaggcaaaaactgcagttacttttccaccaacctaatatctagtgccgtttccacagtgttacacagctcaccatgagggatcccccttagccctgccgaaagcagaaaggtagatgcaactaccacggatagtttttcaaaataatataaatttccaatatttttgtaatatttccggtaactttgagagggagaagttgagatcagaaaatagaggtggagatgcctcattgcctccttgataaaatctaggtccttagcatgaatggcatgcagggttcttcttgactgtctggtgtcaactccccctgtgcccaccttgaaggagtgtaactgaactcctttgtgctaaaatgtctgtcctccacctgcctccctcccctccaagcctttgcatgtgtttctgtgcctttgtctctccccactacaaccagggacattgttgaatgaatgaatgaatggatgaatgaatgaatgaatgaatgaagacttgaatcataatcggaagagccaaaatgcttaaggctcatttaagtatccaatgacttgagagcccataacatcatgccctgtgcaatgggctatgacgttgtgggctctcaagccatccaatacttaaatcagtatcacccactgggtgagatgtagcccctgtcctcaaggagcccagccatgagaaaacacacagatactgtgaagacataggcagacataatggggaccacacaggcaatgagaggcttcagaacccagaggaaattactttttcaatgacaaaatgatacgctctttttacttgcgtatgagacctggaagagtggagagcatggctgtagagccagtcctggatacactccagcccaccacctgctagctgttgacctgtggcaaattgcttaaccactcggttttactgaagtgccttgagagcaatgcctgacacatagaaagtgttagctagtctgttattctttctatttttagaagaaaattacagcaaaatatttgtctacatggttccatccttattattatcagagtcatttccactgaacaaacgtccgtgctacatcaaaggttcagatttaaagttgcagcctgtgctcatttctaactgagcctatcactagagcaaagcttgccagcctctttatctgagtgtgtcaactcttaccttttgtgtctgtcttctttctgtgtgtccttggtaagtgtgcagaactttgaggttttcatctagcacaatgccagcgatgaacctgggctgtcctgcctgagtatcctgcctcttcttctacaatcagaagtaaacccccaatctgaagttctaaaaattaaccaacaataacccacaaatcatttctttgttgcaggaacactttcagagtccttatgatttttttttaattaccctgagcacaactctaagatataaacgatttggaaaacaaagggaagaatttcatgagatctaattctaattacttttgccattaattaactttgttctgttatttagtttgctcttccttgggtgaactagaatgagaatatcaacacttgagaaagttaccattggacatagacctaagtaggctggcagggttcttcccatctaaatttagggtgacaatgttaagaaattaaaatgagaaagttatttacataaatatcacatcattgccaagcatgggatggtgattacctgttttgtatgttgttaattctaataatttctttatatgtagtattttactttaagtcagttgaaatttgtaaataacatcatacttgggtttcatttatttttctttgcatggggtgtgggccaggttcaacttgttttaggctatacaaagtctgatgtctgaataaaaaaaattaatatataattttcttttaagtaacagttgatatttactaattttccatttgcttctctgtattatggcatatataattaatactttatataaatggtcatgactatagttatgtaaaaataagtgtgctgtgactggcagttgaattttatttttagttgccttttttttttcttttatagcttttcacctctggttcctacatctggattgtagccataagtggacttgtaagtgtgactacccttttacacccaattctctctctctcctgtaaaaacattaggaaaattgtcctatttagattgtgcgtcatattcaactgtctcaccattctttttttttgagacagaatttcactcttgttgcccaggctggagtgcaatggctcgatctcagctcaccacaacctctgcctcccggattcgagtgattctcctgccttagcctccagagtagctgggattacaggtgtgtgccaccacgcctggataattttgtattttttcacgtagaagatggcggttacctcacatcgttgagacaggctggactcaaaagctcctgacctcagagtgttctgccgcctcagctcccaaagtgctgggattacaggcatgagccactgcacccggctctcaacattcttttaacccatggcaggtctggctcaatgttacttctgtggtgattaaaaagggccagtcacggccaggcgcagtgactcacgcctgtaatcccagcactctgggaggctgaggcgggcagatcatgaggtcaggagatcgagaccatcctggctgacatgatgaaaccccatctctgctaaaaatacagaaaaatttgctgggcgtggtggcaggcgcctgtagtcccagctactcaggaggctgaggcaggagaatggcgtggaacccgagaggtggagcttgcagtgagccgaggtggcgccattgctctccagcctgggcgacagagtgagactccatctcaaaaaaaaaaaaaaaaaaaaggccagtcacagggaaaattgagacaaaggaggccagtttgtgctttcaaggtaattttgatgaaagttttagctgggcttgtcagtgttgtttttaaatcatagaaaaaaaaaaagcctgaaaatgaagaagttggacttactaaaaataaggagagatagtctgctcattttgtaaaaagacattgtcacacgagggaaaaaaataatgccaactggaaagtcaggtgggttggacctgaccaaagtctcatcatggaagaagggaatgaaccaagcaacctcagtatgtttgctggaattttttcatcttgtctatgctattgtattttaataataagcgtttgtcctaaattctctgtgaggtattaaaaaaaattagagcatgaagtggagttttattcttcatccatgacttaaatttaaacctccagatttataaaaataaattttaactagcggttatagagcatagattttatttctttcttagaaaagacttaaatgacagaatggattcataataatacacatttcactgcaatcactgtacacatttcaaataaattatcactatccttgtttcttgggtgaatgactggtatttggggctagtgtgtcatcctgtacgcctgcttacccctcttcttcctttaagctctctgtattattccttttctgtgttcattctttgcttaaaattcacgcctttgttccccacagctgatatgcttgcagccaatattctggggctccaagtcactttgttttctcctccctaaaaattttcacatctacccagatacctgatttggcttcaggaccacagagctaaaccctattgtgaagtcttcaaaacacctaagctatccgtctggtattcttgagacttgtggtggcttagggccatcctggggttagactgattctctgggacacaggtgccagactcccccaagtctaggctcacccagttagaactgttgcgtgactgaggaagacttaaccagcctgagaacagcaaagaaggagctcattgctttgatcatgagagatgcctgaggatgtactgtttgttccatggcatatttgtttcacttagcagtaatggttttgagttctgttttaaatattttccaaaagcattcaaatattgaagtaccttattgtatacgatttcattgtgttagttactattaattcttttactctccatatttgtccccttccttagtaactcttatgtgactcagttttttaaaacacattccattttctttctttattctttttttagactcctagctttaagtgcctgctgtctcctcagaaagttgcattgtgtgacattcagtgcactaaaattggaggttgcatttttcatctctttatagtctttttaaaatctaaaattatatgttatgattatagtcttttccggtacacatgtttaacaggtagtggggtacctgttttaactttttaaaaggaatcagacgtttaaaataaaattcttgaccaaaaaaaatcccttgtttcagaagggtgaatagaattacagtgtgtttggaatataattcaaagataatgtagcattttaaagaaccctactaataataaacatttctgagccttttacagtcattgattcagccaaagttaccggccttctactatgacaaaaaatctgataaatcttcatattaaccttgttctttattactattttaccataattagatgactgtttatttaaaataattaatattcatgaatcatggccagttttcctatgttcctataccataaatgttggtgcttgttttgaacctaaggaacattttctttctttgtctagaaaattctcatttttattatgaaatatttactgtgatgtggcatactttagataaggaagattgtaaaagacaatatcagtattatttgtgagtgtttgatttacacaccactgactataggatccaagcctgagattcacaaagccacagtctgcctattccagatgtctcttgctcaacatgacttcccctcttcctttatagatcaagtgacttccctttttggggagatatttatgctaaataaaatactaacaaaataaaattcttactatgcaaaagaaatgcacagataattataattatagatgatattcagtgttttggggaatgttacaaaacctgttgatgagatttcacattttagtattgaaaccagtaattcacttaaccatgtgtgttaagcaatgattttatttcattctggcaattaatgtggtttttaagaaaaagagtattttttaaacaaagatatttgtatgaaacatgagtaatttgttatttgctgtcatagaaaccaaaaactttactcatgcttttctggaaagctgccaactttggattgagcttattttatttagctaggtactggttgatttattttgtttaggctagcttttttgttttggagacaggctcgctgtgtcactcaggctggagtgtagtggcatgatcttggctcactgcaaccactgcctcccgggttcaagtgattctcgtgcctcagcctcccaagtagctggaattgcaggtgcacgccaccaagcccggctactttttttgtatttttagtagagacgaggtttcaccatgttggccaggctggtctcgaactcctgacgtcaggggatccatctgcctcaaagtgctgggattataggcgtgagccaccgtgtctggcctaggctagtttttaatctctcctcggtgtcccttattcttgcataattatagatgtctttgaatatataactttaaaatattccactgattaaaatagaaggttgataaattatgtcagtacagtattttactaggtaagttgaccactttttatcttcagtgatatcacagaaaataactaaatcatttttctgagttgagggaagacagtttttagcttacaggagcaatagtaagttagtttgcccaggatggctgtcagacctcagtcctattttgttatccagtagagactccagctgctgcccaggaaaggtgagggggattctcttgtacttaaagatgactgtaagattattcacatgtatcattgataaatgtttttgtgttacctttttcctcatttgacagttctgatttttaatgcaaacatttagtatttaaaataggacttttcatgaaatgttgcaaaattgtaattggaaagcttggctattacagccaagtgacatatatcagtttaaacaaatacttcaacatttcagtgaccgtatcaactgttcttctagatgtctggtgagagaccttcaaaaattgaagtcagtctttacatattcataattccactaattttcttacacattaatacttttccttaaagcattgcttacttactgaacttcatttaaattcttcttgtggttctgcagagagcttttgagccatctacatctcagaacttcttcattttctacagttttatgaatcatagtactgagtcattaccacagggatgcaccctaattctcaaaagccgaggtctcaggactgatctgattctggcatgattaaaatagaaagagccttcttttgccaattttctttttacagttcacacatttatctttacttgaccctcttttaagctgtttgagagtgaattaacaggcctatattcctcagacttctcccttcaacgcagcccttcactgtacccatttcctgcattcgttacttgtcatgtacagtatatcagactttgattatctctgatccagcagccttagtgtggaaaaaaaacaatctgttacacccaaaagtaagatttgggacttcaaatgtggtctgagtttggattgttttctgtaaggagtggggatctttaaagcacttcaagaagaaacactttacgatggtgcaagattacagaagccttatcagggttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgttttgaggccctggcctgcttctgggcgagggatggtaggtgtgggttcctctgcgccgcctttgcttgtgcccagctctctcttctctccatgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggatcgcttgagcccaagagttcaacaccagactggccaacatggcaaaaccctgtttctacaaaaaacaaacaaacaaacaaacaaaaatttcaaggctgaccaaagccatgagggtgatgggacttgtgaaaggaccacatgtagaagttgaagacaagtagcaggttcttaagaagcatccaaatttggagggtgccttataattaaaatagcaagtgtgatgtcagtgcttgtccaatgtacaccccacacacactcacattcacgttgactcatccatatacactcccttttctcctttttcctccctccctctctatgctacctttcccactcctgaccacagggagccaggactaactggaagaagccttctattaatatattcttccttgtggcaattgcaactcaggcccaggatgacaaatggtgtcttaggccattgttaacacagggaggtagcgaccagttgacgtgtgatttttaaatgctcagtgcagaataaatgaaatgatgccattgtcttaataaagctggcagatagaattgccttataaaatttataaaaatagctataaaattttattattgcaacttatgttctacctgtaggcaaaaatctagcctcctttcaaaatgcgacctcctcacctacccctgtcacttctgtgaaccatacactccaactacacacaatccattcccaaacatccactttcaggattctgtatgattgtgcaaacaagtatttttctttaacaaacacacagcacttagtatgtaccagacacttgtggtagattttttactctagtatttttgtttgttcaaatatatttggtcaaaatatgttctgcccctctctactgaagccctccctatagggcctctgcatgccctgttgacatcaggttttgttgtttgacttacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgataatttgttaccacagtataacttagaaaaagctgactaatagtactcttttctaagcactttacaaacattattttaattagccctcataaaaacctgaggaactacggaatattctccctattatagatgaagaaactgaggcacagggaaattaactacagtcatgcactgcgtaacaacgttttgatcaacaacagagtgcgtattcagtggtggccctgtggattctaatggagcataggtagaaacctggtgtatggcactcagtgttggcactgcagatcaagtaggggaaatgactgatattcagtcatggtgccagaacacttgattttctgtatgaaaaaatatatataaatgaaaatatatatcccatctaggtttgtgtaagtacactctgtaatgttcacacgatgaccagatcacataacacatttctcagaatgtgtccttatcattaagcaacacatgactgtaatttgccaagaacaccaggtagctgaaaagtagtggagacaggattcaaatgtaggtagcataactttagtgtctatgctcttttttttttttttttttttttgatacggagtctctcactgtcacccaggctggagtgctgtggcgcgatcttggttcaccgcaagctccacctcccgggttcacaccattctcctgcctcagcctcccaagtagctgggactacaggcgcctgtcaccatgcccagctaatttttttgtgttttttgtagagacggggtttcaccgtgttaggcaggatggtcttgatctcctgacctcgtgatccacccgcctcggcctcccaaattgctgggattacagacatgagccacagtgcccggcctatgtctatgctcttaaaagatagctttgcataaccacatgcagtttcttccaactatatcccctatttcactcacatatcccttcttctaggaaatcttactcatttaagtcctggcccaacccttttcctgagtcagtcctgactttatttatgagagctctcctcttaaatttttaagtgacagtttataattgttgactataggtatggggttgtgcagcgaatctctggagcttatcgctcttgcttaactgaaactttatgcctgttgatttttaactctccttttccctctgcccccagcccctagcaaccaccattttactctctgattctgtgaaattgactatcttatatacctcatataagtggaatcatgcagtatttgtctttccgtgactggcttgtttcacttagcatataggtcctcatgtttcatccatgttgttgcatattacaaaatgcccttctttttgaagggctgaatagtattgcattgtatgcatggaccacattttcttcatccctttgtctgttgatgggcacttaggttgtttccccatgttggctattgcaaataacatggtgatgacatgagagtgccgagacctctttgagatcctgattcatttcttttggatgtatacccaatagtgggattgctggatcatattagttctatttttaattttttgaggaacctccatactgttttccatagttgcatcatttgcatttctgccaactgtgcacaggggttccagttttccccacatcctaaccaacacttgtcttttggtgttttttgtttttttataatagccatcccagcaggtgtgaggtgataccacattgtggttttgatttgcatttccctgatgattagtgacattgagcattttttcatgtacctattggccatttgtatgtcttctttggagaaatgtctgtttaggtccttagcccatttttaaaactaggttattagttttttggtattgaattgtaggagagtccttttagtttataggaattctatgttattcttcataatcttcagtgcctagcacaatgtctacttgatacacattctaaaaataattttttagtttaaaaacttaatattatcaaaaaataatttctgtactataaaacattatactacatgattgtcaggatgcttacaatgtgtactgccttactaggttcttgatgtgttctctatagtggtagaatacctggactgcctattttaaagatagggaggctgagtttcaggttgcatgaatgatgggtggtagaaccaggacaaaggccaggtgttctgctccaggcccagtgagtccagcaccttacactgcacatctcaaggctctcatccatgtctcttccagccacgagatgcacagacagagttattcttaaagtttcccttagccacaccactaggatgaggccccattcatcagcaatggagacatgattctggagggcaatcttgggtatgaagaggttttcaaagtccccagaggccctgaaaaacacaatcgacaactttttgcagccttctgtgtgctgaccaatagccaaggaaaattttttctcattagcagactctattttcttcgtaatatgaagaatgtggcctatagctatgctttctcttctaaaatcatcaagatatttaactggtcctctctccatgcttggttaaaaactcagcttaaacctcaccttcagcaaactcactgtcttgtatttcttgcattgtcatactcaatctgaagtaaagaaacattcagagaaaacttaaaggataatttaaagtatattaggctggtatagtagtgttactgaataaaggaaaaagaagtagagataaggaagaggttgccaagaaacacccgtacttttacattgtagagattactggtagattatcatgtccgttgcaggacagaacattttcccatgggtcttcacattgtctttttatcaggaaattaaaattttttcatcagttttgattatctctttaaactatatgtagttttggtttttggtttttctctctctctctgtgtgtgtgtgtgtgtgtttaagtgtccagtgtttgtcttcggggactgactgtgttgatattttccttctgtcttgatgatagcctctgggaagggactatggtaaaattaacatgtcgttttgaatttatttattatttataaacaacagcataggatgttatcaaaggtcttccatgttagcttatattgatagctgagaacattttcaaagcagcagaagttttttgttgttaaaagcttgtttttgttctgctaaaatcctacctcttataaaatttaaaagatttatgtatctatttgagatctttctagatcttcacattcttttttattaaaagattctttttccctttttttgtttattaagatgttatttacatacaatagaactcaccaattttaagtgtatagttcgttgaactttggtagttatatacagtcatgtactcaccaccataatcaatatggaaagcagtctcctgaccatgaatggtggcttcatgccccatgctctttccccacatccagctgccagccgcaggtaaccactgatcttcatgtaattatagttttgcctttgctggaatttcatatacttagtattgtataatatgaagtattttgtgttttacttctttcacttgaacatgaaaatttcaccaatttttaaaattaatttttcatttattattgtattaagtaacaattaatagattaagtattaatctatagtatggatgcaccatactttgtttatccattcaccaattggtggacatttgagttgcttccaggtttggattattatgaataatgctgctgtgaacatctgtgtacacatttgtgtgtggacatatgttttccttctttaggaacggaattgctgggtcatatggtaagtgtatatttgacattaggaaatactaccatgttattttacaaagtggctctaccattttgcatttccaccatcgatgtttgaaacttccaaattctctacacccttgtcaacacttggtattgtcagttgttttagctttagccgctctattgggtgtgtagtggtatcttgtggttttaatttgcatttctctaatgattagtgatgttgagcattttttttcatgtgcttagtggtcattttcatatcttttgtgaaatatctgttcaaatcttttatccattttgttcattgggctatttatcttctaactgacttaaaataattctttatatattctagatataagctctttgttggacatgttttatgaaaattgtattctaatttgtggcttgtctgttaccaaaaagcaaaattttaaaatcttgattaattcattgttaactggtttttaaaatagtttgtgcttttgatgttctatttaagaaatctttgctaatccaatgtcacaaagattttctcctatatgttcttcaagaatttaatagtttctgctattacatttaggtctgtgatccagtttgagtataattcttttgaggtaaagggtaagatttattcttttccacacagatactcatttgttccattaccagttattgaaaagacccttttctcattgcatgaccttggcaccaaaactcagttgaccagtataggtttatttcttgactcttttctttcccagttatctatatgtctgtccttacgccaataccacactgcactgatgactacagctttatggtaagtcttgcaatcaggcaatataagtcctcccaccttgtttttcttttttaaaactggtttgcttattttaggacactgacttttaatatacactctacaatcagcctgtaatttcttcaaaaaaaggggaaaagagttaagattttgcttgtaattgcgttgaaactttagatcaacttgggaaggattgccatggtgatggtttttaaatgtttccacagattcttttacacatcaagaggtggagcttatttttcctctgctagcatttgagctgtacttggtgatacttataatgaatagaatgtggcaaaaatgatggaatgtgactcccaagagcagatcataaaagacacagctagtcctgtgtctttactctctcctggatctcttgcccttggggagcccatctaccatgccatgaggactcttaagcagacctgtggagaggtccacatggccaacaatcgtggcctcctgccaacagtcagcactaacttgctaggtgtgtttttgagccaccttggaaggttatcctccagtgccagtcaggtcttgagatgagtgcagataggctgacaccttgactgactacagcctcatgagagaccttgagccataaccactcagctaagttactcccacattcctgcccccacagaaattggataatagatgcttattgtttcaagccactgagtcttaggtaatttgttgctcagtaatcaacagctactacaacaatcttaacagtattgagttctccaatgcacgaacgtgataagtctctacgtttatttagctcttctttaattcccctttgcaatttttaaattttcaatgtacaggtcttgcacatctttcattagatgtatttctaagtaattctggtatgttgatgctattataagtggaattggttttataaatgttttcccaattgtttgtcactagtgtgtagaaatacagctgattggctgggtgtggtggctcacagctgtaatcccagcactttgggaggccaaggtgggctgatcatgaggtcaggagttcgagaccagcctgaccaacatggtgaaaccccatctctactaaaaatacaaaaattagccaggcttggtggcggatgcctgtaatcccagctattcaggaggctgaggcaggagaatcgcttgaacctgggacgccgaggttgtagtgagctgagatcatgccactgcactccagcctgggtgacagagtgagacgtcatctcaaaaaaaaaaaaaaaaaagaaatacagttgatttctgtatttcgttcttgtgtcctgcaacttttctaaatgtgtttattatttctggtagcttttctgtggattccttagagttttcaacataggtggtctgtgtcatccagaaataagttttatgtgtttatatgcttcttctttcccaatttgtaccttttatttttctttattatactagctaggacctctaatagaatattaaataaaagtggtgaatggatatccttgcttcttcctggtcttagatggaaaacgttgagtttttcaccattgaggctgtatctataaatccacaaatcttttagagcttcacattcacttttagtttgttatttttcatcaaaggtaagaaatgagtttcaactgaaataagcccatatttttattaatttttcattttttgaatccatttaagaaagtgcatgtaacttttaaaggaggatggtccgcttgttaaaatggatattagaaggtgtttgtttacatataagaacctgatgatggttttctccatgtgctagagactctagttgccttccagtatattttttccttcataagggaaggttcgttttatttgagccagcaatgcctccagctgagatcacatatctcttatccttcgcctctcagtctgaccactggtctaagtcctggcgtcctggccattgagctgtaaacacacatatttgtgtgacttctgagaaggctccttaaagtcgccttttgtcctttcttattttttttcttctggctgctttgactacagttaagatgtttggagctttttaaatatgaaggtgaaataaacttctcttgtatttaagccactgttgtttgaagttttctacttagcatagttgacctaatcctcctgatgcatgatttcccaaaaggaaaagcctagagcaggtttctaagacagtatgtgagaaacgaataatctgtgattagtgttattacttctgtctctattccaatttggttttccaagaatcagaaggatatccagcattttaattgggtacctcaaaatcttttaatttagtatcatttctattccctcatatgagatagaaaagctatagaaagttcaatctgaatcacttttgcacttaaagaatagcaagtctcagagtaactgccaaaggcacatggttctgtctgtcatgaaaagaataatcttttcaaaatgtatgacaaatggcagaaataactttgggaatccctaatttgcattcacattcttggggtaataaattagggaatgtacaaagttcccttatgctttctctaacattttcattggagaagaaggaataggaaaatgtaagatgcatcagggcagggatttttctgttttgctccttactatgtttcagtgtttagaacataggctggcacgtattagcattgagtaaatatttgtggaatgaataaatgaggtctcggtgggtctggttaccacaggccttgagggcacatgaagtctatgtgctggggctcagttgcaaggggacatttattcctttggctgttccttgtcatgcagaggcaatatcatgcccctgggaaagcagcccctaggtttgtcctgttgtcccagtagatggtcggtttcttgaatgtgggaccggtggttggcacagcttgccttgtgggtttttgttcagccacagttggccaaagaaagcaatcgacacctgtgtgtcattgcaaagtcatagtttctaacctttgcctgttgtggtttcaggctagtactaaacaggaccagaggacagttgaagtttactctctataatcaagagtgttttgcatgttttctacccagcaaattaaattatttgcctgatgagcattatttcatgattcccttcctaaaaggatgaagcatctggaaaatctgaagaaccgtgtaattgacgtccatgtttattagtggactaagagaaaatcatttcctcttgccttacattctcagacttacagggtcacagcttctgctgttggcatatggggggctgctccctctgacctggagccagcgtgggtctttggcctagactctcagctggacgtgggccaggggttctctggttgcgtgaccatgtgtcccctttcctagccagggttcctgcttcctgttgcccaagtgctcaaactccaactcgagcttgtcttcccgggcatatgctctttgttcctttttgctttatctgatcgtcctgcactgaccccttgcctgccggagactgcgccactgctgccttctttttcagtggcccctccgtttgctctttggcttacccaggtctgagggcctgcaagacctccttggtagagttcccccagccccctgacacacaaatccaacatatggtctttttctaaagcctgcttttcagagggtctatggatttcaagaaaactcgctcaattcagaagacctagtgtaaaaaaggtttatgagatcatgaaaattaggtcaggcatggtggctcacacctgtaaccccagcacttggggaagccaagatgggaagatcacttgaagccaggagtttgagaccagcctgagcaacatggtgaaaccccgtctctggggggggaagaaagagagagataatgaaaattaaaattaaaaataatgtgtgaatgtaacatagtattataataactgatgctctctaaaagcttttggcagtaattaagtgaaatctaatgtaattatttttgtcccatctttccatagactagggttttaagcactttatattttaatcctttgtgaaaatctaaaacattgtgcagtagcactttatttgacaacttgaggtcatgctggcgtgccagtgacatggacaagtgaactctttatcttttatcatatgggaaagtataaacttgggaccaaaaagaatgcataactttccaatttcctttaaaaggatctaagataatgtatttatttttgtggagcatttgttaattcaccattcacccaggaaatacttacagtactatgtgccagacactgttctaagtgcagaggccaagtagtgatcaaaagcaacccaaatcttccccattcagagtttacatttagatagatgggatagaaatgtaagcagatgaacacaaaagccctacttccctgccagaatttgcagtcctatttttgtttattactgggtggggtatccatattcttcacagaatggtcctgctgaaattgaatacatagttttgtgagtgtatactcacgtctgattgtcattgtgggggcagggaaggcatggacaggagagtgaagatctttaaccttcctcagtttcttaagggagtctgtggcctcccccccataaattaagagcttctaccaaattgtgaactccttaaatactggcaaaaactatgcattttcattatatttttcttaatttatttaaaaacctgatttaaaaaaaattagcaacaagatcttgctccgtcacccaggctggatgcattggtgcaatcatagctcactacaacctcgaattcttgggtcaagtgatcctcccacatcagccttccaagtatctgggactacaggcatgcaccaccatgcccagctaattctttttatttattcttattttttttttagagatgggggtcttgctctgttgcccaggctggtcttgaactcctggcctctagtgatcctcctgcttcagcctcctaacatgctgggattacaggcgtgagcacagaaaaaccaacattgtattgttgagcttttaaggtatataggtgtaaaatatgacagaagtaacgcagtggatgggaagacattacatggaactgtagtaagtcttaaccttgtcagtaggttcttggaaattccaactttaagcaaaacatcattcaaataatgtcatttcattcaacgtcttttcattacagcattgaggagacaaaattatactttgtttcagttaaagttggagtttccaagaacctatcagtgagttaagtgaggacttactgtagggtcttgcaagcttctcctgttttacatgaagtaattcagtattaactccaaatatattatgctcaattttgaatgcatattataacctctagggcaaatatgagggggaaaatacagtgatatatagctgaaaaaaaccaaaatactaaataatatttgatagcacaaaagaacgtaggaaagggggagtaaagagtaagaaacagatgagacagacagaaaccaaattgcaaaatccagctattcaagcaaatacattaagtatgaataatagctaaacactccaatcaaaaggtagagattgtcagactaatttaaaagaaaaaaaattgctatatggtatctacaagacacactttaaatacaaagacacaaaaaaagcctgaaattaaaaggatgaagatatattatggagacagtaaccataagaaagctgaaatggctgttttaagattagacaaagtagacttctctatgagtattactaaaaacacagcagaatgctttgttatgacgaaagggtcagttgtgtttgtgtgcctaataacagcgtccacaaacaggaacagcttctagatatatgaagttaaaatagctaatgggagcaatgaacaaatcaacaatcacagttgaatactttgagaccgaaaaataaaaatgtttaattttgtacttcattcaaatctcacagctctaatttgtactacatttttaatattttgttatgtttataacattttgctatcttctgctgaatcagcgtaatgctgatatacaccctattttctgttttatatcagatcttcagaaaaggcatttctacttccttgcctccaattcattactgtttttttttttccatattgacttcatatgtctctcttcattaaaaatatatatttgttacagagaatgcctctgcctaccccctaccctgtcccccatcacccctctacagcaaagactgctttctgtgattctgtagttaccgcagacagatgtgtgcacaaacggcatagactattattttgttgtctgaaattttgcaggaagatgagcgcaacatgtgataccttctatgtgtatttttcattccactttaaacacatcagtacacgcacatggagttcatctggatggctgtatagtactgtgttgtatgaataacccactctgcagctgttcccctcttggggatgatttgtttctgcttcctctctctctcatgcagggctgcagtggaatgagcctcaaagctctacttggtgttgccacattgctccccagaggcgccatagcttcaccttccctcgggactgtgtgagagttctcagttccctccatccttaccaaaacctcacacctggaatcccagcacttagggaggcagaggcaggaggatcgcttgagcccaggagttcaagacctgcctggcaacatggcaacacctcattctccacaaaatggaaaaaaaaaaaaaagagataaaactggatgttagaggagctttacatttttgccagttgctgtatttaagattgctcattttagatttcagagtcctaaaaacaagtgaggataaacatcttttcatgagtttgtcagccatttgagttttctcttctgaaattaccttttcatatgcttttaaaactgggctctttcttacacattcctagggtttcttgatatgttctgaatgctgccttggttggctgtatgaattctgaatactttcttcaggcctcttgtgttttcatttcatttatggtagcttttggcatactacagcttttaaattgtaaagtagaccagtgtgtgttttcttttctagtttgtaccttatgtttcttaatttaaaatattttgccaccccagtgccaaaaaggtattccttctgtattttgtgcagaaagatttacaatttcatgaattctatttgagttcttattccattgcaagtttacgtttggtgtcaggaaggggccctgttctgtctcttccttgtgtatagcccatgtgccccttccctcccaatttacccatgtctgctgaataccaggtgcccttacactgaggatcctatttctaggctcttgttctcttggtctatttaagtaaccctagataaagaccacactgttttaggtagccaaactttatagtatgtcttgaaatctgataggacttacgtttctttaaaattgccttgccttttctgggttttttatttctttgtcttttaactcttaattgtgatatacaacacaaactaactgtcacaaagccttgcaaatcactataaagcaaatatacccataatccaccatgcaggtacagaccatgcctggccagccccgcagcccatggtgccccccttccttcccacctctcttcctccttcccacctccctcctgtgaccccttccccttctttctccctcccttctgtgacccctcctagcacacatagtcatcatctttgcgctttcctgtctcgttttactgcttagtgtgtggtttaggttcattcattcacagaagtggaatcgtgttttcaggctttgggtctggcttctttctcccaacatggtgtttttaaaatgcaaaccttaaatattccgcatgaatttgaggcttggcatttacattccaacaaaacaccctgttaagattttattttgaatgatatttaatttatgtattaatttgatgaaaattggtatcttaaaagttttgcatcttcctattcgtggaactggtatctttattatcactagggttggttttgaaaaaatatcccttattatctttttcttttttttctgtcaaggccttatatatatattatttatttattcccaattatcttacagtttttcttgctgttatttgctaacagtttattttttctttctaaacagtctgtattttatccctggttgcttttaaggatttctttcttttgtttcaccacagtggatctagatgtaaatttcgttttagcattcttttagggactcttgccctttcatcctaaggatttatattctttctttattctagaaaactctcagctgtttatctctttaaatataatatcctttcccccatattccctctgttgtcttcttctggaacccctatgctgacagccgcatgagatgcacataatctgcctgtgcagaggccttggccttcccaacccacatggaccctccttggttcatgccctacacagcttttcccttctctctgtggaggggagaaagggtacatggagcatgaggaggaactggggtgcctcttacccagacttaagtaaccctctacttctctcctccttccacagggcctagaccctctagtccaggggtatctagtcttttgaactcttctgtgacacattggaagaagaattgtcttgggccacacataatatacactaacactgaagatagctgatgagctttaaaaaaattgcaaaaaaatctcctaactttttttcttttttttttttttttttttttttttttttttttgagacagagtctcactgtgtcgcccaggctggagtgcagcggcacaatctcgacttactgtaacctccaccacccaggttcaagcgattcttgtgcttcagcctcctgagtagctgggaccacaggtgtgtgccaccacgcccggctaatttttgtatttttagtagagacgggtttttaccatgttggccaggctggtctcaaactcctgacctcttgtgatccgcccgccttggcctcccaaagtgcagggatgacaggtgtgagccactgcgcccaaccttgtaatgttttaagaaagtttatgaatttgtgttggaccacattgaaagctgtcctgggccacatgtggcccacaggcctcaggttgaacaagcttgctctagtccctgtgcttttctgagtcccacaggactctctgcaggcatttggacttatatgctgcttatatgcagagtggtttataatcacttgataagctttctattttgttagcatggttcaggattagtttctggtttcatggaccttggagtttgtttctgttttcattttctttgtcttgtactatttttgagtaaaggggcacagaaattatttgaaaccagaagttgtccaccattcactcttcagcctactacagtctgtctttggtaccaaaactgttcttgtaaacaccttgtttatcaaacacctccatttgcaacatccagtggctagttctgtcttacttatcagctgcattagatatagctgaccatccctattttaaaacacttcttagcttcagtgataactaaactctatttcccttctcttcactggcagccctgtctcagatttccttactggcgtttcctactctgtctgtccatagaatatttgtgcactcctggattcagtccttagtcctgttctctcttctgctgtgtctcctcctcccccccattttatctcctctagtcctgttaccctaaatgtcatatcatatccagtgactctgaaatccttatctcgaccttttccttgagttctagaattacatagccacctgcccactcagtagccccccaagatatctaatagacactcccaagctcgggctgcgcagcatctgctgctttctctgcccaaaatgttatttccccagttcatcaagtcacgggcaccgcatcatccttaagatcttcgctcaagtatcactttctctgagggctctcctgatgtcccccgctgcccccagagtaggttcgtgccccatgtcactttatttccttcccagaacttgccagaaatagttttatgtgttgacttgattactgcctgttctccacattgactgctataagccctgtgagagtggggccttgcttatcttgttctttgctgtattctaagttcccagaacagtgcctggtgtgtagcacagtctcaaagaattcttgccaattcatcaatttaaattttatttttaaacattgaagtatacttttctcatattagaaagttgtcaaatatgttctaatctgatcttctaatcctaagaatcaaattcacatcaagattttttttttttttacaaaggaatagccatagtcatttttaactagaaaatcataggaagccttgagacttctgtaaccatacattataaatgaccttcaagatgaagacaaggttggtttataaatggaactaatattggtgaggattttaaatgtctagaaaaatcagtagttgaaaaactgattaaaacactatgtaaataaaaaccaagattttagattgtgtttattctctgataaattgatcgtgtgactgggtcagctgagacatggcagttgttttctgctggtgtctctgtgatggccatctgccaacaaaggtaaccgcagagtcagtacagtgtgaaagtgtttcaataatcagatcttttacggctttttaaaaaatgaagacagtgtcttgacaatcttttaccagaactttgaatactaaatgattagaattttgctagctcttctaattcaataaaaaacaattttgttttactaagttcaattttgtgttgatttgcactgcttagtgttctgcagtgtggtagaggattttgcttattgcctaacactgctatgactaagaaaaataccgtgtgcagtgtctggaggctgctgatttttgagtcgtgtacattttttaaaataatactacatttaaacaatcacattggacgtttttcttctagatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcaggtaaaagtgataataatcactaaaaatttagaaattctcagtggcccaagcaaatctttcctctgtgattgcatgtgagatagagactacattttattccagtgccttgcaagtggattttgacatttccaaagagattgtaggtctctgttagtggccattcttagttttttaaaaaggtaaaaaataaattgcagctgaaagattggtcaaactggacattcttgttccacctatattagataagcatgacttcttagagaaacaccaacctagttaacaagatgtgctatttatctgtttttataatcttgtaaaagccacagtgtcttcctgttaaaatgctaatcatatgctatggagtgaagaacaaatgtaaaatttcttgattttccttggttgaaatgaagagaatatgaaggcaagaagattttcagtggaacaaccaaggagtagataaaaaaaaatgctgtgttttctcaaccttgctatcaataatcagaaattattgcacatttgtctacaaattctgcatccaaacaatctgatactacatttgtcttccatgggcagtgagagaaggagggttagtgcacatcaggctaaaacctcaggcctgatctttcttggacacttctgtgagccagcccacagggctccccatttttcgcctccaccttctttacccctggggtagttgtaaaccgtacagttacctctgccatctctctgtcttccactagcattggatgcaagaagtaggtctgcagatctcacgatggtttggagaagtgaaatcaggtttgaggtccttagagtcccattggagatgcaggtcccagagtttatatcaggggggggaggaagggggcagcttattaggggcagagtctacaagagaaatagagaagcaaaagttgtttcttaaagatgtgcttgaatttgagtgactctggaacatgccataaagatgcccatggtgtatttaaagctggaggatggacatctctgtcttggaaatgtggaagctacatatatatataggtgatggagtcacctctgtagggatgagagctgagagccgaaagcaaagaagtagtaagttctgtaagagaagagctacatccaagatgaacacaggctacagatgaagcctcgtatttagcaggaggtaaatccttcaaggaaactgagagaagagcgaaaggtatgagaaatcagaatgatcaaggtcagaaaaactgagtagtgattgagtataaaggtagaggcacagagcttatgagggagagaaagaagtaggggatggttctgatgtttctggcctagataatcttagatagatgactgatagttccatttcaccaatatcaaaagagcagatttgggggaaatatgttgtctgagatacctttggaatcctgggaggagattctccattggagagctttgaatttgtcctcataagcaaaccagagaagttgcatttctcagattggcctccccaggaagatttttatacaaagagtttatgagagaacaccgtcagcatcagtatctatgggggcgggctggcgaaggcagcaagatgggacagagggagcagctgcagttccagcaaaagcctcgctggtcttatggagcacagtgaagctgggagagcccttctgagttgtcccaaaatggggaccagtcctgttgggtaagtcccatgcgtacgacctctttgaaccttaattacctccttaaagtccctacctttaaatacagtcacatcgtagggttagggcttcagcgtgtgaatttggggcaggggcaaggggtgggagacagtgtgttccataacactgcagagtggaaagggcccagcatagtctcggcgctgagtgactgttctgcttgcagacggtagttatcaggcacacacagtctctgtggatgccaggttggatgctccatagtggcaggagataggtcggcctaggtgagggggacccacacattcctctgtgctaccaccatggccatccattcgtgtgccagcgctgggttatctggtgatggagccacagtcattctgtccaccttccatttggtgccttttctgtggtggatgcccgtggtgggcacgacctgcaagacacttgatgctgttcctttagctggatcctccttgttccctcccttccagtcccctgaccgaccaaccaggtgatctgccatgcccagcagatccacacgtgtaattgcctcaggccacttctcttcacacagagttgatgaccaaatgtgctgcccaggctctgcccatagggggttcccctgatcgctgtctttcaagattgagccatcatgcagccgtttctttcagctgccactcatgtcctgagccagcctgtccatttggctgttttcccctctgtcacttggtcatgaggggcccaccagctgtggtagtcggtgttagctgggaagaggctgtggtgcagcagaggtggctgccagggtggtctggcatgcctgcttctgcagctcacccatgccctgcagccccacctatgctgagcccagatgcccgtgtccatctgatgatgggtttctgtcggcccacctggcttggtaacttggtgggtctccactgctgaccacatgctcactttgtggcctacagacaggcacttcatggtgcagcagcagtttatgcaagtgggattcttggctgtttgcgcacgccctcgctccaggattctacggacccccattgtggttctcctttcctgccttgctgtaaactccgcacggtgtctttccccccagatacttggaacatcacgggatctgccaggttgtacccaggcctcagggaatgagacagacccaaacccctgccctgctggagcgtgcattcccaccaggcgcctgtgaagtggcacaggcctttatggctgtctacactgctgtcagactcctccactttcataggatggtctcactaacagatctgaagtccagagcaggacaccagcccctgggctcttgctgggcttttacgttgagtggtctgctgggcagcacagaccagactcttgattttttcctaagcttcctaagttctcttctagggtccgcacatgggtacacccaaacctgagcacttagcctcctgctgaacttcttcactcagctgtgtctcagttttcttcacataagtatgataaatcaccacgtagagaactcttttgttaaaccaccactggaaattatctgccgtatttgtgtgcatgcacgagtaccgtacagggtgcagttgtattggaatgtaataccaggagaaaagtttattttcatttacttttcaacaaataagtacttagtgcttattatatggtaggcctagagctggacattgaggacacaggtgtaaaaaagatagcccccagtcctttttcttatggagcttaggtcctgtctctcttgcagaattagcatgtttcactctttatcagtaagaagaccaccaccatttattttgccagtcctatagtaagtactcagtatatgttatctcatttatgcccggtgtacgcctagagagatgcaggtattccctcatgaccccggaggctcaggggagtgcttgcttgtccaggggcatgcagctgttgatggggatctgggagtgagacccagctgtgtctgactctgaggtctctgtttctgatccctaactcatatacctcccaatatgagagctccttggtgatttgttttcccccttttcactttggctggcaggaaactcagtgccaggcttcaggtttaattagggttaagttagaacttttgcttccatcttcttctttatgtttcaaatacatgtttttgttgtttgctcctgtatcttttattgtaggcaatctcatgctgtgtatttcatttaaaatacaactgttatttatttaaaaacttgatttttagatgcttttcatagaatctgagtttatttagtcagaaagtcattttttttcagttactaactgctgtatgttacacatgatctgtctgcagtttttcatttcaggtattccaaaataacactcaagtcttgattcagtgttgtatttctttagatttctcttgcctgcttatgccagagttcatcctgccatctggcaggtgctcgctgccaccccctgccacgtgctcctcgtgtggctctgggggcacagttagacagttagactgcttgggaagctctctgaccaatactggtggcttcgctgtgggcacaaaataaatgaagaacatgtcctttccctccgtgagtttgtggccaacttcagggagctcaggcagttgtagttgaaatagatgagcatccaagaaacaaggaaatatttactgaagcacccatgcagtgaaaatctgaggagagagccactggtgtggactgatgctgccaaaaaagatttcaggaagtagaaggacgggtggaatttggatgggtggagagggtaaggcacatcattccagaggagaggaccagcaagagtgaggcatggaggtgctaatgagaccttaaaaaggagagacctccaggagccctgtgattgacatgtgggcagatatgtagtgagaaatgggaaatgatatagtaactgataatggagggaggtagtttaagcctgacaatagatttcggcttggacattggctgtgaaaaattgtttattcagtaacaaagataggacagttatctcagaaaaatgtcattttattgcacagtgtaagatggacgggggaaaggagaaaccacagaggaggagacaaatagaaggaggtttctaaagcccggctctcagaggagtgccttggctgggctgatgctgtactctggatcgagctctccttcctctgttcactccctaaataggttgtttcccaagactcagttctctgcctactgagcttttcacgttagacacccaaggggacccacccagcccctgtcctcaccactttattgagctcatggctcccatgagtccctcaagatctagagactggacctccctctctcctggggctccagaccgaaatatcctactgcctatagtacatctccacttcactgtcccatcagctcttgacaggtactgtttctttttttctttctttttttttttttttttttgagacagagtcttgctctgttgcccaggctggagtgcagtggcgtgatcttggctcactgcaacctctgtctcctggcttcaagcaattctcctgcctcagcctcccgagtagctgggattacaggcgctcaccaccacatccggctaatttttgtatttttagtaaagacggggtttcaccatgttggccaggctggtcttgaacccctgacctcatgatccacttgccttggcctcccaaagtgctgggattacaggcgtgagccaccgcacacagccgacatgtactgtttctttgctaaatttgtttccctttctcactccctacctgatgaaaagcacccattgtttacccgaaagtccaaacctagggtttcaccccagacatttcccacttatacatccatgtccttcctgccttccccaccagttcagccccaaagagtctccctccttgatgtaagtccgtcattcatctccagtgctgtagttcaggccaccggcgccatttgcctggatttcttccctcccatctccatcaccgactgcctccctcctgagcctgccccacagcctccaccagtgatctctgtgaaaacagaaatctgcttgtttcactccagctatcatccttcagggcctctccatagctttcagggtggttccaacacaaggctcctgcctgctatgtggccgcatctcctttctgctgccgtgtgcaagcccttaggccagccatgcctcaccgggttactcacagttaactgctgctcatattgtttcacgcagtctcacctttacatcttccctttcctctctgcccagaatgaacttccctgtaccaaccccttcaccccacccctcccacatacacatcattttcacttgtctagctgctatttactcggcattcctgacaaatatcgcctcctcagggaggccttccccagcttcctggggggctcccagggctctctctgcccctgtagacactgcctgtctctcgtggcaccgcaaacccgatgttcactggtgatttactgccctttctccaccagtgtgtctccggatggagcagacttgttttctgtatatctccagtgtgtgaataatgcctggcagatgttaggaactgtgggaattaatgagcataataaatagatacagaaagactttaagcaagctgaacacagatgaataatcagggctggaaacatctacagaggttgagtgcagtggttcacgcctgtaatcccagcactttgggaagcccaggcgggcagattgcttgagcccaggagtttgagaccagcttgggccacatggtgagacccccatctctatttaaagaaaaaaaaagatctacggatactcttgagagaacagtagaaagcaagacccatgtctagagagtgcaaagagggaaaaaaaagaacccccagggaccaaggagaaaaccagttcagtggccagggagcctgcggagtagaatgtttcaggaagagtaggtgtttcaggaacagattcagacgttactatccccgggcgcccccccccccccccaggaaaaaaaaggcaagtgaagatgatactggaagaccaccactggattcagcagaatgagttcacttttgaaaggggcttcggtggagagatggggatgagaagcgctgcatgagctggaagtgggggaaggtcaatatcactctgttctgactggctgccctcattctgggacatcactgtggtcacgctggtccccgttcaagttactttcactctgtgagaaagtcaatatgatcttatgctcctgaagcatttttagtccactgtgtggcatattcccattccacagctctgatgaacagtgaccagggtgatggctctatagatctcacttcaactgagacatgagacctaggtgctgacaggggcagggtacagtggtcccatgctcatcattaagcacaggcatgtgataacgtcatctagtgtgctttgacctcctacagatctttctggacatttcccgccagcactgactatccagaggcctttggaggcttgtctcatgggcctgtggcagtgaagatggagtgggctgcagagtattagctgcagcctgtggtgcccacttcttatctccctccacatccacagctgtcccattcttttgtaaactcgggacactatgctggacacacataagctgctctcagtagttccttgcccgctgactcactcttgtctcccagcagagctgccttctccaaagcaggtggcatctcagagtcattttgctacttgcagctgtgatcatctttacactgccagggccattacataacttttcatgggtttgtgttttgttcatccccagtagaatatgagctcttggaggacaggagctgttgtacttctttgtcttttggctctaatgcagtgtactgccctgagggattaaataagacgccgcctgcgccttcaagaagtttgcagccagcgaggggaagacatgaggctgtactaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttgggaagagagcagaggccaggacgggtcttctaccaaactaagaattgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtgcctgtagtcccagctactcaggaggctgagatggaacgatcacttgatccctggaggtcaaggtgcaatcacggctcaaaaagaaaaagaaaagaaaaggtgacactagaggaagaagaccaggtgggagacagtgaaaattctgtgtgctcaggatattgttggtgatgagctagagcatgcttagctcatcacagtgaaggacgagggcaggctttgcagagcctccttgtcttcagacctccagatcaattactggagtctcctgtagtaatgatcatccgaatggtgcctgtgcaacctgagtctccacagcttcacggtgcatgtctccctccctttgctcgctgtagcaaagaagctctgtgtgctgtgatgagaaagatgtatctgttctctaccactggcccctgacacacagcacctaaagcccttggaatctccacagtgagcatagggtccagccctacagggcttagcaggtgttctccccatgtgcggagatgagattgtaataaataaagacacaagacaaagagataaagagaaaacagctgggcccgagggaccactgccatcaagatgcggagaccagtagtggccctgaacggctgggtgcgctgatatttattgcatacaagaccgggggtcagggtaaggagggtgaatcttctaagtgattgacaaggtgaagcaagtcacgtaatcacaggacaggggggcccttccctcttaggtagccgaagctgagagagagaaggcaccatacgtcagcgttttcttctatgcacttataagaaagatcaaagactttaagacttttactatttcttctactgctatctactacgaacttcaaagaggaaccaggagtacgggaggaacatgaaagtggacaaggagcgtgaccgttgaagcacagcatcacagggaggggtttaggacttcggatgactgcgggcagactgggataatatccagcctcccacaagaaggtggtggagcagagtgttccctgactcctccaacgaaaggagactccctttcgcggtctgctaagtaatgggtgtcttcgcagacactggcattaccgcttgaccaaggagccctcatgccggcgtgacagagggctcacctcttgccttctaggtcacttctcacaatgtcccttcagcacctgaccctatgcccgccggttattcctaggttatattagtaatgcaacaaagagtaatattaaaagctaatgattcataatgtttataatgattgataatgtccatgatcatctctatatctaatttgtattatgactactcttactctattttcttttttatactgaaacagttgtgccttcagtttcttacctcggcacctaggtaatccttcgcccacagtgagaagtgtcttttcacatggatgactgatgtccaggctctcctggatagcctcagatgggggctggttaccaggggaactaataagtgattagagggttgagactttcagccccacccccaacctctgtgattagggagaggggttgagttgatcaccaatggccagtgatataatcaattatatctacataatgaagcttccataaaacccccaaaggacagggtttagagaacttccagattgctgaatatgtgctggagcagggtgcagggggtgccagagaggggcaggggccatgccccatgccttgccctgtgcatctcttccatctgactgttcatctgtatcccttgcaatatcctttctaataaatgggtagatgtcagtgtttccctgagttctgtgagccatcctagcaaattaactgaacccaaggagtggaccacgggaaccctcatttatagcacgttggttagaaccgcaggttaggtctggcgattgccatctgaagtaggggagcagtcttgtgggagtgggcccttaacctgtgggctctgatgttatctcctgggagacagtgtggggattgagttaaattataggacaccctgctggtgtccactggagcactgcttggggtatgaagccccccagcacatctggtgtcagaatattgtgttgagtcgtgtgtgagtgtagaaaggaagaaaacagtgttgtttttcttcagagccatgctcacaatagaaagcagcgtaatataatgaaaagaacaagaatgggcagttagggactcaatcctgggttgacagggacatctatacacaatctgtagaatactgttgtcattggggataaaaaaaattatacaaaattaccttaggtaccagaggctctatcagatattagttattatcatagtattgggcatctgtttttgtggctctcaggaagtttgagagagtcctaatttaggagccaaccttgatagttattactcgtaaaagcttgtaacctctagagcaacagtcagcaggtgatggcctgtgggccaaactacctgtttttgtacaatctgaagctaggaacaggttttacattttaaatggttatataggtaactacatagtatctttgatctcttgcctctttatcttccaaacctaaaatgtttaccacctggccctttacagaaaaatatttgccagtccctgctgtagaaggttatatagccagcagctttcaaagtaaccttttacctggaaatgtgaattctctcttagttctggtcatctgttatttgtgggagccaatcctctctctgttggctgatgatgagaattctgttatataccacaacacaaacttggggataaaactttccattaggcatttctgtaaaatttccatctattttagaagcagaactaaggtgaagcccagtgtgaatgaatcctgcttgttggtacaagccaagtgggacatttggcagcaaagcccaggagtccttggtgctcttcttttaactgcctcctcatctcattgggctgcccggtgttaactggttgattatcacctctgtgttttgcctgcaaggaaagaagctactgacacccagagtggctcagcgatactcacacgtgctttcagttactttcgcagcatttggttaaagtgagtttagctgcacatcctcacttggtaacattctgtggctgtgaaaattgtttctctctttatcctcccccagcaacagccatttggtatcatctgagatgtgcaccaggaggcagatctgccctgtcaatcatgagagttcctatcattaatcaagtattttgaattcaataactttttttagtgttttaaaagtatttactggtccttgatgtattttttagcagctgatggaattcacataccatataactcaccccctcgaagtgtacagttcggtggtttttagtattttttaattgcacaaataccgtaatttgagaacatttttcatcaccccaaaagaaactgcgccccattagcagtcattcccatccgccctgtcctaggcagccacttaatctactttctgtctctgtagacttgcttattctggacattttatagaaatggaagcatatgtagctgatctttatgactggcttctttcgctgagcttcacgtttctgaggttgacgcatgttgcagcatggttgattttccctctgtggtttagatagcaagatctgcctagtagagctttatgtgtgcaagtgccactccaccagaccagtttctgtcactgccccttcatcaggccagcttccttaggaagcttcctgttgcctcttggcctcaccagtgctaccattttcattaccgtctattccgcagaatacacgcagtgccaggctctggtgagtcccacagtgaccaaggcagcacgatccctcctctccctgagcttagagtagaaagcgtcagttacagtgaaatgtgatggtcactcttctgggagaaatgtgtagtgcagtcaggaagagtcaagaaattgtgtctggaggcagcaccgtcggaaactctctacctccgtctccacccctgtgtccggggtaggggcagtgcacgtgtgttgcaaaggagtccaccaggaatccaaagggagcgaattctcatgtgtcccgagcatcctcagagacagcaagctggcacgtggcaccctcctcagcacttttcctttttggctatgctctttcactttttggtgcaatttgatttgaaaacgattcttttcaagttgctatgcttccttgtcaacaaagcagtctaatcagttaaagctagttcttttatgactttcttctttcaagagtttataagtatatagcatcagatgtggaataagttactagtgcttagttgataaaaatctgcaaattaaatgaaaattacttgcaagaactctattttcagtgaagttacagctacgctgtttatctcaatctgtacctccttgcagaagctactgctgtgtttccagtgcttttgtagttgatcatactgatctttttgacaaaattcagaacagaaagataggatcaatctaaagtgtgatccttttccaagactgactcattaagtgaccttgagaaaatcatttctattttccatcctgccttggtgtcttcatgagaaaaaagagcgaggtacagtctcatgatacctcagaaaacaagcaaatgatgatgatgtacttggctttttgaagatgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttgtggagaaagcagccagaggccaggaattttcagagtcgtgagtcacgatctcccacccaagattagagcacagattagccatactgagatttggtaaaatcattctgtctaagcaatggaggtgtgtgcacacgtgcagtgcctgttcacaggggatgcaggcagatcgtgggtttaggatgggggaggccaccgcaccccccttcactgctctgcacctgctccctcacgtggacactgtccacaactgtggctctcacaggacagttgcccaaggagctcatatcttattggagatagggggtcgtacaggtgacattcatgagcagtgtgagccgggtgacatgggggtgtcaacccagcatctgtccaggagctcctcctgcagcggctctggcaggtggcctgaggctcctttttgagagagaactgtttggccttccagatgttctttaatataatgattgggaagagacagctcataactagcttaaggctatctagtccagctttccattttacagctggggaaacccagactcagggttttattctctgttcacttggcggcttggctgagttctgtggaagttcagcagagcaggggaacaggagggtttgggttgcagagaaagaagccacttacagatgggaaacaggagttgggccctatgcaaatggaagggaccagggagggcactttaggtggcagggacagtttgagccgacatagtaatttaggatgtaatttagagaagtaatttacgatggggctggtttgggcagacctgcaaaacaggacagactcagacaggatgcccgagggtttttggttgaggcagtgtcattgtgaaagggcttcttgtgcacactcactgaccgtggcatgcagattggattggggaaatcttactggcagtcatgtcatccaagaagttgttggcataatctcggagtgcaacagcaaggacctaaacgggcagatcctctcccaggggaaaatcagtagtccttcagcgttggctgggtttgatggacagaggagagctgagtccagacatgagctgggaagtggacatccgcctgccacggtgaacgcagataggcaagtgcgggaatgagactcaggtggtcactgaagacatgaaaatggatgaactctccacggaggaaatgtaagaagaggggaaaccttgagtaatccccagtctcatttttaattaggagtttcacctctgtttctgtcaaaacatttactgtaacaagtaccaaaactaattttaattttgacttttactttataatttgtgtgtagagccaatgctgggaaggaaaaaatgaccccaaatttggcagacaaaagaatgaaggaagggaaaacagaatatacgatgcagaaatggataatccacactctgagagatgcacttccattcttatgtcttcaaggccactgtctcagtcctcgctgtgtggcccttaccgtcaccagcgttcagtgcttacaggtgtgtcactcagtcgagggagtgaggaagctgcaagacaaggccttggcatgctcttcctgcgctgatgtccctgacctgcagctgggctgtgggctgtggaaccctgtggtccccccacgccaccctctcaccaccacctcctcctcacagagcagccttagcattctcattctctaccaaaaccaaaaccaaaccaaaacacaggaaaaggttgggacacctctggtcctgacggtccctggaggaaaagttccccatgaggagtgatgggtcagtcacgttttcaaaacaaacgagagccaggacgcaggcctgtggctcagcccgcagcgtgcttggtgccacaagcccccccgcagctgcccagagtctcaccccactctgtgcagggggcctggagggcagcggcggcacagacccactggacgccctggtgcatggctgagccatgtgcatcccatggctctctccagagtcccttccctgcacctccagggcctccccagatggaactggctgggagccgtgctttgttgaaacaaagggaaaacctgtctctcttgggtttgcagctgctgttgaaaccaactgaacctgtttgtaaaattgtacctatgtcacagtaagatcagctgtgctaggtatgtcaggcctctgaaaagaaatgtcattaaagtaaacaagacttgggacacatgtctgtcagactgtacacagtagaagcatcccttgcaggggctgttgggttgcatcctaagctgtgctggagcttcccgatgtactctgtagatgtctttgcaccttctgtcctcattgccatccccaatcagtccctggaacaccagctgtggccctgacccttttagcccctgcatggaatgcacaggcaaggcgtgtggcctttgggactccagccgactagagcaagacagaggaagaagagacggggcagagggcagccgatagttggaaacttctgtcccctaagccaaaaggttctcaaaactgagcaacaggatgtattgtgtctcctgatcgtattgccatggaaactgccttctgttctgcctagaagaaatagtactgtttgaagtatctcatccatcaacactggtcactgtgagaaaccacaaaggaaaagtgaaaccgagagctgcaaaactagcctgggactttgttcaagcgatcatctcctttccctctagtttattattttttccaatacctactgagactactgctaagcagcacagaaagatacaatacactgtttttatagcacgacacaaagatcatgggtggcacttcacatgacagggttagattcagtcttctgagttttctaaggttcctatttttaagactttaccaaggaaccaaggctttcaaatatgcagcatggtttcttctgggcctcgcgttgccccatctcttatccaagtggtgaatgtgttgccagtttgtgtgtggttctggtggtgggctttgtttggttttctttttttgggctttgtttggtttttccccagttttgccacaaagcttttgctgaggacagcagcctctgtggtgtcttttctctctgtattgtgctcactcttgtagtcatgcaccacataacaatatgttttggtcaatgacagattgcatgtatgacagtggtctcataagattatgatgccatatttttgctatgtcttttctatgtttagatacacaactaccattgtgttacagctgcctccagtattcagcacagtgacttgctgtacaggtttgtagcctggtcgccataggctacaccaagcagccttggtgtgtagtaggcgatcacatctaggtttctgtaagtacacagcaacaaagtcacccaacagcacatttctcagaatgaagccctgttgttaagcgacacgtgactacagttttaagtctaacaagatgcctctcgttcagtcctgaagtgcttcttgtttagtttttaatgtacgtttgttttgttatctcagccaaactcttttcagggccataggaaattagtcatttctctgtgtcacagcctccttatctggccccaggacagcgcactacgcatagaaggcaaatgagtaaaactaagtgtaagcatattcatacttacaccaaaagctgcagcttccacagagcacagggaattgcaaataactgtcttctatgaggagctgccatttgtggtttcaccagtttcccagcattgcttctttgtaactcctggttcttgtattagaagaggatgctatgtccatgaagaatgtaggtatcaagcatgtcctttgggagcctccttgctttaacccctctcaccccttccaccccgccttcattagtaacccatcacctgggtcttcatatcccaactaactacagtcttggctaagaaaaccccatacgccttaactcagcaatatgcctcactatgtctttgtccattcagttatccattttgcaactgtttcttgagtgcttgcatatgccaggtcgtacaggaggccaggtctacaaacaggacaagatggagaatcacagtccccgtggagctaataggctgttgtgagattcaggccggttagcctgcaagtgaaatgggatgtgctgagagctgtcctggggaagggatggtgaggtgtgagagcacgcagaggagtacagggtggtgagagcaggctccccagcaggagtagagaatgtgagggcggtgttgtgagaaagtgactccagtggcagacaggagtctggtaagcccaggtaagaaatttctgtcggattctgaaagcaacagggatgcattgagtagcatcaaaggggaggatgtctgtagtcatccgaaaaggcccttaatgtactctccctttcttttctaactgtgtatctatgtggctggatttgcttcatgtacttcaaaaaccagagtaacagaacaaaatcgaatgcagaagcagatgggagaatccagcaaccttctagtaagtcagacattaaagagatttgcaaaaatggaaaacagtgccactcttctcagtaattctgtttgggaaaacatggttattttttatttcaaaaatctatatttatgttagcaagtaataggcttgtgattgttaatgagttattaaatatttttaaattaataaaagggcaatgaggagccagcaaagggtttctaagtagaggaggggcttgacgagatttgtatcttaggaactaactctggagccaccccggccatggactgtggtctcacacggggcagtgagagtgagggtggagacagtggcgggggagttccagtggacagagcctagagatctggtttatgcagtggatggatgtggatgtcacaccccaagacaggggacacagcaagagatatggggtgggagatgagtttgtttgggacgtgttctatcttaggtgtctccttaacatttagatgaaagtgtgttcaggagacagtgggttacatggctctgagacacagtgtttgggttggaggttcgagtttgggagtctctaccccatgaagccctaggaatggatgggcacccagaacacggaagaaggagagaaacactccccacatggaaccttcaagaacacccgtgtctgaaggacaggagtgggaggaggagaatctgaggacactgagaaggcgtagctagagggctagaaagaaagcgggatgccacaaagcctggggaagagaatgtcgaggaagagtggtcagtaagacctggtgctgccagaaggcaggtcacagagcgctcaggaggatccactggatctaacaaagggtgctttgataacctggaagaaaaaggaaaaagtgtttcattattaaaataccagactatgagcttctaaaaggcagggaggttgtcttaattctctttctacttttgttgctgaaagtattaccaggtacattagtagatgtgataattttgtgattttacattaactcattcaagtaaaacgatctagtctttttctgcccttgatctccgtggtaggtcatcccctttgtcagagactcctgttaaatcaacctgtttcctaaatgtgtaagtatttccttatggcctggggtaaagcttcccagccactgtgccatggtcatagatgggctgagatactggtcccctccccgcttgggggcaactggaaagggcctgaagccactgggccagctgtaaacagttttggcttttcctgtggaccatgcaaatctgtctttttctgtgtgtgccatgaggtggaaaacatttgaaagccttggtccatagcacactgagtaagtccttgtgtgggccctgcctcgcctcccgtgtgcccaagcacagcacccctaaagagtcacatcgcccttcgctgcctaccccatggtctcccccagaaccttccctgcatggtggcctgcagggggccaccgattgtagactggaggtgcccctgctgtgtgcttcacacttcaaaacctggcatgctgataaaggctttctgagcaccaaagactgagaagaaagggtgcatttgtttccaatggccaacagtcttaaaataagatgaagatgcttttggaagtcattttggcttttctaaaacatcgcattcataatgccccctctgtaattgttctccattttactcttttatggggcaccaacttgtacgagcagtcagctcaggctgcagtgagctgagagtggtactggccacctgggaaatatgttcaggtcttccatccatcacagccctccaggatcctgtagtctagttgggaagacgagaaacaatactgtataaagtataaggccaagtagtaaggatcagaataatcatagctaagctgcaataagcttatagatggctttacgttctattttaaatgtttcacatgaattaactcttttgattctcatactctccatgtgaggtgggtgcagttattattaccactttacaggtgagaaaaccaagggtcatggaaatgtttgaaaatgcatctaaggtgttacaataagaggcagagctgggatttgagcccagttattctggctctagagactgttcttaactcagcttcctctacctttttgtccctctgccgttattccttagcattgctttgctccttgaaggcggtataaacccacttaggcccctttctttgaacaccttggggaaaatgccttgcttgctctcttctccatcgttgaaatcattctcttttaatattcagccccagccccatcctcttggaagtcttacccctgtgctttggccgcagtgggttgatgtccactctgagcttttctagtccttttgatttaggcctcacagctcccatcttaattatatatcatcttgcattgttctggcttttccatttctgggtatcttgccttcccccgaggagatggggcgctcttcgggagcaaggatgagaccgcgtgcctggctcacactctcctgtggacgctcgagtgcccgaggtcagccacccgtgagctcttctggcttctctaatgtagacactgcctgaccatcccatccagaaacctttcaatgcctgtagaacatggatttctgttccatggaacttctgcttaataaaatgtcagaaacttttactgctcctcggttgggaaaccatcatgtatgtatgtatgaatatatatttattcattcatacatgtatatatacacaagaatttttacttcatttgaaatcttcttacaaactaataataagtatttcataaaacgcctgttcaaactgcaagctgtttccttcttcacttttaaaatatgtggttattgcttttgaagaagacaaagtaaaggaaacatttcctgtttatagaggctcatatttaaccctacgtaaagagcagattcatgtcaaaacatcctagaacctagagccgtaactttctgctttttaagcacttttctactatcacaggagtagagggattggggttttgtttgctttgcctactctttgattctctcactctcttgtaagaaatgaaatggaactcaaagcccattccccttccactgtcctggagtgggtgtgttgtgtgcctttgcatgtttttgtatctttactacatacatacttatcagggtttctcaacctaaacaccattgacattttgatccagaccattctttgttatagcggctgccctgtacattgtaggatgtttagcaacatccctgacctctacctactaaatgccgacagcaccaccatcctgtcccccctcccctccttcacataacaaccaaaactgtgagcagacattgccaaatatctcctggattgggggtaggagaacagagtcaccatgaccatatatccatctaaaaaagttaaaatagaccagacgcaatggtgcacatctatagtctcagctactcaggaggctgagatggaagattgcttgggtccgggagttcaggactgcagtgcgccatgattgtgcctgtgaatagccactgctctccagtctggacaatgtagcaagaccctcatccccaaaaaaagttaaaatagtatatatactcgtgttctgagtattttttaatttatgtaaatagtattacattttatttatattatttacataaactacatacaatttatgtaaatggtatatgtatatgttgtatatgcatattcttgtacaactttatttgttcattaaacattgtatatttgagatttacccatgtaaatctaattcatttattgtagctgcttttataatggtcttttatataatagaaccacttattaatttatttccctccttaggaacaactgaatttttttcattttcttacttaatattacaaccagtgcttcacagaagatcctcatacatgaccccttcagcattcacagctccctagaggtgaagttgccaggtcatagactagaatagtttcactagatcttgacatgttgctctccaaaagggttgtgtcagtttatactctcatcagcaacttatcagagttcccatttctttcacatcattcccacactcagtattgttgggctgtgtatttttgcgagtcttgtgggtataaaataacttgttttcatttgcctttccctaacactagtgagattgaatatcttttcatatgtttcttgacttgggatttccccttctgtaaatggagtattcatatacattatctgcttttctcttgagtcacttatttttttctcattgatttataagtgttgtcttataagttcataagtgtcattgatttattaagtctcattgatttgtaacttttgaattttgagcatatagcagttatatgttgtaaacattttctctcaatctgtagtttgtcttatttaattcagtaacaattgaacttttaatacaaaagttcttacaggtaaagtaatttttaaccacttttttcattgtgatttatacttcgtatttctgttttagatatcctttcctatcctaatgacatgaaaataatctcctatttcttcaaaaaaattttcacagtttggctttccacatttaaatctttaatcttagtttttatttttgtgggtggtgtgaagtaagggcctagttttatcttttccctatctatagccagttgtcccaggactgtattcagtacgggctcataaccaagtgcccatgtttactgttgattcctagactctgtcttctgtttggattttttgcctaacttccactaataccacatgactttaattactgcagtctaatagtaagtcctaataactggtagagaaatcctttcttatatttcttcaaaatagtcatgcctagttttgagctttaacttcaagtagtctagtcccaccaaaatatacacatgtgcatacttttgaattttgagtatatagcagttagggaataggaataataataggaatctgactccacatgacagataacacaacatagcagaaacttaaccgaggtagtttatttctgtcttgtatagaagtccagcagtgggcagcccaggccggcggggcagtgtcctgaaggtgtcagcccccggctctttgctgctgctgtatcctcagcacagggcttccacctgatcctctaagaagggcgagcccctgcctctgaggatcttcctggtcggcccatattccctttctgctgacataccattgtcagaacctagtcaacatggaaagatactgagaaaggtagcaagtcacacgtatatacacacccaagaaaaccaaaactgttttttccaaagggggaaaatggatattggaagtgaaccagcagtctgctagactggagttggcagtgtctggatagattataggattacatgttaccaggctcaattcaggaacatgctgaatctttccatttacttagaaatcttgtagatcttttgtttgattttattcttaactaccttatatttttattgctatttataaatagtaattttttgtacttacattctctaatgatttcaatagagggaatgttactttttaatcatactctcttgttctcatgctttgagagacatttgtaaacactcttggattttctaggtagacagtcatcatttgaataatgagttttgtttctctttttctatctttatgtgagatttttgtttgggtttggtttttgttctcatgctgtgacttgtgctgaatgcaagaattggtaataggcatttttgtctcttcatgaatgggtattgaattttgtcaaattgttttcatacctattgagatgagcgtttgatttttctccttcaaactgttaatgtgtggattatgttgctagtttttctaagatttttgagataaatcctaatacagcacatcatactagataagagaattattttgaaaacattgttggattgaatttgctgatattttatttaggattattgtatctacccaagaaaaattaactatatattgtataatttttcttgctcataatggccttgtctagttttggaaacagtgttatgctagtcccaaaaaattaggtgggaaactctccttccttttctgtactctagagcagtttatataagataaggagtcattaaagatttcatacacttcacctgtaggtttttggtgggtagatttttaagtactgtttcaattacattaaagtatgatatatatccagaaaagtacatgctatataataatagtcatacaaatgtactttttgtgtttattttgttcaacatcatttgagagattcagccatattgttgcatgtcattctggttcattcattcaaactgctttattagattacagtatgtgaatgcaccataacttacccattctatagttgatgggcatttgggtagttcccgtctttgactgttggaaataatgctgctgagaacgttctagtccatgtcttttgatgaacatgtgtttgaatttcttttattcaggagtggaattgctgagtctcacatatggctcagcttaagtagatggtcctgaacaattttaaaagataattaccaatgtctgttttctctagaataagttttaataagttatacttttctagaaagttgtctttcatcaaagttattggtatgaataaagtattcttgtgatttttttaaaatctgccattatatcccttgtattattcttaatactgtttatttgtgctccttcctttgtcttttcatcaagcttgccaggtttgcctattttatttgactttgtaacagccagcagtaggttttagtgactccttctgtttctttgttttccgttttactgacatttgctctcaactttctactttcttctttctcatttttttagattattgttactttctctaacttcttaaattgggtatagttaaccctttaattttcagttttctttttttaatttaatctcaatatttaaaaattacatcaaccactttattacatcccataaactttgataggtaggtaatagttttattcattcttagctatcttctaatttccattatgaggatttttttggtttccaaatgtgtgaggttttttgttttagttattattttgatgttgatttctcatttaattgcattatggtgagaatataatctgtgtaatgtttatgatttggtatttgtgaatatttcatataggatctagtacacaattactttgtaaatactttaaatgtaatggaaaagaatgtatattctctaaatattaaatgcaaggtatatatgtccattcagaaataaacttgttattttttatattattttttgtctggttgatctatcagttactgagttatatgctgaaaattaaatatatgtctggatgcttccacttctcttgtaattctattaatttttgctttctgtgttttgatgccattgtgttacatataaatatgatattcatgtattctattgattttatccctaatactgcctttttttgccttcgaggtctatttatttggcatgaatgtagcaacaacagctttctttgattagtatttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttggggacccagtctcttgtgtgttttgtgtgccgacttgctcatcatgggtgatttccttgtggattttgtggttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatagcatttttaggtgtttgtagtaggaagagtttcagatcttagtctataattttgtcaggactagaagacttctagaaatagagatttaaattaataaattcaaagattgccatatagctagaaacatggatttttttaaagcagcatgtgatgcatttttcttcccatggtggcttcttttttgttggtgacatagactaagccaggaacggcattgctgtcagtcttcaggatccgtggagccaccctcagaaagatggttactgatgctcacttctcacctttttgctgtttgtcagatttcccttcacactctctagcctgttgctgaggttttatcacagtctgcagtcttcctccactgtgtgcgctcaggatttacttcagtcataagaagaagaaaggtagagcaggggagcattttaagggccgtgatggaaacaccagatttctggctgccctcagtgatttagcctcgtctccatgccttccttcctatcacaccctgcaaagccctgagctcctaagagttaactggagttgggacagtcagtggcgtcacagtcgggctgaaattaggagtgtctgtacagtgtctttcactgccttccagagccacagtgcacaaagagcttttacactgcctattactttcttttctcctgagcacctactgcaggctgccaattttgtgctattgactgaaggatgttgtgatacttttgaatttgaattgcttgcatagagcggatcaatatgatacttccttcccagtctatagatgtaactgcattgagagaaagctcttccaagcattatgatgattctgctccttctgtgtctgataactgtgtgttgatctctttttagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagagactttgggcttttttttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatattcaacaagcaaaccaaaaggacagggacaaatgtaaaactgaaaagaaacaaacaaatgctctaactgcatttcaaatgaataacataatcacattgaaggagggaaaatggatttcagtaacgtttgtaccggatataccctcagtctaatgaagaaacaaaaagaactgcaaacaaatcttaaacatttcttcaaggtttagttttcataaaggtatgagtatagcaattctaaaattatgctgtgtgtattatagatttgagcaaatgaggaactcggttgattttattgtggaagaaggaaaataaatatataaagcagggaaaggcaagggagaaccctgtggggttggaaaggaattatcactatcatcgtaaactcatgagagagtgtgtgtgtgtgtgtgtgtgtgtgtgtgtgtgtgtgtacacataccctcactctgaccgagagggctcagaagcagtggcctcctggtagcagtgggctcacctactgcccagatctggtttctaaacactcctccccactaaaaggaaccaggcctatttaggaaaacggtggattccaggcccagtgtagggaacgtacaggatagccctggatcatcgtgtgccaggaaagtaaggaagtgatcagtcactgctggggcctgtcagaaggacactggagccagctgcgggatcccactggccacatctagggcatcggcttggggatcagaataaataaaggatagtaagaatacatgcattataatagtagataaatatttatataaatacatacactggagggaaggaaatgcttttcctaaatggaatgtcaagtaataaatatacaaagaatgatagtatcagaaaatcacaaatttgcaagcatcgtaataaaaatccattcagggaaaaatgatcaatatatgaagactaggctatttatatatagatggtccctgacctataatggtcgaactttaacaatttttcaattttacagtggtgcaaaagtgatacatactcagtagaagccatacatcaaattttgagttttgctcttttcccaggccagcgatacgtggtacgagactcttttgcgatgctgggcagcgactgtgaaccgttctgtttttcacttgcagcacgatactcaataattacatgagatagtcaatactctagatttgtgagagatgatttttgcccaactgtagggtaatgttaagtgttctgagcatctttaaggtaggctagattaagctgtgatattcagtaggttaagtgtactaaatgcatttcaacttatgatattttcaacgtacagtggatttattgggacttaactccatcgtaggttgaggagcgcttgtaatctcaaagtatccctccacaagttacttactaattataaaggaaaaccgtaattctacagaagagaaattggacaccaccttaaccaggttatcaaaattaacatcaccaattatggaacaaagaattattatgttcatatcctgaaaaggacctatcagttatgtccttgtaacatatgcagttacaatcaacatgcataactttgatcgtaagggaaaataagataaacttaatttgagggacattctgtaaaatacctggtctatgttcttcaaaaatacgatgttccagattaaaggagacttgggagtcatgctgcccaagtggaaaatgtgatcctggactggattttgtactggagaaaaaatgtctgatgaaaggccattttaggatcaattgatgaaattggactatggattggatattggtattatatgaattttacatttccaggacttggtacataccgaccgtggttaggaaagagaatatttcttgttcttagaaaatacacactgaagtatgaaggaaaacggcaccatgatgtgtgcaacctgctctcaaatggcttaggaataatacctgtgcatgtcagtacatagtgtgtgattgtgtgtatgtgtgacagagacagagagagaaagcagctatggccaaataacaattggtgaatctggttaaggaggaatcaagagttccaggtactattctagaaacttttctaagtttgaaattatttcaaactacaaccttttcaaaatctataaaagaaagttaagagtgttgccatcataatactttgaagtttccctctgcctgttgtttttccctttcagcaaacaaaacaaattgagatcagcatttcacagctgaccacaccatccacgccatcgcctccccattccctgtccccagagtgaacaaatgccacgcacctgcctctgtagcaaaactttgtcctcatttttcccaaaactcaaaaggtgcccctgggcagggatctcatagccacccatgggtaaggctgtgacaggtgttttcaagagaaaccactgtcacgtgcccattgacttgatccagcccctcccgcttgccacttctccactcagactgatggtttcagcagctcttcaggattaacaggtggagtatggagccacagttttcctcttctacctccactagagaatttctagacaaaggttatccccatggataagaaaagcccaataacctgccatgtgtaaaatcttcctataacatgtttaaaaaataagatactgctgtcaagttcagctgaaaagaaatatcaaaattccgttatgttactgtttacttgatacagcagtgagtcacattcctcatggggcagccgttaagacgaggtatttaaaggtgatatatttctcagtttgggcacttcaggaaaaaaaaagtgtcaaaaagggagtgaaaggagtatgtgtgtgattgaagtcttcagggttgtttttttttttgtttaatgagtcatttttccttgatcatcccagaatgacaacagcgaggttacttcttgtcaacatcagtttaaaacagtacttaatttcttcctcgctccgtgttacgagaagttgtaaaaacatgaggggttgtttttaacatacactttcttatacattgattttctaaatcttgtttttggtgtttcttgattatcctgcaaatagctgttataaaccattgttgccttaaagatgcaaggttcttactggcattattcattctgcaggctcttggtgttctttgcagtgggtactatagagattataaaagataaaaaagatactgttgttgccctcaagatgcttacaaaaaagtttataaatttatattgtataatctcttggccagtttgtttaaccactgtctaaaatatttgttaataacatgttaagataacttgaattaacaaaagctttttttgcttactttttcaattaaatgtttgtattttcttcatttaaatatcagagccacgtaattttaatgcattaagaaacttagtaattttttaagccaagaaaaatagaaattattatttgagttttttctgctgtaaacagatactttaggaatttagtgagagttcaagaaaacctggtagacatgaaatgtatgccatgtactttgaaagcagaatattctaagaagaatgtgcatcctttaataaatccaatagtagtttgatagccatagaaatcttttgccaccttttctacttttgctatttttgctgttattaagattcaagatttttagttcttcagaatccactcccgttttttggtgagtaaacccacggcacctctgccaattcatcacccctcagagatgccaccccagccccatttaagaatatcccaagaaggaggctgctgtgcaggcaggcggtgggaggctgcagagtgccaagccacacagtgcgccctgtgctgcctggcctgctagctagacagtcaggatggcaacagcgatccccggaaaccacaaggcgagatgtctgctcatgccttccctgtgcagacgtgcggggaggaagatcagaagaaaaccccacaagttcctatcaatttcacagaactttccaagtgctcttagagttgaaagataatgtctggggaaagagaagtctaaatctgatgaaaggacaaaggtggataaagtaggctgtggggggaaaatgaaggatgatggaccagctaagggaggcaaggagaaggcccctaatgccccccaaagaccactgcctgttctgttcaggatccccagcatcaaatccatagaccctgggattgcttttggagatgggtagacaagcttggtgagctgtggaatcagtgaccgtgagaagcagccttaggacaccaaggtggggaagctgctggagaaagacaggtggcgtcaccggctctgagtctaaagggaaaatgggtggcaagaaggtcctgccagggttgcccagagaaaggtagacaagaaagaggaggaggaggaagaagaagataaatagaaactgtttgtcaacaacaacagcaaaaatgccaagccaaagaccacttgataaaactccttcgagtaatcaaatacgctcaatgtctgctatcttagaaataagtgtatccaggccgggcgcggtggcccacacctgtgatcccagcactttgggaggctgaggcggacggatcacgaggtcaggagatcgagaccatcccggctagcatggtgaaaccctgtccctactaaaaaataaaaaaataaaaattagccgggcatggtgacgggcgcctgtagtcccacctacttgggaggctgaggacaggagaatggtgtgaacccgagaggcagagcttgcagtgagctgagatcacgccactgcactccagcctgggtgacagagcaagactctgtctcaaaataataataataagtatatccattattccatctctctcttttttattgtttttttttttttttttaaacaggtatctttatactactatgacccatactcaaaattaacaaatgattaaatttttctcatatttgcttctgatttttttaaaaccaaagggggaaaaactcatcaagtgtatctcttctgaccctcccaaagcttagaaaatgactgttaggtaaaatcagacaagaaagttaaataagactagaccaaagctgggatttaacaaaaggaagatgagcaaatttcagcttcctctcttcgattcatgtctttctttcctttagctgacagtgaccagctgtctgctctgcaccggggctaagcgctgtgctgaattctgaaaacactaagatggataaggcggaatgtcctgccctgaggagctgtgagcccagggcagggaaacaggtggacaaagagcttgtggaagtgttcgggtgctgctgaggccaagaaaggccgtcagggcagtggtgttgcagaggaggggcctgaggacaagtacatgggaggtggggagccacggatgggtgggctggagtagaggggactggagggccggggcacttcttgggattctagaagctggacagaaaggaggccagacaggctcgccaagggtctgatgtgtggcatgtggttatactctagacaccaaggaaccatgcgggatcttacacaagaaacaccatcattgggtttcccaagaggatggactggacacagaggagggggcaggttataatcttataattttctctatccaggcccaggaaacatggtgcaactgcccagacaagagatgttaccatttggtgcattaatattaataatacatttataatgcatgtcaaacgacagaattacagcaaatttagtgacagatctatttggcttttatttgcaacttatgaattagtgcagcctccattctacaaaacagaatgtgagctcccgccaggcagtactggaacagtgcattttgtaagaaggaaacagagcaatagaaaaataactgataggttaacattgagttacttcaggttgctttttttttaagggttaaagcagaggggagttccttattatgctgacttgtgtagtctgggatctcctatttttagaaaaagcaggtcttcttgttttgggatctgtctgcttccttaaagtttcaatttgattgtgtggcatttagcatgagtgactccatttagtttggtcttctggtttgttggagcccaaaacaatggcgtcccataattttggtcaattcacatgacacgtcgtgtggattctgtttatgtctctgagatatccattagcccaagtagagagaatggctttaaacccacaaggtgctttcactcttagctgataaatagcaaaatgtatttagtattagagaatctaaatcttaatgaggctgtctcctctcttctcatctcaggaatccttaccactgtctccagaaaacccaccgaaactcctaaaatgctcaccttctgaaagcagggctctaatatttattggttttgagacacatctcgtgcttctgctctgagtagccaagcatggcagcacattgggtattgggttagcctcccatggcgtctggtctccctgtggacagcgagcttcctgagggctggggccatgtctgccttgtttgctaccctatgaaaagcctgatacacacaggtgccccagcatcggtcggagaagggttgaacacgaaggtgtggccagtaaacttccctttcagaactcttgttttcacataaaaaatgtgctagagagtggtattatgccaggtttttccattgcttgctctagtagattggaaatacgttttctaacaagatcccaaagttagatgtgttacaatgaaatactagatggtactcaaatagtaaccaacttttgtggggtgtctcattctgctgggtgctctgagagatgtacacaaaggagctcagccagccttaactaaagacctgctccatacaagaccctgacgaggctctagacacagttggtctcagagcagcccagaacgctggcagggtctgtaataaccagaaacctgagttcaaccaagagatgtgaaaggaggggggatctgcagttctcccaaggaagagagtggtcagacagggagaggggggtgggggctgcactgccttgcaagggtctcggccatgcgtcagcatgggggtgggcagctggtgccaacaggtaaccggtgccagttgctatgacagcagtgggcgaggcaggcccagcacatctgggctcccccaacagggtgtgcatgctaccctgcacccagtgtgagctcaggatcgggtgggggccgtcttcaggtgggcatcgctttctgcaagcgtcagaatatgggaagtaaaaacccaaaaaaaacatttgtttttgacgcacttagctaaaagggaagttaaagaaaaccacactctagtttgaataaaccaaaaggagtctttcactgaggggagttgctagaaatctcattggaatgaatgtcccattttacttatgtcaaagaggagttgaattgcaagtaaaataccaaagtgggatttcatttattttcttttctcttttcctttttccctttttttttttttttttttttgagacatggtcttgctctgtatcccaagctggagtgcagtggtgctatcatggctcaccgcaacctcgacctcctgggttcaagccatcctcccaactctgcctcctgagtaactgggactacaggcacatgccaccaagcccagctaattttttttttttttttttttggtagagacaagggttgcccaggctggcattttcttaaatgagaattatcttgaggtagtaggcacacacatcccaatcatagatgtttaaaaataaaaaataaggaaagagaaactggtacagatttatttccatctctagggtgttttcctcattcagtgggttctctgaaaagcacattattagggaatgtattccatcttgctctcctttggaacattgtcaggtgacagtgacagtgctcttgtggcaacgcctatttctgtcatgctcccctgccttggtcagccagccatgtggaagtgtcacaccagggctggtgaagggctgctgacgcctgtggttcagaagctcgtgacgaaaggcaactgatggagtcacaccttgctccactggggcaccctggacacctccaagagggtcttcatccctgtgggggctctggtggggcaccctggacacctccagagtgggtcttcatccccgtgagggcggagctggagtttgccattgccacagcaccagctgcaccttggtgtcctctgagtagccttatctctgctcctcacctctggaagtcaggtttcctgttacggaaagcaggctctggatgttacatttggggaatgttagtgtctagaaataagaaataagtagatgtggaagacaggaaagcaaagcatgctggaggcgaacccaactagagctggcttctcaatgaagttagaggaaggaatcatttcgatttgggggctagaaaccaagctgcactctaatctgatattttgtggtgaggatttttaggcagaaacttcttgtgatgcctgagcaggaggaaggtactcgctgtgctctgagatggagagggaatgttgaaagaacacctttttagaaaatttctttgagacatttttaaaattttccagaccaatgaatgactgcaagcccatgaagccaacactgacgaagttgcagtatgcagcgccgtgcctcgcctcgcctcgcctcaccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagcgcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaaaatgtggtgctttcgatagggagagagatgggctgaccatctataataccattatttatatagtcatcagagttgtgtatttgctaaactttataaatacataaagtgtattttagaacaacacagtctttttgttagaatgttatgctcaccatttaaaaagattgttcctgtctttctgacttctttagggcccaccacacacctggccccgctgccctccataggagaatagtggtcctgagaggtcatgtttattgagcgctggtcatgtgcccgtcactgttctgggcttctcacatgcatccctctcatctcccaaactgcgaggaaacagagagtcagagcctggtcccctgcatgtggtcacacggggccaactccaaagctcgggtctccctgccaccctgcgctggagtcagacctaagacagcatgcagcttcccctgcatttttatttcacggaagcatgaacctggttttctgtccctacaagttgagtatcccttatccaaaatgcatgctgctctagtccttcagtaagcccatcacatattttctctgtgtcgtctgtagacactttttctgcagcgttagcatcatctccatcatcactgttgtcacagtcaccttgactcagaaccatctcagctatttcaccatgggtcagttaatgaacagctggagcccccttatcgatattaaaaacttcaatatctggctgggctcagtggctcatgcctgtaattccagcaagttgggaggccgaggtgggcagatcacttgaggtcaggagttcgagaccagcctggccaacatagtgaaaccccatctctactaaaaacacaaaaattagccaggcatggtggcacatgcctgtagtcccagctacttgggaggctgaggcaggagaatggcttgaacccaggaggtggaggttgcagtgagccgagatcacatcactgcactccaacctgggtgactgagcaagactctgtctcaaaaataaaataaaaaataaaaacttcaatatccacttcttctggcttactgacagactcgaaggtatattttttacctgttaggaggtcaggcatcattttatcctcatttgacatgtggaatccttcaaagtcaccaccttgttcgtcatcatcactgaacatagcacaggccagaggttgtgtcaggcttgcatagctgtgttctcagtcactgtgttccatgcattggcaacagcatgtgtggcatccttcacgctaaacgcctgttgaaaatcttccatacccattcatttgttgctagcatgttgttcaagaaggtacttttatatttatccttcattgatctaagaataccttggccacatggctgaattaatggagtcacatttggggaaaagtacatggcataaacatgatttttgatgagatgtcagctggaggatgaacagaaaagttgtcaaggtataacaaaatatttcagtcatcatccagcccagcttccctgcagtgagcacaagccacaggtccaaaatgtttgtgagaccaatcagaaaagatatccctagttaaacatgcctttttgttagcataataatggtctggtaagaaattcgctgcttgaaaacagcaaggacacaaacttttgcctgtcatgcaagtttacgcttatgcatgcctgctgcattagcacatcccagcaaagttgttctgcccttgatgtcctcagttcctggaggggctgtctcattagctgtagttgtgtctttctggagcaataaaaccaaaacagtgatgttccatcagcattatagacttgttctggcatcagatttttgtcagcaatgaccttggcaaactcaccaatgaatttctttgctgcttcatgatgctttgtcaccacattaaaaaatttggtttcatgttttttcttaaatttctgcagccaacatgttgaatattcatagttccttttcattttcagttcctcatcctgatagatccttgcttgtttcctgacccacatagcattaagtggcaggtgttcactgcaacaccaagggatccatcctcggtacatgatcaggatcttcatttttagctttatgcagtgtttctctatttttcattaatttctgtttatcacttttagcacagaacttcaacagtttatccttctgtttcttcagatcctatatggtggtcactccaacaccatactctcctgtaagacgtttcacacttacactgctctccactttctccaacagcttgactttctgtgctatagataaacataaatctttttcttatcactgttacccagagggtatctgcacaccttttagatattttaacaacatttttataacacagagcagaaagtaagcaaaaaagcacagtgagtgacgcacgtgggttttggccccatgcaggtcattgtggggaacctgcccactggcatgtgcttgcgtgggggagtcggggcatgtgcagaaaaggcatgtcacagctgaaggagggtgagagggtctcttttcccttggagacactgaataaactacgtgttgtggcctgcattttgactgcagcccatcacatgaggtcaggtgtggaacttgccatttgtactgccatgttggtactcaaaaagtttcaaattctggagcattttcgattttgaattttcagattaggaatgcttaacgtgtgttttgcttacctgactgcacgtctgcgcaggcctcaatttcgtctttctgtaatttgagcacaggagttgatgcttcacatgccgagtaagctttcccaggagagaccgtaatgagatgtgtggggactgggcgtgctgggcttctctgagcagaggaatagtgagagccacagcagtaattgttagtgtccaccaaagagccctacagacaactgttctctgtgctgctagtttttgctccagttcttactgtctatatggtgaacctctgaaactacataaagaaaggacagcaggggccacttggctaacttgcacggctgtgagcactgcactgcacccctccactggggagtattgggtaagcacccatcggaacacctatcccctgacccttctcgtccttgctggctggttgtcatcgcatacccaagcccaagcatgcagtttcagtttgccatggatgtttagttttggacactatgggaaaccttcaggtgccctttcttagtgtaattgtttattctttttaaagaactgtgctaacattattgctacttagcaatagtttttaatctggtgaaaataacaggtcagtgggcagtgaaagttctcctgtcacacttgtcttctcacccataaaaatcacttaaagctctgaagccagctttggctaaaggggcatgatctgccccgcagaggatgaagagcgagcccgctgcaagctgtgacagcagacgctctcttctgccaagacctgtgaaaagccagtcttagttgtcaaaaccagcaccgcggcacatgtcgttcatgtctgagagaatgaactcagaaggaagtctcgtgtacatagaaagctttcgttcttactctaggatgtcacctacgtgacttacaacccagcccagccatcccagacctaaggggttcttccctctccagggcagggcctgcatgcagtccatgctgctgccctgtgttggtgacctgtgtgtagccagcccattatcagcatcctgtggattccaaaccaaatgtatcatcagtggagggagagctcaagtgccaggtggagctgtggcctaaagtcacacttcatcactccagattatgaatcgtcatttgccagatctccaaattgctgagtgtggacagcagatggattcgtttgtgctggctgggtgcaaagaagcagccagtcctcagctgcacttgaagtactacaggtagtagtaaaggtagcttttccaagccgtttaaataaacgtcattaagagtggccaagttgtttgggggccatggcatcatggtggtggatagtaggtggaaggaaggcaggccagctcccgtttggcctgagttatctccaccaatgacaatggtccttaactggaaggaacatcatacaggttatttccacccaagattggaaagaccaccttgatcagagagagttttccttccacatgacacatatccagcctgagtcctccagcccctctccctgcacaacctgatggaggcttgagaaagcacagggaggaacacttagcttgaaaatgttcctaaggaaaaggaaagtgtgaattctgagaaccaagtggcagaattgaagtttcacgtctggcaaaagcttaaacagattattatcaaatagatggtttgtgaacgttgaaaagacagctgtggtctaggacaccaaaccaatcctgttggcaagagatcaccaagacctttgacaacatctcatcagcttatgagagatgttggtgacatgcagaatggataatgatagtgcaatgaagtgggtttgaaactgattaaaaatgttgattaaccccttgaacacagagttctgggctctttgacctgacgtgtttgacattttcatcaataataacttgaacaaagttgtagaggtttactaatcaaatttaggcatgatacaagtttgagggagatgattaacagtagataacaaaatgagaattgaaaataattcattttggttgactggaaaatgatcagatggagtttaacagagatatgtagagtcctagacttaaaaggtcaggtaggatttgagagacctgacttgacagcattttatgtgaaaattcctgagtgttttcagcaggcccagcttaactggccacaccagtgatgcagctccttacacaagtgcatgcacaggcacacacaacacatatgcacactactaatgcattcctctgctctcattgaagctaagggcccagactgttggagggcagtggcctcactgccctggtgagaccacacccgtggtgtcacactcagttctgggcgcggtgttctgagacggtgtgcacaaatgggaggggatgggctgaaaggaactggatcctgaaacacaggaatgagcaaaggcagccacagccctcatactgggagttcacagtggtggggagaagctatcaccccacagacacagctgcagggagcccaggacagaaggcagtggggcaatgaggacttcgctctgggggccttctagtctgggagacatggaaaaaggcaggggccccaagacccaccaggggaagaggagtcatcaggctcagggcagagggcagagacagcaacacagcagaacaagccacggtacccacaggcctgggtgggggccgagaaaagccagtgggttgagggaggaaggagagggctgtcacacccgcaaagtgctttatgtaggaaaagagaatagggttgttctcggttacttcaaagggcaaaatcaagagctgtggcattgtgtggatggcagcttgtgaggggcagaacaccagggtggcagcattctcagccacctggcagtgaggccagggcactcagccacagctgatgtgcatatgatgcattagtagtgtgcatgtgtgtgtgtgtgcctgtgcacgctcttgtgtaaggagctgcatcactggtgtggccagttaagctgggcctgctgaaaacactcaggaattttcacataaaatgctctcgagtcaggtctctcaaatcctgcctgaccttttaagtctaggacagtacatatctctgttaaattccatctgatcattttccagccaaccaaatgaattcttttcaattctagttttgttagctactgttttttgttttttgttttttttatctacgacactctctcctctggtgggaaaacaaactagaaggtttctgcctttgctctacgctgtccaccagccctgggcagctgagcatgaatcacctgagggcgccatagtgtcccaggtgctgggcatcttgctgctccaggacagccctccccaccgcaaggcatttggaagacacctggcagcccttcttggcttcctagccagggctgtgcgtcagtccccgtgctaagggttgaaagcaacgttccggggaggagcacgctcactgcgtgcatttgtaagcctagtcctcacccactgagtggtcccatgacatgggcggcaccccccgtttggaaaagccctggctggactccagcttctgagcagtgtccactgcgtgtccctgttggccctcaactcttccctaaggcttttgggggaggagggtctgggtgtctgggcctgggtggtcactgggaggttccctcccccacctgcctctctactctctgcaccttcttcctcaccttgctgagtccttaggttaattttgctcacaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcctgttcctccctgcttctggtggctttcactgcctccttcctcagttgctgccccaggctcagccccactttgctgcctgcgtaagccccaggctgcgagtggcacagctgtcaaagtagtctgagcacccaaaggcaggcagttctgtggcagtgacgccaggagtgcgatgccagggccgagcatggcagtgacgccaggagtgtgatgccagggctgagcgtggcagtgacgccaggagtgtgatgccagggctgagcgtggcagtgacgccaggagtgtgatgccagggccgagcgtggcagtgacgccaggagtgcgatgccagggccgagcgtggcagtgacgccaggagtgcgatgccagggctgagcatgggtcaccaccatagggaatcaaacgacgctgagtcgtgtgtcctcgcagtgagcctgggcagctcatgccgacctgcttccaaggcctggtcccagtaggccactttaccctcagaagccctgtgtccttgtctgtagaatgagggttatgtgcgatcatgcatatatattggctacacatagtgaacattgaaaaatttgtacctggtataacttttaagtatcagattccatattgaaatgaaaattggtttttttgtaaacagttttgacctttgccacaaggctcacatgaagaacatttggggcccagggataagcggcaatgtcagcgccctcaggtttctgcgttttctctgcctgcaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttcagtatttttctatcagacttgtacaaataaagccttgttccaggctatacatatttaccagtcaaccaaatcctccgcactgctcgtctttcttcagaagactgggtgctcatttgaagtgagtgaagtgcttttgttcctgtaagtagcactgcccacagtggcattacctgtgcaaacctggaagctcggcctcactgaggctgcctggggccactagctgctcagaggggggtcgaggtgactttcttggagcccagctggtcccacgcacaagcccctccttgaatctgaattgcgccatctcgggttgcaaggaacagttgatggtggtggagatgtccctgacttcattccctaactaggccacagtcaacacctcctgagtgctgagcaaagccgtgtgtgtctgacctctgaggcaaaccaaaatccactctctgtgttccccgtgcaaaggagcacaggcagagaacacccaaaaatacaccccctcctccatgctacccctttaaacagcacctagccaagtaaaaccaaaccagaggcaaaggtatcccttggagacgggggcagcaaatagcccctttgcaagtagctaattagaggccttgattcacacttgccagctgttcttgagtgtttgctaatcaggattccctttggaatgagattgtattttggagacctttgtcctgcccacaggaacctcagtgaccctctatgttggttgtttagagagtagaggattgaggacctaaatagtggcagagctgggagacaactacaggcttggtttgttctctttagttctttcagcctctttcccagttccttacagctgccaagtcctcgcctttgcagtggtggcccgtggttctccatccttgtcatgcaactaccaggccactctccctccatcaccaccctctggacacacacacacacacacacaacacacctgccttttcacgcttgaccatgttttctgtcttactggggttcgcgttgctcacccactcttgcttcctgcaaatattgacacaaaaacatctacacagacattccccgcagaagtttgaatacctgagagcttccacacctcttgtcaagacactgggactcttttttcaggccgatggcacccccaaggaagacctgcggagccatcccagccagaggagggcgccagtgagccacttgactgggcttcctgaggtctagaaaaggtttagccttttgattttgtgcacgtggtaacagatggggcttaatttttgggtgagcagattctagattgtgaattgagaaggtaagattttccatagtgaccccctgctcctgacattaaggaaagcctgcctgtgaagttctgatttgtaaagctagggtgagtttgggttagaaaggtggagatgttagggaaattgagtacaaaattgtgaacacattccagtgtcatttagaatattctgtgagtccctgagtttacgttcctacaattgttcttaagttgaaatggaagtgtctaaaaccatagacttaagaattttatcttaacctgagagcttacctgatacttaatttgtgagaatcaggagtattttcttcgcttccaagttcccctaaccaatagtgtttttgtaaaggggtggaccaagaacgccaaaatgggctttacagctcagactaaaattccagctctgagactgaaatcttacacatgataaaaattgccagaagcatgtgaatttataacctgccaatacagccctgtctgatggagaaacaaccccactagctacattgtaacaatgccacggatagac

SEQ ID NO: 15594 - DNA, 59948 bp, Human
ctattcacagcaaaatggcagagaacctactgggcctctttggcttttggagatagaatatacacttgggaatacagcttcaacacatttattgggtggtatggaaagctaccaatttgagtggatccctagcaagacagtgctctgcagcaagtccctgctgggatgcaaactgtcttgctgtccggccttgtgtctcagcagatccaatgctgctagtgtccctggaagataaagatgctgtgtgaagtcttaagcaaccctaacaggtgaatcacagtgcagaacctcagggatctggaacaaggcaattcctttgacagtaagtaatttgaaaagcagcccctggcatgcactgagtccagcagagactaagagtctggcaatgtaactctagtgataatgcaactaagcccatcacgagctggacactgccagttttaccaagccaaagtgttaggtgagtatagcagcaatccattagataacgatgaagaggagttaaggtaatgaaatacctctgaagtcaaagaacagtggccagaagaacgtgggtgggagagttggaagtttcccaagaaatataagctcagcataatattatctttttctgactccctaactgctctctacctgaatttcctctattaggtgcagaatagtaatatgcactcttccccaggtcaaatttatggagttatcattgataacttctgctcatcaaaggcatcatcccttaaaacagaatctctttaatctgtgcctttctccgtggctactgttttaattttttcagcatttatttctcacacgtttttcacattattgacaagtgatgtttctgcatatctgatcatcccatttattcttcagatgtttaccgagcattttctatgtatcatgcactgggttaggccctggataaataatgtgaagaagaaaaaaaagacactgctactgggctcctggaatttgcagtttggtgaaaaagatacatgacaaatcctgcttaagatccttcagtggttccttgctgttttcaggaagcccagatgtcttgaccgggttgcctctgtttacctctacagcatcacctctaatcagcaccctttactctgcagccacagtgcgttttcccttcttcacagcaccttcctctctgcctaggtaaagtctaccatcttttaagggttcagtccaggaatccactttttcaggaagacttctggacactctcttcccccttcctccgtaattccagcacacttcatgccatcactatcatataggtaccacgctttttatcctgattctccgttgtcttgtccactgcctctactccacagtgaactcaactttgtgtcaatacttagtacagtgatttctagtactcgacattttttgtcaaatggaatcggatatatagaaacacccgctgcctcccgcaagagcagacaaggccaacccatcactcctgcaccccgacaaaggaacaacagcaccgtgctgcacggcgtcctccggccttgctgcctggcaatgggtagccacctggcgtctgtctcagaataggactccgcggcacgcctcctagcgcagtcggttgacactgcaagaatgggaaggtgcgggtgaccacgcggtcccagaccggcgcaaggcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtgagaggcccgtcaaactctttttggtgtttaggcgctcctcctccgggcggtgtgttgggagggcccaggtcaaggcgcgcgtgggcggaagcggcggcggcggcgaaggcggcggctgtcagagctggagggccgggcaccgcggccatggagggtcaacgctggctgccgctggaggccaatcccgaggtgggcgcgcttcggggcagccctgggccgtgggcaggtgcagagggagccggcttgctgccgcgagtccacggtggtttgtctctaaagcgtgttctctgtttcgttttcaggtcaccaaccaggtgagtgaggtgtctgtcgctcgggacctcggagtcttttctgtctgctcggtccgcttccctgctggactccacctccacgcttccagggattctgggatttaatttcttgagggcccctcttgttcggctttacgcgggtccgcccctttcagaaagggccatctcgctgccacctggctcctgaagattctcccaccactcctctggtcccattctgcagtcaccacgtatcttggggactccgggtctgaggtttggagggacttttaccctgtattcctattccccttccttcttcgttttgcctcctgttagtgccgattccataattttcctaccggtgtaccttttggatgactaatttgcccacacttcctgactccaagctttgtaaactcgcccacccagtccttgtaatttcatccaccgcctgcactatgaaatcatcttccaatcatctcttgccccatgaagtcacttttcttccccgccacgccccctttatcttccagtcttttaaagctggacatttagttgctgttgtatcaaagaaagctcagtttaatagttcccacgccattctttgcaatctatagcaatttaagttccttctgggtgttggaggttgggggttggggagggaggagggaacatctcccagccactcagaagagtaagtgctaccaggtataaacttttgatctgctcaggtgtgccttattttaccctgtttttttttttttttcattctcaacagctcatttcttttttactgctctcctagtttatcatactccctttacctccactatcttccttctcatcaccaaggaacaattcaccgtgttcttaaaaatattggtttttggttttcaaagcttgtagcaaattccctggacaaagagacatcctctgtcttgctctctatcttagggaggaaacatttgatctttcaccattaaatatgttagctttaggtttttggtaaatattttttaaatcaggctaaggaagttcctcttttccccctagtttgctgagagtttttcttatgaatctatgttaacttttcgcaaatgatttttctgcatctcttgagatgatcatttaaggaagaaataataccaattctacataaacataaaagaggggagacggccaggcgcggtggctcacgcctgtaatcctagcactggcgctctgggaggctgaggtgggcggatcacctgaggtcaggagttcgagaccagtctggctggtgaaaccccgtctctgctaaaaatacaaaaattagacgggcgtggtgatacactcctgtaatcccgggtacttgggaggctgaggcaggagaatcgcttgaacccgggaggcggaggttgcattgagccgagattgtgccactgcactccagcctggatgacagagcaagactctgtctcaaaaaaaaaaaaaaaagacacttcctaactcattttatgctagcattatcctgacgccaaactagacaattcatattaagaaaactgcaaatcagtatcccttatgaacatggatgtaagaaatcctctacaaaatattagcaaatagaatgcagcaataaatatataaaaagtaacatatgaccaagagcagtttatcctggtgttgcaaagctggttcaccattcaaaaatcaatgtaattaaccatatcaatagactaaaaaacaaaactttttagatgatgttgattgttttaacaaactaagtttgtgtaagtaggaacttacgtcctgtgattcagctgctagtggaccttgtttctagggtgtcttgaaaaactatcaaacacattaatattttaggggcaccttttttaataccagtaatctgaacaggagctggtgattctttggtgattaaaatattcatggttttctgcttttcaatccagttgaaagacagtaaacaagcaaacaagtcattagcatttattataagtacaataagaaaaagaacatagtgctttgatagagaccatcagggaaaatgtaatacatggaatagtgacaggagacctttctgagatgatataaacagacaaacaatgttatttagtatatgattgtacactatatctggcatgctttggcatgatttagtttgttttaaattgattttttaaagaaataatgtgcttttagtgggagaatgggcaagtatgtaagaaacggttataactaaaaattttgtggttgtttctttattctctatgttttagtggcagaaccaagaatagaagatggatagaaatttagttaactgacttagaatttggagaatgaataaaccctaacagcaatatccatcccactctcttttatttcctcaacctaatggaatggtaggatcttgaactcactctgttaccatctggtaattgcatgtgttgttattataatcaatgtgagcaaatactgctttaggctctgatgatgcctagtgttgtataagaatggccatcacatgtctactatatgcagatgagtattaattgttagacattagctagtaaccatgtgtctcagcagatgtggtagacagtgatttctcttgttggttagtatgctgtcagcccttttaaggatactgtgttatgctacaggtaggacttaatcagaataaaatgagttaagtgatcaaaaaaattatttaaacattttaaactctactttatttacctatgcatttaaaggggtaaatgcagcttgcagctgaaagttacagataattaaacatcaagaattacaacatttatagagtgtgatataggcaattattattatttatgaccgtactaaatcttcattgtgattattttttgtgatttgagtacagtacaaccacattatgtatattttacatattgttgtgcttcagaactaatgatttttgtttatatggacccctctccaccccaaggattattattcctactcgtgattttattgaggaggcaaaatattttctagcgtaataccgaaagggaaataaatttactttagcataactattctatttagcctgtatgcttagagttagaaaaagaattagaggtcatctgctggcttattgccttaaataatcacaataaataaatcatataaattctcataagaattctctaattagtagataccattttaggaaaaaaatctttgttatcctgtcctccttgagctgctgccttacctgttttccttctttgtaaactttccacaaagaattgttcatagctgctgcaactgctacctcatctcacattcttttccttattcattcctgtgtagcttgcttctgtgtgtaccatttcgtagtaactttttttgtcaagttcactaatgattgccactttgccagatccagtgatcacttttctgtcaccatatttcttgacctttcagcagcatttggtagaatagctcactccatctttattgaaacattatcttttcttggcttctgtgagaattctgatggtcctctattttcctaattgcttcgaagagtctctgttgctagatcatctcccttccaacttctaaggagcgcctcagccacttcatcctagactgctcatcttttttatgtgttttcttgccctagtaatgttttctgttgtatagttctaataccatcagttgtcacatagatgaccccatgttccttgaaaccctaacattgccaccaaattggaaacctgtatattcagctaactctttggtatctccatctggatgtcttatagataccttaaagttaatatggccaaaaaagaaatatgggttttcatcttcccatctctgctctaaacccttttcttccccatcttccaagggcatagccatccatgcagtgtttgaggtgatgagttgatgccgttgattcttctttcagattgccattccagagaggccgtagtatcttgatttgattcttggattgtaatctctgctttgctatctaccagctctgagaccatggacagttatctaacctctttgtgtcttagttccttaatttctttctttcttttttccttttttaaagacagggtcttgttctatctcccaggcaggctggattacagtggcacaatcatagctcactgtaaccttggaattcctgggctcaagcactcctcccacctcagccttccaagtaggtaggatacaagcttgcaccatcacacccggctaatttttgtattttttgtagagacaagatggttttactctgtttcccaggctggtctcaaatgcctggcctcaaacaactagttccttcatttcttataatctcttctaatcttgtaagatcactataaggatcaaattactacatataaaatatgtagaacaatgtcttgaacaaagcatgctctccatgaatgtcggctatttttaatattctatttctcattcctcagatctaattgatctgcaactcttatggactcttcttgcaaaggctattccaaatacggctattccaaatatggctattccatttcagctgccacagtgcaagccaccatccttagcttggacaactatagtaggctcctaactagttcttctgcttctccttttgcttccctaaaatctaatttccatatgcacccaaagtggccttaaataaatgagaatcacatcttatgacttcctgcttatcatactctactggtcttccaatgcttgtccttagaagatacttgaaacttttttgtttttttaaacttttagcttcaggggtacatgtgtagatttgttatataggtaaactcatgtcacagggatttgttgtacagattatttcatcacccaggtactaaacctagtacctaatagttattgtttctgatcctctcctcagccttcaccttcaggtaggctccaatgtctgttcctgtctttgtatccatgtgttctcatcatttagctctcacaagtgagaacatgcggtatttggttttctgttcttgcattagtttgctaaggataatggcatccagctccatttcaagcttttatcatggctgaatgaggaggtactgcccatctctgacccgctcatgctgtgctgcagtcttcgaatgtggagtctgttcctgcttcagagtctttgcacttgctcatcctttgcttgagtcatccactcctgtttgtttcatggtaggttcttgtcatctgtggctcaagttcaagtcatctcatcagtgagtctttgagtacacagctaaattagccccccaaatctgtactgtcatcctcacttgttttattttcttcacagtacttcccactttgtgaaattatcttgtttatgtgtatacttgtttatcatgtgtatcttaccactagaatataagttctgtgagagcagggatgcgtctgaagtatgagaacggtgccaggctcacggggccatcaacaaatatgtagttgtcagatggaagaatgaatagatcttataaagctgctttcctgctccagaagatctcccaacattatctttaatgcggtcatgaatcctttgcctagttcaatgagcagcattctatctcttaaagtggtttaattttttattataataataatatataagtagaagaattatatttcttttattgaaacaaaatctgctttcccgtaactttctccagttgtctatcattctcattgaaaccatagagtaaatctaattgctctttaaaaaactctttaaattaaaaaaatttatttctttttgagatggaggtcacactatgttgcccaggctggcctccagctcctggggtcaaacaattctgccacctcagcctcctgagtagctgggactacaggcatgtgccactgtacctggctcccaattgctattttatgatattactaaaaatatccagggacagggatcatagtaatttaagtcctctctgaacatgcttagaaactttagctgtgatgtcttccagaaccttatcatactggtcacctgcctttgggctttcttttcttggtcattgactttcataaaatatgcctcctataggcatattttctgctgagtaatctatgtcgagtacagtgggctattacattatcttaaatgatccttcttttaaagcaaactaacattgtatcacctttgttggcaattttgtagttagtccatattgagcctgcagtgaagtaaacttcattttttcttaatccacacataaagtgttttcagtgtttcctcattatgtactttaataattattctgtctcattaaaatttatttttgctagtttctacactgccattttctcatttaactaatagttattctacttctacatttagcagttaatactagtttactggcagtaatatcaagtaattgctaggtaagtataattttacatcataattcaaatcattaataaattagtaacaaggcagaatctctggctgccctgaacagaccattaaagaccagaggaagtggctttaagaacaaatttgaaaggaaagtgaattttatctatttttttaatttataaaatcagagtttttgttatttgactgtcacctaaagaatgaggaagaatttgttataatttagggacaggaacgaacaggtttttaagactcgtttgtgtgtctaggtttttaagtctagtttgtatgcaaaaacctggagggaagagatggttatagacagtttgaaaactctcaggagttcattgtggccaagttagagaataaagtaccaaaaagatactctgggcagagagaaatgaagctggaaaagtaaataggtgccatagtgttcagatccttgcatgtgagttctggcaggtggcctcgaaaaagcacttaacctcccagacgtagttttcttattggctggtaaaaggatacactgggttgagtgcagtggttcacagctagtgagcactttgggaggccggggccagaggattgcttgagtgtaggatttcagaccagcttgggcaacatagtgagacgtctctactaaaaaataaaaaaatttagctggctgtgatgatgtatgcctgtagtctcagctatctgggaggctgaggcaggaggattccttcagctcaggaattagaggttgcagtgagctgtgattgttgtcactgcactccagcctgggcaatggagcaagaccctgtctgaaaaaaaaaaaggaagataaaatgaaacctgccttgccatggcagtagaggtgaagtgggtactgctcctagctcctcacatacaagggtctcaaaacatatttacaaataattttaaatattctttatctagtgaaaaatttgtcattggaccatagaataaaaagaataagttgactgaagattttttaacagccaaatactataatttattaattatttttctcaattggccaaaattttagaggcattgtgaaaatttgttgagttagtcagaggtttttttggttattttattactcaatatttaagtttgaaaagccagaagactggtgatagaggttatgaaaccttttatcctgcttgatgtaaatgggatgcttctaattaactgtgtagagatggctttgcaaatgcatgtatagataattatctttgtgagcagtctggaaaaatatttttggtatagttttaagaccatcattttgtgttttctcccagttttgtaaatttaaatagaatacatatgtgtatcagttctatagatttgtaacttacagctacatataattattgtaaaactaatgcttttataaaatactagaaaatagaaaggtggattcacaccacccaagctaactgctaacattttagaaaatttccttcctatctttctgtatttgcatatgatcatttcaaacacagggttttttttttttaattgtaaaagtaggacattttaatgattttttttttttgaagacgtgagtggtaaaagttgaccctcttctctaccctttctccatttcccagaggtagtctttatagctgcttttattctttgtattcagatagcttctggtgagcctgactcatggcaatctggagtcaggatctaacaatatattcagtagatattagttgcattgaatttctttatatctatctcatttaattgttgatatgagtaagaagttaaaaagcatgattctggttaaaatttaatcaagttatgattttatctactattggatcattcattatgtcctcagtttgatactaattggtatcactacagtggctgcgtttggttcctagtactttttgtacttgttagctttggctgacatggagtagatttgcagtgaactgatttacagtacttgctgattttgtccagacctttcactaaaatattctaactgtgacttttagtttgcagcacagatgtaaaattgctctgttgtatgtaccatcgtgttttataactttataacaggatgactttgtgggtacataaaattaacaaataaatttaaattctcttatcagggttcatgatacttttccttaaaaggcaatttaggtagtcttctgatttgattaatgaatgctagggttttagattaggagccaaaggtatcttttctacttcttttcctcattatacagaggcttcactgatgtatatagacatacagatggctaggttatctactaaagtagagatgtaatctttagtcagttctagaaatataccttgggtgtctgtgattcagccatgtacagtgctaggcaatgagattaaaaacattgaataagacacagttttttcccttgacttggcagttaatttttatcctttttggtttttagatagaattgaatactgaaaaagcatagactaggaagcttgcaggaagtggagaaaggagcaggaagtagttcgaagtgctttagtgaactataaatagaaccaagtaagaatggatataatgtagaggagcccattgatctcctcagccccggactcttttttttttttttttttttttttttgagacggagtctggctctgtagcccaggctggagtgcagtggcgcaatctctgctcactgcaagctccgcctcccgggttcatgccattctcctgccttagcctcccgagtagctgggaatacaggcgccagccaccacgcccagctaatttttttgtatttttagtagagacggggtttcaccgtattagccaggatggtctcgatctcctgacctcgtgatccgcccgcctcggcctcccagagtgctgggattacaggcgtgagccaccgcgcccggccctcagccccggactcttatagggcatgtgacttgttccaagaatgaacctaatctttgctgaacacattcttctaagaaagtttttataaatcactacgtttcttattaaacatacctagaaccttatttttgaccaatgatatcattagcaagtagattatcttctacaagcagagaaatgaagggataaggatagttgccctttaaacaggaaggtcttgtcttacaaaactcaaatgcatgtgagatgaatagcactgtttatatacgtgtcatggcttccactggttttgcaagacctcatttgatgatctaagtacatgtgatcattcttcagggagaaatgcctatggcaccttttttgtttgtttttaatttcaaaatttcagatgttagaccagcaaatactataatgtgttcttgaggtaagatatagtgatgcatttttaatatgatttttgtttcctctattccttttttctatcatctaaaacttattttgtaatgatgtacttaaaaagttatcagcttctttcgatataaagttattaattgtgaaaatgacattctcattttttctctatgtgatagattaaggtctgacattttattttcctgtgacatcttaagaattgtaaaaaaaacactaattttttgttacagttattttgccagatataagagaggcaatgaagttaagtaggtttcattgtgtagtagaggccaggaagccagtagtttacttcctatatccagcattttctgttgttcatacaatgcattagatacatttttggcttatattactctttgctcattgatacaattcatggctatcaatctatctttaaacctcagacatcatttttggtaaataggataaactatgttgattttctgataaaatatttatttactataacttaaatgcctctccttaaaaaccaagtgctggaaatgagtttaacatatcaaccaagccaacttatatgtatttgatgaagtccaggcttattaaattcaattccaaagaaatggagtttgaaaaaagaggttttatttcacatgttatgaatgttaaatgtttgttatgtgctataaataaattgctatctcttctcaccctattcatagaaaatctgctttactaccattctgcccccctagttttactgaagtataattgacaaaaattgaacatatttagagtgtgcattgtgatgttttgatatgtgctgctttactgcattcctactgaatgtcagttacatttgtattttatccctttataggtattagatacagagtacatatttgttgatcatttcccttttaacactatgtatagtatactagttttcttttaccaactaatgttccattgttttttttttctttctttcttttaccagtttcttaaacaattaggtctacatcctaactggcaattcgttgatgtatatggaatggatcctgaactccttagcatggtaccaagaccagtctgtgcagtcttacttctctttcctattacagaaaaggtaattgttaagtaaaatagaaagtttctggtaaatacaatttttgttttattctgtcttattttttgaggcagtatctcgctctgttgcctaggctggagtgcagaggtgtaatcatggcttactgcagtctcaacctcccaggctcaagcgatcctcccaccttagcctttcgagtagctgggaccacaggcatgttccaccacacctagctgatgcttgtgttttatttttgtagagacagggcctcaccgtgttgcctggtctggtctccaactcgggctcaagtgatcctcccgcatcggtctcccaaagtgctgggcttataggcatgagccactgttcccagcccaatttctttttcttctttttttaatttacaaagtttttgataaatacaatctttaagaacaaatgatccccttcttgcataaaattaggcaatctagtcagtaaagaaatcttaaaactttttattaaagagatgatatttctattttgatgacagtaaagtcctaggttagtgctttaagctttggtaaattttcttctttaataaaaatttggttagtttgcctcagctgtgttttgatgtcacattttgatttatctgttttagaaattttaagtactagaataaacttaaatacagttttttcaatatatatatatataaggaatcttctttgcttattttaagttggtaggggaaactgataatgtaggttacattattttcaaaataaacttgaatgggaatcactaagcttaaatatattttaattggcagctttagggtgtgttggggattataaatagctgttctttgagctctgtatttaaattcaagtctacatattttagtctttttttctagaatgacatatctgtatgtttctgtgtgtgtgtatatatgtatacgtatacatacgtatacatatatacatacgtatatacgtatacatatatacacacacatgcacatatatatgtatagtggagccagaacttttaagtgcattttataatagattttgaggctatatccttctgatttttatttttaaaattagaaacagtaggatgattgcagtagttatgaaaaatgaagaagtaaatgggaagatgtgagagaaatatgttgatgatttgtcatatttgtgctcaggtcatcctattcttcaggactaaatggagccaaatcccacaggatttaagactttgcttagtcctggaaattcctggatcattttctttatgctataacaaattagcctcaattcaagataaattaaataacattgaaaattttttctcttctacttaagggttctacaaaacaaattattcaataaaagaaatgatatttctttgcatttactattcataatagagaaatttggagttaggaatttcttactgattgtctagtattagaccaaacccctacacaatggtaaggttatgattactgacatttgtagaagagttgagacaaaaacttaagtttactctcttttaatacaatgttacttttaccttttttgattacaaaaataagccaacagataactattccaggaccccaattgtaatgaacagtaaataattgaaaaaaaaatcagttgcctaaagcttagggtttcttagctgaggtgatacaaataggagtttttttgtctgaattggaaatttccaaaccattgattttttatgactttttttgtaaaaaataaattagatttgatctctttcatttagtgagtcatcagcattaaaaaggcatattatccttatcaataggatttaatttagtagattatcagagctaaaaacttgtccctgttgaaaggaagaacacagttctaaagtatttgcgtaagtaaatttgtacttacataagtagaaaatgatgtaagtaaatatataagtaagcataaatactttacttatataactataataacatgtaagtagagaatataaatagcatgtactacttttagatgtcttacagttttgtagatccctatttcagcttataggtgatatattgcaaagttattaagaggatatctagtgcattctttaggagctgcaaagtgtttgtctttgaagttccaatttagaaattgaatatgtagttgtgaatgacttaagcatactaatagcaaaggaactgtcatgggtacctcattatcctgtatgtatgtatgtatgtatgtatgtatgtatatatatgtttatgtttacttattttttgagacagcatctcactctgtcgcccaatctggagtgcagtggtgcgatctcagttcattgcaacccatgcctcccaggtacaagtgattcttctgcctcagtctctggagtagctgggatttcaggcgtgtgccactatacctggctaattttttgtatttttagtagagacagggtttcaccatgttggtcaggctggtcttgaactcctgattttgaatgatctgcccactttggtctcccagagtgctgggattataggtgtgactcattaccctttaaagtcaatcatggtgggtttttaaaaataaattttattgtgtatatttgaagtttacaacatgatattgggttcatatacatagtaaaatagttacaatagtgaagcagattaatatatctatcatcacatagttactttttttgttacaagagcagctaaaatcttatttaacaaaaatttctaatgcaatatgattttattaactttagtcttctacttgtttttcctatacatctgctattttgtgtcctttgacctacatcacatcacatccctgctaacctctgtttcgttctctgtgtatttgagcttttccatgtatcagtgatattatacaatatttttctttctgtgtctggcttatttcacttagtataatgtccttcaggttcatccatgtagcaaatgttaggatctcccttttttaaagctgaataatatttctgtgtgtgtgtgtgtgtgtgtgtgtgtgtctatatctatgccaccttttctcccaaccaagtactaacaaggtccaaccctgcttaacttctgagatcagataggattgggtacattcagggtactatggtcatagactataccatgtttttatccatttagccatctatggacatttggtttgtttccatatcttggctatcctgagtaatgctgcagtgaacatggaagtgcagatatctttttttttttttgagacggagtctcgctctgttgcccaggctggagtgcagtggtgcgatctcggctcactgcaagctctgcctcctgggttcacgccattctcccacctcagcctcccgagtagctgggactacaggtgcctgccaccacgcccggcttattttttgtatttttagtagagacggggtttcaccatgttagctgggatggtctcgatctcctgacctcgtgatccacccgccttggcctcccaaagtgctgggattacaggtgtgagccactacgcctggcctaaagtgcagatatctttacaaggtagagattcatctcctttacaaggtgattgtctcctttggatatgaattgctgggtcatatggtagtctattgttaatttctttagaaatctccatactgtttttcataatggctgtaccaatctgcattcccaccaacagtgcacttgggttcccttttctccacaccctcaccattatttattatctctttttgataattaccatcaatgatagtgttttgttgttatcatttgttttgagacagagtcttgctctgttgcccaggctgtagtgcagtggtgccatctcagctcactgcaacctttgcctcctgggttcaagcgattctcatggctcagtctctggagtagctgggattacaggcatgtgccaccacacctggctaatttttgtatcttcagtagagacggggtttcaccatgttagcctggctggtcttgaactcctgacctcagatgatccacccccttcagcctcccaaagtgctgggattacaggtgtgagctactgcgcccggccagtgatagtgttttgaatgtgttctttgtgatagtgcggtccagccagtaaatcataggcaaagaggctataaattttatttctctctgatatttatgtctcttggccttattttttttaattttttgatctaccataatttctttttttcctttagttgctttgtatcattttaggaatttttcctacacattacatcttgaaattatcaaatcttattttgctttgtcatcaggaacattaacaacagactaagctgtagaactgtaaacttttcagcataagaccttaacatactgaacctttccagttttttatcaatcgaacttacatgaataatgtccatttattctgatagtgttacttaaaatgtaatttagaagcacaataataaaattcatattttgagcacagatacatttgttgttagaagcagtctattatttttttcttccataggcaagagataaaagaagcagtttcttaactacttgtaggttttctatagacatcgtttgtttcttttattgcaggggatcaggaaaatgtttctgtaaaggactagatagtaaatattttcagctttgcaggcctttaagtgtctgttgcaactatttgactttgccttgtaaacagccatagacaatacataatgaaattttacttatgaaaagaggcagtgggccagatttggcctgtaggctgtcatttgctgaccccgctctattggaagcagaaagttatggaaaaactataaacaaaacaataaaatcatctttctcctccccacctcaccgattttttaacctttttgctattttttactctttcttactattaggaaactgagatacagagacattaaataatttgctaaagtcacacagctaataacagctgagccaggacgtgggcccaggcagtcagctatagagcccacatttttgatgcttattattataccctattgcttttacaaccagttattatagataatggttagtgtcagttacagattatataatgtgaattttataaatatgctatgattttccaaaaggaaaaatatttttgccaatgataaacaatatagaaacgtaacaattagcaagtaaaagttctccagtaatctcttggcccaaagataacctctattaagtttttgcataccctttcagactttccaatgtgtatatacatattttaaaaacataaatgggaattgttattaatataaactgacctataaccacacttagttgtggacaaagttctaaatcagaatatgtaaatctattatgctttatagtattctattacgatatgccataatatattttaaccaaatctccattgatgtcttagaccaatctcctacaaaggaaattgcttattggagtgtatgagaatttaaaatgttaatacatattgccatatgccctgtaacgtgatcgtacaaatacatacttttaataacagcataggagaatgcctttttccccgtaccttcaccttcactggctactgctattcatttttcaatcttttgtcagtctggtaggtgataaattaattcttttattttaaaccctttctttcataataatattttttatcatttgcattttttcttttacagactgagttttttaatatgttattttccacaaatacactgttgacttttttttttaatagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttggtaaatgatttttcattactgcattttttcccccttaagatacaagttaattgcattgagcagtaggtggtgctctaattctttcttcaaactataaaataaagcattccctgcttccttgatgatgggaatgtatatactgttagaagaaatattaatccttctcattcttttatattgttgactaataggggttaaacaaatggacaaatattaataatgtaaggcttatcatttataacatgatccttacatttctaacctaccaatgaaagaatttaacctgaaaaatagtagcatacttctagtattttcatatattggtctctctgctgtatcaagcctttttaattttatcttctttcatattctcagaatctggatcaaccttgaaaaaattcctggaggaatctgtgtcaatgagccctgaagaacgagccagatacctggagaactatgatgtcggtaccttctttccgttttgatctcatgtgggcaaaagtttgtgggattgtagatgtgtttgggggttttgtcttgaaaccatagttttgagcaattatggattttattgtatccattaagaaaagccttttgtacttttcagataactttgaaatatccacaaatgctgataagttgccatttcttttctatgttcagagctgactgaatggataaaatcagtttgatttacaaattttttttttttttgatatgcagtctcgctctgccgcccaggctggagtgcagtgatgccatctctgctcactgcaacctctgcctcctgggttcaagcaattcttgtgcctcagcctcccaagtagctaggatttcaggtgcgtggcaccacacctggctaatttttgtatttttagtagagacagggttttgccatgttggtcaggctggtctcgaactcctggcctcaagcagtccctccacctcggcctcccaaagtgctgggattacagacatgagccaccgtgcctggccctgatttacaaattaataaaatatcttatgattgactattccttactattccctccctaaaataaataaatatatacctgccagtaccctgtgtatcttttattgggaatttggaaccaggctgaagatgaaaggagaaagcaaaggtttaaaggtagacattagaccatactgtagctatttcatcagtgtaataaaggccacataaactaggctatatatataatataggttatatttaattcagatgatagtgattttaccacttcatataactgttctgaaatggtttttaaaatttattgcttttggaatcaatttttcttttgaaatcttttgaccttttaataacattattaaatagattgtaagttctttgaaattaggcgtataatctacaaattatttggttagaacaatgccttatgtagaatttgtgcctgataaattaattggtttgattatgttgttatgcattccaatatactttgagaattttaaattgtttttttctttaaaaaaaaactggagacttcataaaacatctttattatacataaaaataaacatgaaaatcagtactcttactaatgagaggtagataaacattaatattttttagggagtgtatatatatatacacaattttttaaacaagaatttgatcatactgtaatactgttttataacttgcttttttcacttatcagaaacgtattacataccagtaagtatatatttgatattatttaatggctgcatagctttccattatgtagtattgtatttcaccaataaattattgttagaaatttaatagtttttcttctttttcactattttaataaatactgcaaggtacatcattgtagctaaatctttgtaaatatccttaattatatataattatgtacaattatatgtaaatatataaactcctagaagagaagttgctggataaaatagtttgcatgtttttaaggcttggatatttatttattgccaaattgctatttataaagattgtactttcacctgtaatttactattgtgcccatttctctggatgtttgcaaatagtgggtactataagagtggtttttttttagttcaggaaactaaattctgtagcttctgataaatgcatgagttgtgctccacatttctcaattgctgactgaaactgcatgattaaacataaatacagccagagctgcagaggagcatggaacctggagaaacagatgagataagcttctttagtctctatctgtgaaatgcttactttattctagtctcaattgaataaagtgttaagtgttagttctaacaactgaataagttaaatggcccctacttagagcctggaaattacaaataatcagatattcaatttcctaagttttcagagatttacgggttacacagtacagcaattcatttgattacccagatatcattcttaaatatctagtactaagcttttcttaaatttccttcaatttgttgtttctttagaagactttaggtgttaaaatttagctttgttgtcttcatttaaaaagttgagtataggcattttttccaatgaatacctttattcttattacaggccatccgagttactcatgagaccagtgcccatgaaggtcagactgaggtatttcacattttttctaaatttttcttgctataaatttaaccatataaatttcttgctgtaaatttaaccatagtattattgtaggacataaagttttagaaagttacttggctttttgttttttcctttgagagaatttgcttaagcaaaagcagtcataaagtagcaaaaggacatgttttgacaagctgttaagatgctgctgtctgctgtttcagttcatctaatcatttagagataatgcagattgtgtgctgtttgtgcggcttggtggcctgtgtcttccctatcagattcctgtgaggtccaactattttgagaaaaatacctgcactgttgtacagttaaatagcctgtgtctttattgtgtcctgcttccagcagaaaaccacatcattttctttgctcaataaatttgtttcagggtaatgtaatgatctttaccatctttaccctgttagctagttcagctgggttgcttttcctttccttctcttgcctcttttttcattttttggtttcttcatttttccttccatcttttctttctttctttccttccccccagccctgactgtatcactctaagaggaagtttgtcagaaggtattttagtcaaaaagaatttaactaaagctgtttggtatgtttatatcacatttaagggttaataccagagaattagaggttttcttctttcttatcccatatgtgacttgaaaccacacttttttttgttttttttgagacagagtcttgctcagttgcccaggctggagtgcagtggctgatcttggcttactgcaagctccgcctcccgggtcactccattctcctgcctcagcctcccgagtcgctggaactacaggcgcccgccaccatgcctggctaatttttttgtatttttagtagagacggggtttccccgtgttagccaggatggtctcgatctcctgaccttgtgatccgcctgtctcagcctcccatagtgctgggattacaggcgtgagccacctcgcccagccgaaaccacactttttcatgtaaaagatgacattgcctttatacttaaaaaaacttgaaaagaatacttgatttaaaaatcattgattttggctgagcatgctgactcacacctgtgcagtcccagtgctttggaaagttaaagcagaaggatcgcttgaggccaggagtttgagaccatcctgggcaacatagcaagactctgtctctacaaagagtaataaaaattagctaggtgtggtggtgcatgcacctgtagcactagctactagggaggctgaggcgggaggattacttgagctcaggacttcgaggttatagtgacctatgattgcaccattacactccagcatgggggacagagcaggaccctgtctctataaaatatatatatatattggttgctctaggcgctgctttcaaaggtgtggattattgtttttgactaagtttatccatacacagacacataagaggcccgtctaaaagtttttaacaccagattggaaattaatgaaatgctgttttgtattgctttatatgatcctgaacatattcataatcttcactatgctttgattttttgtttgcaaatttatagtgttaaaattggtgatgatgaggatcagcgtaagtttattgttaagatatgaagacagttacttgtaataaagcaattaaatgctttaatacatattcactacaaaaaatatttatttttgccatacttctcttgccccatttttggagtttcatccaaattatggatttacatttaaacttctttttaaatgatcttcatgtctcttttttcagacctaaccgccttcattctttccagtcttggatgcctgttagacatcatctgaatgacctcactgtattttagaatgcatttttatttgtttgagcttattatctatgtcttaaactttttcttccctttattgtttctgtttcttacaatagttccaccatactttttcccactgtaactatctaggacaaattcattaacttctggtttagaagatctgctttttatgcagattctcagtttttattccagttctcattcattttcacacacttctgctggattccctttcctgaaatgtacctgaatcagttggctgctaaaatttttctaggggtttcctagtgcgtagagcagtgattctcaagatggagtgcagatagaagttaggattttctggagggcttttttacactgctgtgtactcccataagaattaatcttttctgctcctttcccatctcccacagtttagaaacactactggagtgagcaatattttttatgtatattataaccctaaaatgtgttggagtgaaaaaaaaaatgtttgagaatgattcctcaagcctgtgcagtcagtttcaggctctttaacccagctgtattcaaagttttcctaaccctgtcttgtcttgtcttgtcttgtcttgtcttgtcttgtcttgtcttgtctttacttttccttccttccttccttcctttctttccttccttttctttaacttgtctttctaactttaattatttctttttagccatcccttatttccttattttattatttctattcttcttgcagtactctctttctgaaaatattctttccctcaatctcttgcacttcttctatccattcttcaagactcagcttagtacgatcttcagaatgaagcagttcctgattatcagaactggttatattttatcatttatatgaactctttatatgactactccaactatttgcattttagctatttcatattctctttcattttttaagatgtactttttttcacattttaaaaactctaaaattaggatgtatcttacagttgatgtcatagtttacttggcgttattcccatcttagtggttcacaaaatggtgtgtcatggaaccaatggcgccttagtgtgatgaagtatggtatcttatctccctttctgtggctcttaggcctagcattggcatctgattcatttgtgcatgttccaaattatccaatactgttccttacacataagtacaacatatgtgtattaattaaccagaattagctcagaactgtccttggtagtgtaagaaataaaaaaaagtagggggttaggggtggcaaatcttagttttctgtagtcccccgagtaaacaaaacatatccattagccattgtttccaaataggacagcattaacattttggaaagggttcaattcttttttgtgcgggactgttttgtgcactccagggtggaatatactgacctctagttgccatatgttagtgtctcccagttgctgagagaacaaaaatctgtatgtttcaaaatccagttgccatctggctttaaatccctgcttcagggacttttaatatttttctgatcatctcatttaagattcatctccctgccgggcatgggggctcacgcctgtaatcccagcactttgggaggccaaggcaggcggatcacctgagttcaggagctcaagactagcctggccaacatggtgaaccccgtctctactaaaaatacaaaaatcagctgggcgtggtggcatgtgcctgtaatcccagctatttgggaggctgaggcgggagaatcgcttgaactcgggaggcggaggttgcagtgagccgatatcccaccactgcacttcaggctgggcaacaagagcgagactctgtctcagaaaaaaaaaaaaaaaaagattcatctctcatctatgggcttaagagtgttcggtgtattattatctccattgctgtttgtattccagcctactgatttttttgtcagttcctacaaaatacataggtctttgctgtctgtattagtttgcttgggcattcatcacaaattgttaccaggtgcctttaacaacagaaatttattattacacagttcttggggctggaaatccaacagcaaagtgtcagcagggttggcttctactgagatgtcccttcctggcttgtagactaccaccttctcactgtagccttacctggcctgtcctgtgtattcatatggagggggtgtggagagagacggggagagagagatcaattgatctgatgtctcttcctgttcttataaggataccagtcctgttggattagtgccccattcttataaccttagttaacattaactacttccttcaatgccaagttttcaaatatagtcacgttgaaggttagggcttcaacgtatgaatttggcaggggggacacaattcagtccataacaccgtctttgtgctttctaacaacccagtacacttccgggtataccgctgctctttgcagagttggagacttctcatctttcaggtctcaccttaaaagtcacttttcaggctgggcgcggtggctcacgcctgtaatcccagtactttgggaggccgaggcgggcagatcacaaggtcaggagatcgaggccatcctggctaacacagtgaaaccccgtatctactaaaaatacaaaaaaactagccgggtgtggtggcgggtgcctgtagtcccagctactcgggaggctgaggcaggagaatggcgtgaacctgggaggcggagcttgcagtgagccgagattgtgccactgtactccagcctgggcaacagaaggagactccatctcaaaaaaaaaaaatgtcacttttcagagaagccttctttcatcactgttaagtaggtccttctgtatttttttttatgataaaatcctgtttattttcttcctggcactttaaaatagtcaataataagttttttcttccttgtgtatatttgtttattctgctaactagaatgtaggtcccatgaggaaataggccttgtttgtcttgttcgctttgaatccccaagacaaactggacatatataggcatgtataagaattacatagtttgaaggtaagagcacaggatataggtttgtatactgactccactgcttattagcttaggcaggatactttcttcagcacaaaatagaaataatggcatttaccttatgggattgttgtgaagactaatgagttaattatataaactgcttagaatagtacctggcatttaatgggcattcaataaatattaggcggtaattttattttactaggcatccagtaaaatgaatctgaatggcagaagatgaggctgaagtaatagggtgaagccatatctggggggcttggattttatagatggagaaccaccaaagatggtacatttacttttcagcctactgagtttaaggtgagtttttttgggtcatatgtgtaggagtctagagctcaggcgagatatctggagtctttggtatttgggtagtagttagaaccctgagaattctacagagggagaatagtggtagaccaacaataaatccttggggcatgtaggtgttgaaagagtgggtagaggaagaggagccaataataatatagtgtaataacaagtagcatcatcactggcatcactggtactctctatcagaacgttttcatgggaatggaggaggcaggagccttattgcatgctgagatttgtagactaaatgaaaaatctgtaagttgagtcaccaaaatacagtagtctttttcagaagattggccatagcatactgctctagagtaattgtttacctacttttctccatcccaccgtgattgtctggtagatcagctaatacagaaatctgaacagtagccccatctcacttatgcttcattaacttacactgaaaggtattgctttcatctttcgcttaagattaaaaacataaaagaagaatgggatatgaggaaacaatgaggaaattaaattattagtggcagagagtgttttctttttttccattgattttccacttgctacaaccaccattttgtactttattctagatagaataaaatagtgttattagagttgctacagaagtttgatatgtgtcatttaattccagtaccagccctatgaggtattaccattgtcctcatcccccttctatagatgaggcaattgaggcacagaaggttttagttacttgccccaaggtcacatatctgctaagtgtagagctggaatttgagctgaaaccgtctggctgcagaatctagtcctagttcctctgtcctcctcctgtcacccccaccttcaaacaaacactttctttcttttttgttttttgagacgtagtcttgctctgtcacccaggctggagtgcagtggcatgatctcggctcactgcaacctctgcctccctggttcaagcgattcccctgcctcagcctcccaagtagctgggactacaggtgtgtgccaccacacccagctaatttttatatttttagtagagacggggttttgccatgttggctaggctgattttgagttcctggcttcaggtgatctgactacctcggcctcccaaagtgctggcattacaggtgtgagccaccgccccagccaaacactttcaataaaagtttgacagctaattttgtagcagttctgttaagaccagtgttttatattaggcttaatgtgactatttatatcctagcttgggataggaaacagattgtgtgagaaatagtaaattgatagcttttcagttactcctgaattttatttcttttttctttttcattattattatttttctgatgtgaagtctcgctctgtctcccaggctggagtgtagtggcgcaatctctgctcactgcaacgtctgcctcccaggttcaagcaattctcctgcctcagcctctcaagtagctgggactacaggcacgtgccaccacacccggctaattttttgtatttttagtagagacagggtttcacagtgttagccaggatggtctcaatctcctgacctcgtgcctcagcctcccaagtagctgggactacaggcgcgtgccaccacacccagctaattttttgtatttttagtagagacagggtttcacagtgttagcaaggatggtctcgatctcctgacctcgtgatccacccgcctcagcctcccaaagtgttgagattacagtcatgagccaccgctcctggccctgaattttatttctttaaagtgggttcatgattgagttttgaagcactgtgttacaaaaattaataatagacatataaagctaagctttcaattgactaatgtgttggttgtgtgtgttattgtaatgtgtagccctaaacgaaatacggttgaatgttctactagaaaaatagttactgattttaaaattaatataacctgatatatacgtgcccagttaagaaatttaaaaatgaatgtatacagttggcccgctgtaatggtgggttccttacttgtggattcaaccaaccacttaatgaaaatatttgaggctgggcatggtagctcatgccagtaatgccagcactttgggaggccaagaagggaggatcgcttgaggccaggagtttgagaccagcctgggcaacatagtgagaccctgtatgtacaaaaaaattagccagatgtggtggcatgcacctgtagttccagctactctgtagttgggaggctgagataggaggatggcttcagctcaggaggtcaagactgcagtgagctgtgatcatgctgctgcactccagcctgggtgacagagaccttgtctcagacaaaaaagagaaaaaatatttggaaaaaaaagatggttgtgtctgtactgaatatatacagacttttttcttgtcattattctctaaacaatatagtataacaacaatttttataacatttacattgtattaggtattacaagtaatctagaaatgatttaaagtatacaggaggaggtacataggttatatgcaaatacaacactattttatataaggcttgtgagcatctgtggattttggtgtcttcaggggggtcctgaaaccaatagtccgtggatatcgagggatgactgtgtattcactccaactgagacctttctgaataactgtagaatagtaagattggcaggaagttccaatttcatatggtttgggcttccactaaagtgtctagtagattagaagatctccttattttaaggcttttctattcacaaaagattctaataagtgtttttaaaattgtgaagaaatatcagtgatgtaatagtggaaacagtctgcaagtcaaatgtgaaggcaagaaagaaaaatccaaaagggtattttatttgccttcagaccctacttttacttcattgccacttaactaaaaagtaattcctaaaatttgtgatttgtccatattaattgaggagccagcccagatatgggtagagatcaccttatgatttattgtttaactttttaagtttgttgtactgcccagaacccccccatgtaaattaatagtaataatgaaaaataacagcagtattgttttctgtttttaaataaacataccagtatggaaaaaatagcaaaagacactttttgcatctatgtatatttgctaccattctttttttagtacattttaagaacagttgagatcaagcgattttatttgacttttttcttaacatattaccatgaacattttttttgtttcatcaaaatttcctcattaaaaaaacctttgctactgtatactatcatgtgagtaaaccacaatttatttttcatttccttaacttttgatgtttagattatttttagtttctcaagttaaaaatataacttaattgaatatccctgttatctaagtattcttttgggtagcttcttgtaggtgggattactgattcaaagggataaatatttttatgattcttgttaaataatgtgaagttgtctttctttcatttgttcaatcagataacctgtttgagcacctactgtactaggcactgtgcttataattgtacatacaaagataagtgagacataatttgtgtcttcaaagatcttttacttcagtggtgactgcagctttgaaaatcgcttgccagtattgaattccatttctaaatttttgcttgtttaatagggggaaataacatgtttgattgctaatgatacttaaaagatctttagtaaaagtttttgaagttaatttaaatcataaaatatgtaattaatttacaatgaaatattaatatgtaatctattttggttagtgttgacctataaaagagggattatttgaccactggggtaaacagtgcataatttctgatttcaagtatgtcatcataaatatatatacataattaaagatacatgtgtgtgtttgtgtgggtgtgtatatttttaatttaagaaaatcctctgtttagaatctacttggcttttttggcccagccagtacagactgtcagtggcagtaaatagtttaaagtttcatcttcattagatgtatatgtatagttgcatggcttcattttactctgaagtatagtttttagttatttttattattttgggattacaaagagataacagaaatcattccaataagccaaaaatgatttacgcacaaattgaggtgctcacatatttatttccctccttttggaatttatttcctcttccttcattttgaaagaatctgaggatattaggaagaagcttagttcttaaataatataaaatttaagttgccgattatcttgtaagaatcaggcggaaacaatacatgtatcatgcggttcaagatgtagagtccagttttgtcaaaagtctgaaactgcaactttctgatctttgtttttctttacttttcatacctcattttctttatttcaacatgacttaatcttttggaggcgattttattttattttatttttaaaaccaaaaatgctctgggactccctagcttgtctctgtctctcttctatctttttttgtttcttctgaacattgcttgaatagaggccttccctttccccttttctctccctccgtctgtcttcccttctttttttcctctccatttctctcctttcctccccccttctttcttcttttctgatctcagaattttagaaatggagatattaaattattacttattttaaaggaaaattctcagaccgaacttaccagttcacacttccagatctgactagatgaaactcgtctaagaatgctttcagcaataaaaatagaactgatgttgtgtttggtgatggtgaaagttttctgttagttttgttttatatcacaactttccagagtagagggtaatgttaggatataagatttttttgatttgtaataaaggagaactttatttggggctactctcaaactgtaaagaaaataatttctgggaattagtttgagaagtttaacaatggtaagcttaggtttaatgtaacatttagatgtacaggtattatattaatagatatttctaacatggagaattataaactgaagggagagaaaacataattgttaaaccagtcagggaaaaaagtctttttagaatatcttgatgtctgtgggcatcttgatttattaggtgagcaaaatgaagaaacttaccattatccagattttccatggaatatgtagtggtattttgtgtattttgatatctatcccatatttaacttgtgacttctttgccaaccgaacatggatactctgtaggaaactttgcatcttttgtatggatctggctttaatttcctttttaaaatttgaaccttaaatttactgtaatccaatgtattacactgaaatttactaaaaaatctacagaaatccatttagaattaatttataattttgattttaaactcataaagttatacatgtatgtgttctcatgcatgcgcacacacatgtccttacacatatgtgtacacacatttataatctaattttcaaagcatttggtagctctagagatgttcccaattattttcttttccatgtgccatattttagactcagcggtcttgtcctctccctctccctctcctcaaaattgttcgaggtgctcaccagctttcaagtattctcaccttcttaattcttactccttttgaaagtatgtctaccatattattataatgatggttaccattttctgaattcatgttatggggcaggctaactaagtgctgtatctaccctagtttgatcctctcaactccgtaagatagctgttaccccattttgcagatgggaaatctaagaagctgctaatatattcaaggtcacacagctagtaggtactcctgtgctcttaaggcaacaaaacgtgtaggtaatacaaattgctgaaactaaataaaatgaggtttttaaaatttgaatttctgtttttgccttaaaagcaaggctattcacagctagtaatttaaggcaaatatgtaataagttacaaatagtcattcagagttgtgccgaatactttgttcttttttgccgttaacatctaagtcagttcttattcagtacactagatttttttttcctattaaccggaaatcttacccataaaccagccacagtcttttggtaatcatgttaggtatattttagaaaacagtaattattttaactatctacccactaatgatcccttcatgttcaagaaattacatggttataaggatatttttcataataatagtatgtccatttaaatgagaaaatgctttggctgtaaaccaaaacccacttactttattttagaattttaacataatttagatttaagcacttggagtacccaccaaactaaacacttgatttctttttttttttttttccttgagacagggtcccattctgttgctcaggcggcagtgcagtgggtcgatcttggctccctgcagccttgatctcctgggctcaaaccatccttccacctcagcctcccaagtagctgagaccacaggcatgtaccatcacacctggctaatttttttttttttttttttttagtagggtggggtctccctatgttacccaggctggtcttgaactcctgggctcaagtgatctttctgccctggcctcccaaagtattgggattacaggtgtgagccactaacaaaacacttgacttcttcttaggcagaccctctgctttgtttgattttttttttttttttaagtctggatcatttctttttagcctttacagcatttcaaatacgttggttattttatttaaaagtttaaagagtaatttattcattttttgctgtataaaaaagtgcatgcacactaactgtgaaggaaaagtaatttggcctttgaggacgtaggtggtgattgttgttgttttttgaactggttttaagtttgacaaccagaagatagatttggattatattcaggaattcagatagaaatagtaatagatgtgcccttatgaatcagtcaaattagttgacagttaatgggcgagtgaccttgcaatggaaaacactgaaattggagctgggagtcatgagtctgcctctggctttcacactcactagttatgtggctttgggcaagtcaagtaggtccttgtgcttctgaaaaaaccaaaactgtcatgcttatggtctgtattctcatagctcactttctctgtgtgtgtaagtgaatgtgtgtgtgtgtttaaactcagaggatttaaatcagaattaatgcttaaaaatctcatgcaacaattacttattaaatatcttggcattcttcctgaagagtaaaacatttaatctgcattttaaaattcctcaggtttctgaaaagcctagtctaggtttttttgaactataatgaagagatgagtttatatttcatgtaaagtggtgtatctacagtcacattatactgttgcagtgcccacatagtcagcagtgagggcacaggttcactgttaatgtcctggcaaacattggtgtcgttaatagttttgatgaaataaataattgttagtgattttggactcttcaccagaatgaaaaaactgaggaagtgagttctttattcagactatctaaaaagtgaactctctttaagacttttatgaaagattcaaaaataaactgtagacatttaatcttttccaattagtatggaagacaatgtgaaaaattagccatctagctcaagattcagctcacagtttaaattttcatatttgaaagcagagctaaaaattaggttgctttaacaattgcattaacagttaatattataaggatttaaaagttggtgtatgtatctttaatctttgtaattctaagaggaaagcctgtgaattttacgtttccataatagcacactttatttcaaagtccttccatctcttgaaatgttattgcttgaaagtctttttctgaattagatcaactctttgaaattgaaaatatatatgatgtacactgttatgtctatattatgcattatctctggaaattatacagttggagatatttgtatagtgcgttcatttagcatgaggaggtaaaaataagtctgactagagtaaaaatttagaattattgattctaatgttttaacattttgacatacttgttagaaacaatctttagtatgctatcataggagcagtaaggtagtagacaaaagctttgcctgcccccaggccttacaaagtagtttaaaaataaacaattacaatatattgatatgctatcctattttgaatgttgtaaaacattagtcacatacaaacacacacacccacaagctttgacatatgggactcatttaacagagtgtacttttagactcattatccttttcttattccttcctctgttatataagtttttattagaaaacatgatgctcaaaaagaaggctaaaattactagtgtgataacatttggggaaaattattctttgtctttaaaatagaaataattataatatgtaccttataggattattgtgaagatctgtagcatctatagtttagaacatctggtaaaagatagtaagcacttgatattagctattatggttgttgttttataacatcattttggataccaatattattactgttgactgatgcatatatagatacttgtgtgcacattttcactaaagcgtaattgtagaaaaccagaaacaaactaaaggtgcagtattacatttatggtatgtctatttaaggaataatatgttgccatgaaaaatgatgtagagatatacttactgagatgaatagaagcccaaaatttatgggtaatgaaacaaaatagctaaaaattttaacaaattgcttaaggtcaaaagtaggctaccataagactataaaattcctgtaaacagccctgaagggagagctcatatccactctctgcagacctcaatgggtgctcatgagattaagtggggacaagatgggagagaatctttaagtgcaggcctaggggaggagagcagttgctgctgtgggaaaggcgtgaagcctggattcttctctcctgtagaacaaagcctaaagaccttgagacagaaaacctttcctggggaagggaagagataaaaccaccccttttgcgggaggggcaggttcttctaccactggaggaaaagacccctgagaaagtcttgtccttgatatccagggacagaggctgatctacaacaacaaagaatgcctccacaagcccaccattagactagcaagcaccaagaaacaggtctcaaatgtgtggggatgggtcaataatatggagagagaccttctctgaggcatagcctctgagcaaaagcctaaagctgagagtggaacaagagcattgaaaaagaaaacatcctacaacccaacttccactctaagcacaaggttatgccagataaattttaaaccaatggtattctcaaggtaatcatagcaacaataaaacccaaacagtaaactcttgactaggttggcttatccccatacactaagttgtagcagaagatgagacacgcccatttttaggcatacatattatttatcacagtctctatactcctagagaaggtgtctggcttttaaccaaaagcattcagcagagctagactcatatatgatctagatgtcaaactatcagacagggaatttaaaataattaaatgctcaagtggaaaagatggaaaacatgttctatcacatgggtaatatcagcagaattggaaactattaacataagaaagaatcaaatggaaatgccagtaatgaaaaatacggtactagagatgaagaatgccattaacagattcaccagtagactcaacaaagttgagaaaagaatcggtgaatgtgaagataaatcactggaaattacccaaacttactcacaaaggggaaaaaaatagtggaaaagagggggaaaaaccacacaaaacaaacggtgcatccaacagctgtgggacaatttcaagtgatgtaatatgtgaaaatggaatcccagaaggagaagagagatggaaagatatgatgggggtgggagtgggtgaggggtggggtcttgagacaaaaagtatttgaagggtaatggccaactattttccaaaaataattacagacatcaaaccacagcttcaggaatctcagagacactaggtaggatgaatacccttatcctccaaaaaacaaacacacatatatacctactgagatacattaaaattcaaagataaatggaaaatgttgctgaagaacaaagataaatggaaaatgttcaaggcagccacatgaaaaagacagagtagatactaagaattcataagaattacagcagactccttactagaggttatgcaagccagaacacatagaatgatatttttagaaagctgagttcagtggaacaaaatatcttttaaaaataaaaactttgagacagacaaaaactgagagagctcataccagcttacttacactacaagaaatgtaaaggaatttcattatgctgaaacagtacaatgccagacagaaacttggagctatacaaagatttaggaagcattgaaaatggaacaaatgaaggtaaatataaaataaattttattcttgttttacatttcagtaaaagatgattaggattactaaatcaaagatagcaactatgtactataaatttatagcacatataaaaataaaataagacaatagcacaaagggagggagggagaaattgggataatactgttgtgaggttcttatactacatatgtagtggtgtaatactgtttgaaggtactccgtaactaaagatatatcttgtaaatcctcaggcaattactgaaaagcttaaaaagtataaacaagaagcccacagtacagataaaatagaataataaaaataatgcaaaaagcagaaaagtaacagagcagatggaaaaaataaagaactgacaatgtagatttaaatccagccatataaaacatcacatgaagttaatgaaatgtcagtataaagactcaaatgtctataaaccctcaaattgaaagaaagatcagtttagtaaaaaagcaagacacaattatatgctgtttacaagaaagtcattttaaaaaacgtaagaagataacaatcaaaaggatgggaaaagatgaactatacaaacactaaccaaaagaaagctagagtagttatattgacatgaagttaagtagacttcagaacaagaaatattcccagtgatgaagaaggacattacataaggataaagaggttatctcaccaagaagacatagcatacacgtaacagaaagtatgtgtatgcagctaacaattagagcctctaaatgtatgaggcaaacactgttagaactgaaaagagaaatagacaaattcacaattatagttggagatgtcaacactcagaatcaataaaacaaatagatacagaacattactaaaaaattgaagatttgaacaacattgtcaaacaacttgacccttttgatatttgtggaacacttcagaaatttggaatacaacagctgaatatacagtcttctcaagtgcacatgggttagttaccaggatagaccatattctggattaaaaaatcaaccttaaatttttttaaaaaatttaatttatataaagaatgttttctattcatagtggagttaaactacaaatcaacaatagaaaaatatctggaaaatcccccaaatatttagatattcaatagtacacttctaaataattcatggatcaaagaggaatcacaggagaaattagaaaacattttgaattgattgaaaagaaatataccaaaattgacaggatacagctaatgcaggggttggagagaaatctatagcatgaaatgcttatagtagaaaaaaacaaacaaacagaggttagagggaaactatagtattacatgcttatagtagaaaagggaaatggcttcaagtcagagatctaagtttttaccttaaggtagcaaaaaaaaaaaaaaaaaaagagcaaattaaatccaaaatgcataaaacgtagaaataacaaaggtaaaagcagaagtcaatgaaattcattactgtagtagaggtcctagccaatatagtagggcaagtaagggaaataaagggaatattgtttaaaaaggaagaagtaaagcagtctctaatcacagagatcatgactttttaaatagaaaatgatttattaaaaaatggagaagggcttgatgtttaaaatataaaagataaagactgttagaaatgttccaggttaaaagatactaaggagacatgatgaataaatttaatatctgtgcttagattagatcctgggggaaatgctataaattacacaactagataactggcaaaattaaaatatgggagattaggagaaagtattatatcaatataaaattttgagggtgataactgcactgatattaatgtaagttaattcccttagtcctaggaaatactgaagaatttaggattaaagggccatgatatatgtaacttatcttcaaatgattcaggaaaaaaagttatgtagaaaaaggaaaagagtataagtgcagatgataaagcaaatggaagtaaaatgtcatagtcaaatctgggtgtttcctgtattatgcttgtttttgtaactctgtaaatttgaaattatttttttaaaaagaagttttcaaaaaggttcttcaaaaatgacaaaagaagagggccatcatacctgaagttggaaatcacatttctcacaggtgtgtttggagtaagcaaccttaagggatgaggtaatgtctttgcctctggaacaaagagcctgtttgcttactgcttgctgtaaaccagtggtttcccccagctcagtgttcctctcttgtaacacagcctattcttttgcaaccatccaccctagctctgtctgttgctctcatgtgaattgccacaaacgtattgatgatcatgctccttgctgtgctataagtaataatttttttttttctctgacccaggcatctcatgccttttgccaatacccatgaaaaagtaagaggctaactgattaaattgaaagaataaactcaaatttcagatctgacagattactcttctaaacatgtcttccttatttctatttctgttcttttctcacactgaattctttgccaagaatattttcccatttcacccatcccaactttatatattctttcagtatacaatgctggtttagtaatatttccctctctagattcttagaaatttttttctccactatttattagtcacctctccttctatctcttcctttacatcatttatttcccctttttattcattgcctctttcttcttcccctattctttccttctctctttcctgttatttgaacataaccagattgaatgtgacaaatttcttattaaactatatctgtgagagaagacattatcatatacacttttgttcccatatagaatcaagtataggattcatttatgtatttttgattgactgattcttattatgagccgctaaaatgttcaaacatattttttaaccccgcatcaaaatgatagctttttttaaaggttagtatattgtatatttagattgaaggtactaagtaggattagagaattttcacagttgacaagagttttaaaaatcattcggaaagtaaaactcatgttccttaagagaaatctattatggttgttacggttagcaaaatctattatcaccaagcaaggatttatattaccattctttttatttcttctcactatgattgtagtgattgtaattttgtcatactccctcaaattttttattttatatactggtgttattaatccaatgtgacaattatgaagtcatttggattactactattatgttatcatacccttgtatactttgtagaaaactcttggctagattttccttttgtggtacaatagtgtttgaaaaggtgttcccaaaatacctaaccttatcagaattatttctctccttaacagtatgtgtcccatgttagcattaacatatttttcttggtcactttgggtttacaccacagtgattaagatcattggactctagaacttgatttcctgggtctgaatcccggttctgttacctactggcaatgtgaccttggttatgttacttaacccatttgtgctctgattcctcatttgcataacaggaatagttgtgcctgtgggttactggaaggttaaatgaacctatatatgtcaagtccttaaaaagcacctggcataaaaaaagatgcgtattatatttaatgatattgtttcctaaaagatagctaagaggccatgatattttccatgtaacctgtcagcctaagtaggaggatagtttattcagatcgtcagctttggaggaattaatttcactcttgtttatattttaaagttggctttttttttcttcttggagcttattccttttaaggaattcttttttaccaatgcctatcaccacacagttttcttctacccgttattctttgtgcattttatatgcgttacatggtttttgtgtgtgtgttactttttaaaaacattttgatgtaataattttagtggcttttacgtattaatttccatgagtctgtgctatgcaaatgaggatatgtgaatattatcaatgtacacatatagaactatggcatataacctgatacttggttatatatttccactttacctgcttttaaccaatattcatacatgatcctttgctagatagattatggttattaaaaatagtagaccatatgaattacaagcatgaccatacgttgcttttaagaataaatgatcacccagtaacgtggtctaagtaaaatattctcttttttaattatgtagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgtaagtttagtcaatcttccgtctcttcttccagtgacaagggctgtcttttttttttttttttcttaacttcggtcttcagagtgcttttctcttggttcactcaaccattagctttttctcccccaataagattgcaagcatatctctatgctttgcattctagcttgacttttgccagtgcctcagaacatccatctttccactccatatcctgccaacataacggcacctgccttttgatgagcactgatccacattcatgataatgtttaagtctggttaattgttaaagtgaatatgtgttctgttacccttcagctttctgaattcatttagttgactcaggtcaacaaatgctgtgtaccttctgagttctttgccatctattactttattattattatttttttatgtttctgagcatgactttagtctcttgccatgctctggggttactttacttactctattctcaatctaaatccttcatggtgtagggtgtttcatctaagctattattttattccctgaggtggctcaggtacttggtttaatcttgatctgatctttcctgcccattcagtttctaaagatcttttccaagtaggaaatgaagattttctccttgtgtattgatgtaggcttcccacaaatttatgatttctcttttataggctaatgatatctgcaaactattaaaaatacatttttcttataatcttgctaattatcttaaatgttgagactgatgatgcaattctagtaattatcataattgagatacactacagaattaagcaactacagctcttgtctttctgatgttttggactattaaaggcaatgactgtggtttggcagagcctccctagaaatggaatatcttaaagctttggtgtgtgccatacatttataagaaatttgacatttctataaattatgatggcttttgaagccagaggaggaagtctgattacacgtacatttaatgcttaagaacaattaaaagtcaacggcaagcattctttccttccccttatttacccttctagtgttatactcaaactgtgaagtggtatctttccttaaatatttgcttccaccaaatatcagtatggtcatcaaatacttttccatttctgctgagtatcaacaaactcacatctctttctatttcattatcctcattgggtcacgacattcttcatttttattcgttcatccatttgatatttgttgcttctctactgtgccatatgccatttgacacagtgagagatacaaggtgaactaaatgaccagggtagaatcctaaaggtgtaaattctgacatgagcacaattgatccaattctaatgtgaattatttcttttctacttaaaaatgttccaaatataaatgaacatataaaatttggcatttcctgttttatatgcttttatataatgttgatcttggctccatattagttccattgccttatagctttaaatgtttttgtagcttagtagtaaagaacatggattctagaagcacactgctcgggtttgaatccagattctaccacttactagctatatgacctacagcgtgttacttaatgcttctgtgcctcagttttctcaagagtaagatgggtataattatattacgtaccttattgggtttatacaggttgagtatctcttatccaaaatgcttgggatgagaagtgttttggattttggttggattatttatattagacttacctggttgagtatctcaagccagaacatttaaaatccacaatgctgcagttagcatttcctttgaacatcctgttggtgctcaaaaagtttgaggttttggagcatttgagatttcagatttttggatttgggatgctcaaccagtatgatgattaattatttgatacatataaaacatttagaacagtgcctggtggtatgtattaagtgctatacaattatacattaaatttagtgtatattttaatgtgacatttatatttagtatttaatttatatctaattgatttgttatcactttttaattctttgagttaactaagaagtgttgcattctaaattagggatatatatatcaaaactaattgattggaagtcaatggtactatttatactaaaagagtaggatccttatcagtagatagagacatacaagaatagtcatactacatctatgaagtgtcaatatcaggcagcagcttcaaagccaaaatggtgtttggatgtaaagtggaattttaatttttccttcatatatatatatatatatatatatatatatatatatatatatatatatatatgaaggaaaaaagatcccatctatagccttttttttttttttgccctttgtgtagttatttcttggtcattttttgaaacaagcacttgctgaaatttgctttttatttatttttcttgtttttagtggaataacttttaagcaattaaataattacagatttttagactctgagactaattgaagctgactgaaggaaagggcttatcacaggttctgaggttttgtggaaggcttagaagttttgagctttgcttatcttttataatagtttgaaggcttttcataccctttttagaattttgtatttttagtatgcacttttagattaaaggtgcaatgatgcacaattttgagtcactacatttggtaattgcttacatttgcaataatgtagtattgttattggagtaatacataaggtttatataacacttaacagtttacaaagtactttcatgcagctcatttaaacctcgaggtggataagaaacccaaggcttacagggattgggtccatattcagttctctgactccaattgtactacttttacctctagcatggttgtatttactggcacaatataaaaaatagaagctataagatgtgtaattcttaagaagagatggtgttaaggtaactaataatttatgaaagcataaagtttaaaagatttagagtatttcatatcctgttggaaaattgtcttaaaatgagtaaaaggaagactctttcctaggtgaatgaataattcattatagccttttttattatagaattaaagttacagtttatataattgcctaggtttagccttaaaaaattggacactcttctgattattgataaatggagatattagactgaggtggccagtaatattttttgattctctgaccaggaaagtaagggaactcattatcactgtcttcaaatatttaaagaaatatgttcaggagggattagacttttttctaagatgatggaaaatacaaggagacatatttagcctcagtatgagggaaaattctaacaaaactgtctaacaatggaatggactgcctcaaaacctagcggaggagcctctggcattagaggggctaccacaggatggagaagtgcagtactggagcaacaataaaactagataactctgattgctaacacctgtggaattctgtagttctagagtgaagctagaagagctggcttgccacatcagtttatgttgaatttcttccgttcataatttgagggaaataacctctgaagaataatgtgagattaggtgaaacactatatataaatgttttagaaacattctgtatatccaagatagtaatgtttattctgtacctttcaatatctgcatcagaaaacttcatattacaactacttgaaaatatatacttacttgaggatgaaaagaatataattttttatttaagatactatctgttactgaaaggatattaagtaatctgagatataatttgatttatgccatttgaaaacttttcctttaaaatttgtgctctatttgcatttttaacagtgattgtatttcatttcaaaccatttagatttgatgtatagctaactcatattaatattagctgtatagttactacatatcataggaagtgccagttaatcaatgtatcgactttgcatatgttatttgaatgccttagaaatgtagatattgctcatgcaaattgattggtaagctaaagaaatgtagatctagtcttaatttcaaattgtttgttaagcatcaaagcaagagaaaaatcacaggctactgtgaattgtactttaatttgttcttatcttttttcccttccttttaatcgcctaggctattttcctgcattattcatttttaaacttttaaaatccagagtgggttaaaatgcttattttactcaaagactgtttacactgcactgttgaaacatcagattatcaagttcaagtctttaagggaacatctcttttgacatcttaaaatttaactcgaaaagagtttctttaagctgttaggtgtaaaaatattttaactttcttatttcaaattttaaaaactcatacatatcagttcatgtattcatttcattcagtaagtatgcaatgtgcatatactgtataccaggcattgtgctaagtgctgaggcttctaaggtgaacacaatttttggtctttagatagttgagattaagaaagttgtgcttttagtcactgttttctttgccgataactgagcacattgtcacaaacacaggcatggtcactctttgtccattataccaaacattaagccttgaattatattggataaatgttctcttatataatttgatgttatttgtatgtgtttatgtatacatgactgatttgtttgactactaatgtatataatacctatttttccctcctattccaggcaccaagtatagatgagaaagtagatcttcattttattgcattagttcatgtagatgggcatctctatgaattaggtaagaactattttaatttgtcctggggagagaaatggtaaatgggaaagtctctacttatgataaacaggactattgatatttattgtgtttacttaaattaactgattgcctataaaattgatttgacatagcgacagttttccttttaagacagtttactagaaaaatgttattttatgtttaagcaacttataattcaaaaatgtttgcataccatcttcgcattttagcaaagcaagaaagtaaaaaccattacagggaactgcttcaaatctctctggcaatcattacaaaattattgagtgggttatcatcaatatctggctgaacaacctttagttttaaaagatagtgtaatatttgggaggctgaggcaggcggataacctgagctcaggagttcaagatcagcctgaccaacatggagaaaccccatctctactaaaaatgcaaaattagcccggcgtggtggcacatgcctgtaatcccagctacttgggaggctgaggcaggagaatcgcttgaacacaggaggtggaggtttcagtgagccgagatcgtgccatggtactccagccggggcaacaggagtgatactccatctcaaaaaaaaaaaaaaaaaaaaaaaaaaaaaagagcgtaatagttgtaatgattgggctgagtgtcactagttttcagggttttgtaatgttcctgtgattttttaaagactttacaggagcctttgttttcttcaggcatatgtcagagtacccatgattagttacttggtattttggcttatacctgtactttttttttttttaagtttacctttcagtggactatttcatggcatgttggaggagatcacataatttactcagacagaataaacttcttgtaattttttcataattggtatacaatacttattatgacttcttcttattcttttccataagaccttctcgagttttaaaaaagccaaataaacaacaaaaaagagaagttcttttcagtaattctagataccgtgagttttggttctattacctctcatttgctgtctatatattaccttgtcacattaattttaagttgtataaagatagaagattttgaaagaacacagattgtgactgtaaatgtgatccataaaatttaggtggattttgtgtttggaatattagcaacagatcgcatactttattaaaaagaaatggccctatcaaaggggacaaggaaaagaaagaacatagtatttataaaaatgtgcaaccctgagcgttgtctacaatactagagtgatttgaggagtaataaaacttaaatgagaagaagtcattattttggtagtatataatggacctccaggacagttttgaagatgtgccttgctaattgagtctacaaaatctgcagagataaagtataacagtgattggggacttcagatgtctgggtggttgctggaagcagattttctactctgaattgtgaatagtaaataataactagtggaagaggaaataaagagtgctgggacttaacagacacattctgttaacttcaagaaagtagatttggccagagcaaacatatgtaggattcataaccagagactataaatctgattgtgactttcagaatgagagacttacagagcaaacaataacatctaaaatatatttaaaccaaaagaaaacctctctaatgatctcaatgggaaggaaagagttatcttaaaaaaaaactcggttttactagttagatagctgtcttggctcagaggctaaaagggcagttagaaggaaggacatatatcaagggtaagctacatatgaagaatgatgctcttttggagcatgccaagatcaacacaaaaggattttaaaattggtttgaagtaagaacttcataaaacaaaggcagaactactgaggtcttgtttggtttagatattctttatcaagaagaatgatctgatggaaaattagaagcctactggaaattagattttttaaatgagtttaaataatttcagagtggtaaagaatagccataatctttgagatgtcagagcaataataggtacattacaaagatgggcagttgctgattcattgcaaaggaaactggcagtaactctgatgcagatctaataaattcaaaaggaatattgagcaagaagagtattgagttagtgagtagaaaatagtgattaagagattagcactgggcacagtggtgtgttcctgtagtcccactttctgtagtgggaagctgaagcacgattgcctgagcccaggagtttgaggctacagtgtgctatgattgcacctgtgaacagccactacacttctgcctgggtgacatggcaagacgtcatctcttaaaaaaaaaagaaaagaagacactatataacttttaagaaagaagtcatttcaaagttcaatttgctctctgtgggttcttgcattggtagattcaaccaactgtggattgaaagtattagaaaataaataccaatacaacaataaaaaacaaattttgaaaacaacataacaactatttacatagcatttatattgtattatgtatgataagtaatctagagatgatttaaagtatttggaattgtgtaggttatatgcaaatactataccatttaggtagagtatgtcaaggggcttgaacatctcaaaattttggtatgagatggggccggtgtcctggaaccagtcccccacagatatggagagatgactgtaactttatttttaaaaataaggctgtatgattgtagacattgtgcaagttaatttctataggatatctatatttaacagagaatggtggtagtctttaatgtattaattccctactctaataaattgtaaggttaaccaatgaaaaggactgagttatttctcttttgttatcaccctcccttttccttggggcctcatatagtttctggcatatgtaaaggggaagaagtacatattttaaaatagataaaatgactccttgtggatatagagtagagcattgggatttagaggtggatttggaactgattgaacaatcagattaaaaaaccattaactaataaattattgtctacctgaagtaacaggaatactttgaagcagttttagaaattttattttgaagtaacttaagatgtttgtagaagttacagaaatagtatacagagctcccatacatcctcccacagattacccagattcaattcatatttctgagccatttgaaaataagttgaagacatgatgctccattatctttaaaacttctgtgtgtattttctcaaaacaagtggatactctcctacataactatagtatgaatatcaaaatcaggaaattattataacattgatccagtattatctgatccacagaccccattacagttttcctgattatcacaataatgtcctctattcaggagccaatccaggattatgtgttgaatttgtcatgtttctttgtctcctttaatctggaacagtacctcagaatgctttcttgtctttcatgactgtaacatttattttaagagtatagggccagttactttgagattatcctccaatttaggccatctgatttatcctcatgatttatgcatttttggcaggaataactgcagaaataatgctgcgttcttctcagtgcatcatatcgagaggcacatgatgtcaatttgccccattactggtgatgtttagtgacttttaggtagtttcttcacaataaagttaagaagtatgtcatgcagttgctcatcaagcttttatcctccagattttgcatccattgattattcttgactggattatcattatgactattgccaaatggcaattaaaaaaaaattcccccaacattagaagctttccttttcctctcatttattcatttataatcagaatggactcatggattcctactttacttgaatgattataatccatgatatcatgtatttttatgctcaaattactgcagacttggcctttgaaaggaaccccttcaaactgcagccttgatgtcctgggctccagcaatccccttgtcacagcctcctgagtagctgggactgtaggcctgtgccaccatgcctggctatttttttttttttttttggtaaattggggtctagctatgttgcccaggctggtcttgaactcctgggctcaattgatcctcctgctttagccttccaaagtgctgggattacaggcatgaggcactgcacacaggccatagttttaatttttaagagttcttctgttctctgagtttgcatagcatttgaaaatatggcattctgttcttttatgtatgtagaatttcctcattttaaggatagtaataatacaggaatacctcatttgactgtactttacatatatttcattttttacaaattgaaggtttatggcaatcttgctttgagcaagcttattggcaccattttttccaacagcatgtgctcactttgtgtttctgtgtcacgctttggtaattctcccaacatttcaaacgttttattattatatctgttatggtatctgtgatcagtgatctttgatattactaccataattgttttgggatgccacaaactatacccatatatgctggcaaacttaattgatttcatgtatgtgttctgactgctccattaaccagccatttccccatctcttttcctctctttgaacttctctattccctgagacacaataatattgaaatgaggccagataataaccctacaaaggcctgtaagcattcaagtcacacgtctctcactttaagtcaaaaactagaaatgattaagcttagtgaggaaggcatattgaaagccaggatggtctgatagctaggcctcttgtgcaaaacaataagccaagttgtgaatgcaaaggaaaagttcttgaaggaaattaaaagtgctgctccagtgaacacatgaatgacgagaaagcaaaacagtattattgctgatatggagaaagtttgagtggtctggatagaagatcaaactagctacaacattttcttaagcctaatctggagcaaggccatacctcttttcagttctgttaaggctgagagaggtgaggaagctacagaagaaaggtctgaagctagcagttggttcatgaggtttaaggaaagaagtcatctccataacataaaagtgcatggtgaagcagcatatgctgatggagaagctgcaagttatccagaagatcaagctcagatcttccgtgaaggtggctacgtaaacaacagattttccatgtagatgactagccttctcttgggaagaagatgccatctaggacttctgtagctagagaggagatgtcaacacctgccttcaaagcttcaaaggacaggctgattgtcttgttaatgcagatggtgactttcagttgaagccaatgatcatttgatattcagaaaattttagggtccttaagaatgatgctaaatcttctctgcctatgttctataaatggaacaacagagccgggatgatagtatatctatttatagcctggattactgaatctcttaagccctctgttgagacgtactgctcagaaaaagattcctttgaaaatattactgctaattgacaatgcaccttgtaatccaagaagtccgatatagatatatttacaaagagattaatattttcatttctgctaacacagcatccattctgcagcccatggatcaaggaatcatttagactttcatttcttgttatttaagaaatacagtttgtgagactatagctgccacagtgattgctttgatggatctgagaatagtaaattggaaacttcctggaaaggattcaccattttagatgcccttaagaacattcatgatttatgggaagagctcaaaatatcaacattaacatgagtttggaataagttggttccaatcctcatggatgactttgaggggtttaagacttcattggaggaagtaactgcagatatcatgaaaatagcaagaaaactagaattagaaggggagcctgaagatgtgactgaactgctgcaatctcatgataaaacttgaacaagtaaggagttgcttcttaaagatgagcaaataaactgatttcttgagatggaatctactcctaataaagaagtcatgaacagtgttaaaatgaccacaaaccataaaggatttagaagattacataaatgtagttgataaagcagcagcagaatttgagaggattgacaacatttttggaagaagttctcctgtgggtaaagtgctgtcaaacagcatcacatgctacagagaaatctttcataaaagaaagagtcaaatgtggcaaatttcattattgtcttattttaggaaatttccacagccaccccaatcttcagcaaccgccgtcctgatcagtcaggagatatcaacatcaaagcaagcccctccatcagcaaaaagatggcaacttgctgaaggctgagatgatcattagcatttttaggaataaagtgttttttaattaaggtatgtatattgttttcttagacataatgctaatgtatacctaatagactacagagtaatataaacataacttttatatgcactaggaaacaaaaaaatttgtgactcattttattgtgatacttgcttcattgtggtattctggaagctaacccacaatatctctcaggcatgcctgtacattttttagaagttttaatttctgtatagtctctcttttttaagcctgtacattttttaaaagtttttatttctgtggctgggtgtggtagctcacgcctgtaatcccagcacttggggaggccgaggtgggtggatcacaaggtcaggagatcgagaccatcctggctaacatggtgaaaccccatctctactaaaaatacaaaaaattagctgggtgtggtggtgggtgcctgtagtcccagctgctcgggaggctgaggcaggagaatggcgtgaacccgggaggcagagcttgcagtgagctgagattgcgccactgtactctagcctgggcgacagagcgagactctgtctcaaaaaaaaacaaaaacaaaaacaaaacaaaaacaaaaccagtaaaacagtttttatttctgtatagtctctgttttttaagctccatcattcacgtcgttggccattgttgggtatttgacagtagctgatactcagttatctgcaccaaaaagcatctcgtgatgtttgtcatgtcgcttgtctcttgtacaactctgttgtcacctttctctgggggcttgtgatcacactatgcaaaaaacaagttctgaatgaattggttagttactaccaaaaagtcaggccactattttcttccccgtccagcctggaagtggcacagcccgtttggactggggtttttaggttacatgacccatgtacaaggtgcagctttttcctgcctcttttagaaggggcctgtaagtgtgacagtctctgagcctcatggattcatctgcagcgtatgcatttactgaaattacacgcaaagttgttggcaagtgacagttttgtggtagtagtgtttggaacaacagcaaattttacattttattgttttggcaaaatttttctgtgaaggaccaagtagtaaatattttaggttttgtgggctacatactgtcttttaaaaacataaaaaccagtcttagcttaaaggaggcattaaaaatacactgagggctggatttggcccatggattagaataacagtaaaaatcataattaatctttgttctatactgctattataaaaatagactgtacggttttgacatttcaggatcagttgtttaacaatcttagtctataataattgaaattaattatatgttactttaaacagctgcattcaaaggaaaattgctcactgccattttttgtttttattttattatgttattattttatttttttagagacagaatctcactttgtcacccaggctggagtgcagtggcatgatcatagcttgctgcgtccttgaactcctgggctcaagtgatcctcctgcctcagcctcccaaacagctgggactacagacttgtgccactatacctggctaatttattaattctttgtaaaggtggggtctcactgtattgcccaggctggtgttgaactcctggcctcaagcaatcttcttaaattacaggtgtgagccaccacacccagccataactgagtttattagctctttagtctcatgaatgacacacacacagaaatgatggaaaccaggaaaatacatatattaagccaggtgctgttgcatgtgcctgcagtcccagctacttgggaagctgaggcaggaggattgcttgaacgcaggaggttaagttcagcctggggaatataagtgaggccctgtctctaaattaaatagaagaaagaaaaatacaaaaggaaaaaatatatattaatttataatttggttagggagggaacagcctacattgtttacttatacttttgcctttatgtaaacattaaaaaataatacaaaatggggtggcacataatgaatgtgatagtcatataaacatagaatagtctattgaagaataagcatttaccacaaaaggatattttaagacattttatgatatattattgagaaatatacattataatttagaaagatagtataagttcatagaaatatggataattaagtgttcatgtgtaatatagttacaggaaaatatttcctaaaggttcttagaaactttaggaattatgtcccaggcattgtaatttagggataagtttctttaggattttgaatatttatctcaatgttagtccaaaaataggaatcacaaattctgatgatataatttatagaaattaatattactttttatggagatgaatttatgtgttgattttcattcatttttttaaaaaaaatctaacaaccaagtctattactagatgcatattcagaaatttttattatggttagaaaccatggaatcgtagaaggggctgtgttttatggattgaacttaatgaagagccacttacaagacatctgagattatggatttggatatataattgtcagttgactttgggttagcatgagtttaaataattctggacttcttaaaaaataatattgaaaaagtactagtttatttaagttgattgtgaatttgcttattttggtggtcagtaaaataaccctgggttatttggattattcctctatattactgcattgatagtacacagttaatagtagtattgtataagccatgacagtgtagctccctttcattgttttaaacatgtctgtcttacttgagatcttcctatttaaagtgaaaaaagaaatttttttaatttccaaggataaaagctggggtgataatttttaaaaaactgacaataattttgcgtattattttcaggaaacgaaagccagcattgtaataaattccgttcatgaagataatttaggctttcaaatatggaagcaaagttctaactaataacctttaataaaaaatattcatggtagcacattaaaacatttgttttaggatatattattgaaaatggcttttaacttttcttgcctcactgggggaagaggaaaatggaagttgaaagcacattatcctgtaaaaacagctaagcattcaattgtttgtctgttttccacagatgggcggaagccatttccaattaaccatggtgaaactagtgatgaaactttattagaggtaacagtaacacttgttggcccatcttcatcaatattttgtcatctttaaaacatctctaaaggtcacttgcataacattttctttgtatttggatacttctttatccttgttctctctagaaaatccaaaaagaaaatttatattagtgttaaaaatctacaacaaataaagaggttttcacagctctatgaacaaatgtaaaatttgaaaaggcaagaatagtattgaaagacttgctcattatatcccagatttcatcaaatccaggataccattaattgtatcttgatcctgattttagagattttaaaacatgaataaattgtgtggcttagaatcaatgaaacgtgatttttagttgaaaagtttcttaatagcattttaagaacacttacggccaggcgtagtggctcacggctataatcccagcactttgggaggccgaggcgggtggatcacctgaggtcaggagttcgagaccagcctgaccaatatggtgaaaccccatctctactaaaaatatagaaattagctgggtgtggtggtatgtgactgtagtcccagctactagggaggctgagataggagatttgcttgaacccggaaggcagaggttgcagtgggccgagattgcaccactgcactccagcctgggtgacagagggcaagactctgtctcaaaaaacaaacaaacaaacaaaaacttactgtatcttatacttttgtacaaagcaaattagggcacccatgttcacttttctggtgttctttatttctcatttggaaaaggaagtttgcagtgtaaaattagtatgaattagaaaaatatgaaatgtttatcatttgtaagtaaaacacttttacactgaaaaatcatacttttttttttcctccataggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggttaaaggtgcaatgctttcctcctcttttcttgtgaaggatttatcttgtttgaaaactagcaatagctttcttattctttttagattttacaggaaattttgtattgggatactaggcacaatttccatctgcataacatgaatatatattatctatgttaacatgtttatttagaaaacatttgtgaagcgtctacttgtaacgagatggatgccattctgggttcagaagttaaagcatagaacgctgttgaaaaatgtgatagttatggagcttatgttattgtgagaagagataagtaacaaacacatcaagataaataccaatgatagatgctgtgtggagaattaaaataggatttatgttagggaatgaccgagcagctactttagattttgttgtcagggaggcttctgtgaggaggtgactttaaagttgagatctgaatgactaagcctgtcataaaggtggtggggaagagcagaagaagtaatgaatgtggagtccctaaagtaggaacatcttgctgtattgtaggaccaggaaggaggttcaagtggccagaacatagaaagtaatagggaaagtagcaagagatgaggtcagaaaagtaggggctttttgatacaggaaaaggcatttggattcattgcaaatgtgatggtaagccattggagaactttaagcaggacaggaacttgctttgatttgtaattttaaaaggtccctctgacaactccatggataatatattgaggatgggagcaagaatagaggtagaaaaacctgtgaggtgcccactgtagttgttcagtgggatgatgatggctgggccttaaaaatggtagattagatagaggccaggtgcagtggctcatgcctgtaatgccaacatgttgaggcatgcagccaggaatttgagaccaacctgggtaacaaagtgagaccccatctctacaagaaaaaaaaaaaaatgccggacatggtggcatatgcctgtaagtcctagctactcaggaggctgaggcgggaaggattgcttgagcccaggagtttgaggctgcagtgagccatgattgtatcactgctctctagactgggtgatggagggagaccctgtctcaaaaataataaataaatttagatggtggtacatgagtgaattttggttgtgctttgaagaaggaagggcttcaattgagtctttaaggatatgtggaaaggcagtagaaaagtgaaagggcatttatagagttgggccaaaacacagagttgatgtgatgacagtgttctatatctttttgggagaggaatagccattactcgggtatatacatttataaaaactcattgacttgtacattaaaaatctgtacttcactgtatatgcattttacctaaagtagggggaggtagtagttggttacttggaatatgcatttatcataactctgaattgtacatttaaaatctgtactttacatacattttatcttaagaaaaaaaaccagggttgggttgaaatgagtataataggagaaaaaccagattggtctagaatgaagtttttgaccagtaattgaatatagatgtttacgcacaattcactgagttaagagtagtaaggcgtggcttttagaatgaattagatctttgttactcaagtgtggttgcatcatagtacctgggagcttcttagaaatgggaaatttcagaccccacccccaaaaccttttaacaagatccctgcttattcataagcaataaattaagctggaagcactagattagattagttaagcatttttaacaagatcccttcttattcataagcaat

SEQ ID NO: 15595 - DNA, 82000 bp, Human
  misc_feature (1)...(82000): n = A,T,C or G
tcctgcttcagcctcctgagtagctgggactacaggcaggtaccaccacacttggctaatttttttgtagaacggagtcttgctttgttgcccaggctggtttccaactcctgggctcaagcgatcctcccacctcagcctcccaaagtgttgggattacaggcatgagccactgtgcccagcccaagaataatttttaaaaatttttaaaatttgagctaaaggaaagaatcataacaactaatacccaacactaacattattactgtaacaccgagacaactttttttctctaagggccaaggtgatccgagcccttttctttcactcaactcaggaatcacttatggcccattggagctaaaatgtgaagctgacagggaactcaggtgtccaagacaacaaattgtcactgaattagcttccttccttccttcctttatttatttatttatttatttatttttattgagatggagtctcgctctgtcgcccaggctggagtgcagtggtgtgatcttggctcattgtaagctcagcctcccgggtccacgccattctcctgcctcagcctcctgagtagctgggactacaggcgcccgccaccacacccggctaattttttgtatttttagtagagacagggtttcaccgtgttagccaggatggtctcgatctcctgacctcgtgacccacccgcctcggcctcccaaagtgctgagattacaggcgtgagccaccgcgccggccccttttatttttatttattttattttattattttttttgagacgtagtcttgctctgccatccaggctggagtgcagtggcgcgatctctggtcatctccgtctcccaggttcaagcaattttcctgcctcagtctccggagtagctgggattacagacgcgtgccaccacgcctggctaattttttttttttttttttttttttttgagacggagtctctgtcgcctaggctggagtgcagtggcgcgatctcggctcactgcaagctccgcctcccgggttcccgccattcttctgcctcagcctccggagtagctgggactacaggcgcccgccactgcgcccggctaattttttgtatttttagtagagacggggtttcaccgtggtctcgatctcctgacctcgtgatccacccgccttggcctcccaaagtgctgggattacaggcgtgagtcaccgcacccagccacgcccagctaatttttatatttttagtagagatagggtttcgccatgttggccaggctggtctcgaactcctgacttcaggtgatccgcccaccccagcctcccaaagtgctgggattacaggcgtcagccaccatgcgtggtcagcttccttttagttagatcacctatatctcctgccttcccctgaaaggatagtccttgtttttgtttacaagtgctaaattttaaaagttacctaaaagggtctctagcatcatcataaagtccaaaaaatattttactgacagggctggcttttaaaaaatgagttaatacatataagagtcgttggtactccataaactgcttgcagacctaaatcgctgttgtgaaatgcctttaactgttccgttgcccactccgacccttggcttgttacgcctctatttggtcctcgcacctcgcagcgggctcccgcgccctgcgcgcgaccccctccaagttcccgcctctttttactcaggcccctccttcctctcaaatccccgggccctgacttggccccgagacgcatgcgcactaggaaagataggcggagtcttgagggaggaggagcagggaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggtgagtggggggaggagagtcgagggagggggttgtcctgtcggagtggggggggaacactaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccctgccttcagccccccccatcatttcccagccccatcccccttgccaaatactgagctgtcgcctgcggcgagatgggtgactgcgcatgcgcgagtgtgaacgcgctcgggctgcttcttcgctgccccgggggcgcatgcgcatcgcggtgttgcagggacctgcgggataaagagccggtggagcacgagtccgccttcttcccaggctgtgggctagacttgctgccagataatgagcctgttgctcctgtccaaaggggagaatttaaattatgtgaaagacttaacggacaaagcactattctcatctggtgttgccctagagactcccaggctacaaacgcctcgcagagccagcgtgtcccacactgacccttcttttgaaactgtcactgtatcttctagttctaggattacttttccattcctatactcccatcgttgtgcttgtaccttttagtaccaacttaccctaaatttaggagtgggtgctccatcccatcacttattctggcaggggattttggaagccttgctaaagaagactaagggtcataaatggaactaagtgaggcatttcattttagtaaaattcttaattcgcagaactagataagagagataaagggcaccggccttcttactttgtgtgacctatttgccttttttttggtcaaagatcttccttagcacttttcattttatctgtaccttattggtgctctgtaacatgaaaacaaatcggaaagcaatctgaaactgttggtggacaataacttattcagtggaggttttaagtaatgtgatgtttctttcacgttggcagataacaaaaagaaatgtaaataacgaactttgaagtacaatagtatttcagtgatctaggacctgggttttcagttagcgattatatgtggccctttttttggatactttgctgctgcttacctctgccatcaaaacagagtgaagaaaagataaaatcttaatagcaaaagattttctagataacattgaaatgaatagctaaattgttgtggggaagggagtgcgagaggaggggcattttttgtgtttttcagttctccttgccaatcccgtctcctagctggataactgggaagggaactattagtaagccttactttcaattctctttagtttgtattctttgatgttcttctctcaaggcttttttggctgccactgttaactccaaaaccgcatgttcttgggccttaaagtatatgtatttttcacttccccttttaaccctggcccttacagggttctgctgtcttttgtgctgtttcctgttgccatggttacagttagaaccaagagatgacacacagggaacagagaaatttggggtgcatatatcttcctgggaaagagctggaaactcacctttttttccttagaggtagaagttattgtaagactaccccacccttaggtttggggtagttgttatccatttagtactttattgatttctcgttttagagctcttcatagtagctagtttggtatttggagatgtttactgtttcctatgtccatacttagatattacttaggtagtatctagaagtgaaactattgtagtaagtgtccgtcttctcagtaggtttcggccattgggatgcttagattttttcttttttccttttttttttgagatcgagtcttgctctgtcacccaggctggagtgcagtggcgcgatctcagctcactgccacctttgcctcctgggttcaagcgattcttctgcctcagcctcccgagtagctgggattacaggtgagtgccaccatgcctggctaatttgtattttttgtagagttgaggttttgccatgttggccaagctggtctcgaactcctgacctcaagtgatccacccccgccttggcctcccaaagtgctgggattacaggtgcgagccactgtgcccggcctgattttttctagaaacattttgtctagttgaattcactgaagcctcatttaaaattttgatggcgtgcaatgcttttagattaagacgaatattgttaaataattcgtactggtgcagagccttttttaaaaaatcattgtttaaaatgggttaacacatgtacatacatatgaaacaaaattcaaaaggtacacagagagtgaagtctttcttttcttaccatcctctttttatccatgagttccccttcccaaaggcaacagtcttgtttattcatcccgagacagtatatccttttacaagcatatacacctatatattcttcacattttttgtttttgtttgttttacacaataagacactatgctcattctgcactttgcttttctcactttatttatcttggtgatcattccatgtagtaaatacagtccctcttcctttttgaaagatggcagataattccattgtgtagatgtaccatcattcagccaacacttattggacatttaggttgtttccagtgatacaattaattccttgtatgtacttattctgtgtacatgggtgtctgttggtttaaattcctagtggaagcgctggatcaatggatgtgcatttgtaatgttgttaggtattactaaatgctttccacagaggttgtatgaatttatattcctgccagcagtgtgagtctgcctgttttctcaccaacactattatcaaaatttttgatcatttgtgcagtcttttatctaagattttaaagctcattatgtagtttgttaagcttcatttcactgaagagttgtgtataaatacctcactgttttgcagattggggaggggtcatggaggattttgtttgaaaaataatgtcatgagaataaagtcatatgtctggataatagcaaatccatgacaatgctaggaagacataaaaaacctatattccaatttcttcctttaactcttagatgctagtttctctgttagtattctgtaaacctgtaaatgatttatgatctccttttgatagctctgactttaaattgtttatccaagtaaactgctgttattctggtgagaaattgaaaagctaatctagttagttgaggtctgctctcttggtacagaatactggtactagcattttttaagtctgctgatagcagaatacttcactatgagcttcaaataaatagaaaataattaaatatgtctgtgcctgaagagagcttacagtcttgttggaaaacctagaagaaatggataactttctggacacatgtagtctaccaagattgaaccatgaagaaatagaaaacctgaacagatcaataatagtgagtaacgagattgaagcaataataaaaagtctcccatcaaagaaaaagcccaggacctgatagcttcattgctgatttctaccaaacatttaaagaagaactaatagcaattctactcaaactattctaaaaagttgaagagaagggaatacttcttaaactcattctatgaggccagccttaccctgataccaaaaccaaagatgtaatctttttatttatttatttatttttttttgagaccaagtttcacggctgttgcccaggctggagtgcagtggtgcaatctcgactcaccgcaacctctgcctccctggttcaagctattctcctgcctcagccttcctgagtagctgggattacaggcatgcaacaccacgcccggctaattttgtatttttagtagagacgggatttctccatgttggttaggctggtctcgaattcctgacctcagatgatctgcctgccttggcctcccaaagtgctgggattacaggcctgagccaccacgcccggcccaaagatgtaatcttgttgtaaagccacacctactgaatataggaaataataagagaacaattagaaaacagaactggaacagtaatacactgtgttccatgctgagaggaccttgtgaagacatgattaagggttagaggagagttcatttgggaggccttcctggaggaagtgcatttggagcctttttcttttttcgtataatggtttaagtgaaaaattttaaacatacagaaaaatggaaaaaatagtacaattatcacctttatatccatcacttagattcaacagttgttcacattttgctatatttactttatgtatatgcatatttattttattttattttattttttctgagacagagtcttgctctgtcacccaggctggagtgcagtggcgcgatcttggctcactgcaagctccgcctcctgggttcatgccattctcctgcctcagcctcccaagtagctgggactacaggcgcccgccaccacgcccggctaattttttgtattttttagtagagatggtgtttcaccatgttagccaggatggtcttgatctcctgacctcgtgatccacccaccttggcctcccaaagtgctgggattacaggcgtgagccaccgtgcccagccgtgcatatatatttaaatatataaatttttgtattgcaaacatcatgacactttacccttaaatacttcagctgtatctccttaaagcttataatattgtcacagttaaggcaattaacagtaattctctaataccatctaatatccagttcgtgttcagattttcccaattgtcttgaagatgacacttctttttttcctccaaatatatctctttagtctctttaaatctagaacaatttagaagccacatgatactgttttttgtttttttttcgagatggagtttcactctgtcgcctaggctggagtgcagtggcatgatcttggctcactgcaacctttgcgtccagggttcaagccattctcctgccttagtcttctgaggagctgggattataggtgcccaccaccacacctggctaatttttgcatttttagtagagacggggtttcaccatgttggctaggccagtctcgaactcctgaactcaagtgattggcctgcgtcggcctcccaaagtgctgggattacaagcgtgagccaccatacctggcctcatgatactggtttttaaagagcccgagctgtttgtcttgtagaatatatcacttatgggattttctggttatttcttcatagtttcataaacagatattgagctctaaaggtctgattagattatcattaaacatttttgatgagactactttgtacgtgtttctttgctcctcgctgcatcatagtaggagaaacacaatgtcataatgtcccactattaatgatgctgagtttgtttgatcatttaaggtggtaaataccagactcatttgttgtaaagacaattttccccctttgtaattagtaagttatctgtggagtggtgctactttggcattgtactgttacacttctccagcaacatttcacctcatgataatgatctttgcctaaatcagttaattcattggtttttggaaatagtgatttttctgattctgtcatttcttttacactgatttgctttcaatcttctgtaaggattttcctcatcggttaggaataaattataattttttttttgagatggagtcttgctctgtctcccaggctggagtgcagtggagcgatcttggctcactgcaacctctgcctcctggattcaagtgattcttgtgcctcaaccttccaattagctgggattacaggtgcccaccacaacgctcggctaattttttgtatttttagtagagatggggtttcaccgtgttagccaggatggtctcgatctcctgaccttgtgatccacctgcctcggcctcccaaagtgctgcgattacaggcgtgagccaccctgcccagccaatttttgtgttttgaatagaaatggggtttcaccatattggccaggctggcctcaaactcctgacctcaagtgatcctcccgcctctgcttcccaaagtcctgggattacaggcatgagccactgtgcctggcctaaattataatttctactaaaaaattgaggtaaattcttaattttttttctttaacacttttctgagtaaggaaatggtacaatatcatctctaatggtggtaaatgagtttttttcactctcattgttttagtgtcatggattttagtttattctgttttaccaacattaccttctttttgatgctcacactgtcctgtatttggcctgtgggagccctttaagcttgagctatgagtgcttccttgctttctgtcacaagaagttcctagctcactttgtatttttcccgtcctagatgcagaacccttacccttaacctttatgtatatgacattttcttccctttcagtaaattatgaggttggtgcaaaagtaattgcggttttgtcatttaatggtaaaaacctcaattacttttgcaccaacctctaacaggttatttgtctaccatatggagcttctggaaccaaattctaaaaactaaaggtgctttaattttaacttgatgtacctagtgtttgactcgcttctgtgtcactggcattgctggattctggatgttagaactcacagcttccttgtcttgaatattcttcgtgaaaggcagtatctctgaagagagcattgaccaccccgttgtccccacctctcatgagcaaacttgtttttttctaagatgaaaggcacacagaataaaatttagaagttgaaattgtgtgtttctaagctttgggatgtggcggttttattattatataaaaacatctgtgcgtctatgcacaagtatgtcttcccttttcctcatctctacacagtgttatgtaagattatgctgtaatcgcatattttttttattactagattttcatcataaagaagtgaggcaaattgttcttaattagggaaaaatttcagataggccgtaaactctgatatctagctgtcttaactcagggtctggaacagtgctgaatcctgtggctttctgtcatgtactgtagactcaggagaaaagtcagggcagccacaatgttttctgaaaattcatcacactaataaaggttaatacaaatgaaagatacagcagaactgcattctaaagtgggtttcggagtggactaattcctatcttagcaaaaaatgttttgttagactcctacaatgtagtggtatttgagtaatcttactgatttcaggttactcaaagccagataataacagtattctgatatttatctgaaattcatatttcagtttctttttaccattttgtcatatttacaaggttattctcaacctggtttcataacaatactggtcccaaattaaatcctggttgtatattcagggaagcacacctgtttcttgtgtttgttttcaggcatagtgaatctctccgaaaggctattctgacacatttgccaataagacctagtagctgcttttatttttgtttttgaaaagctcccattacaggaaaaagaaattctaaagtacacattcttgaggaaatgcttgggctgtcattcttccaattatgatcatgttttaatagaactggcaaggagttgcctaggtactctatgacagagctggtcatgcagctttgggagagctggatatagaccttagggaattaaccattcagacagcaacaccttcttgaccatggagacctttattcttgacttttgattttctaaaaagctgttagtgtaaatctccttgccatgtcagtagttctttgaaagcctctaatctccccatctatatatctatttatttgtaagaggaaaaatgtatgtgtgatcattcatctcctcaaattgagatttatatattcctttacttgatatttggaaacagataaccatgtagaaattttctgtaaataaaaatgacagtttttcagtgaacatcttttatgctgtcttaattttttttttttttttttttttgaggcagagtcttgctctgtcatcaggctggagtacagtggtgcgatctcggctcactgcaacctccgcctcccgggtccaagccattctcttacctaagcctcccgagtagctgggactacaggcgcacatcaccacgcccagctaatttttgtatttttagtagagacgggatttcaccatgttggccaggatggtctcgatctcctgaccttgtgatccgcccacctcagcctcccaaagtcctgggattacaggcatgagccaccatgcctggtcttaatttttttttttttttaatattccgtactacaacttgctttttttttttttaatttattttttattgatcattcttgggtgtttctttaattttttaattataaaaatatcttaggctgggcgtggtggctcacgcctgtaatcccaggactttgggaggctgagacgggtggatcacctgaggtcgggagttcaagaccagcctggccaacatagtgaaaccctgtctctactaaaaatgcaaaaattatccgggcatgatggcgggcgcctgtattcccagctacttgagaggctgaggcaggagaatcacttgaacctgggaggcggaggttgcagtgagctgagatcgcaccactgcactcccgcctgggcgacagagcaagactcatctcaaaaaaaaaggccgggcgcggtggctcgcgcctgtaatcccagcactttgggaggccgagatgggcggatcacgaggtcaggagatcgataccaccctggctaacgcggtgaaaccccgtctctactaaaaatacaaaaaattagctgggcatggtggcgggcgcctgtagtcccagctactcgggaggctgaggcaggagaatggcgggaacctgggaggtggagcttgcagtgagccgagatcgtgccattgcactccagtctgggtgacaagagtgagagactccgtctcaaaaaaaaaaaaaaaagatatgtatatatatgagtgtatatatgtctatatatatgtcaatatatatgtgtgtatatatgtatatcttaaacatatagaaaaatataaagaataataccatgcatatacttatcacccagctttataaaatcttaacattttattatatttgcccccagatactttttctagtgaataaaacattactgaaatagcaaagccttagtgtactcctattttcttcttccctccctccttagaggtaacacctatcttgcatttggtgtttattatgttctaactgtgctataatccaatatgtactatatactccagtcaataccattctttaccttaatatttttgcttagtatgtttttttgagatatatttatgttgatacatgtaacttgagttcattttaactgctgtttagtatttggttgtatgaatatgctgtaccacggtttatccattttctgtttaatacacataaggtattttgagttttttattattacacataataaacaatctttttattgtggtaaaaaacttaatattaaatttaccaccttaaccatttttaaggatacagttagtggtgtttagtatattcacattgttatgcaacagatctctagaactttttcatcttgcaatacggaaactctgtactcactaaacaccttcttgtttcctcccacccccaggctctgggaaccacccttctactttctgtctctaggaatttcactactctaggtgagtggtgtaagtggaattatacagagtttgtctattttgtgactggcttgtttcgcatagcccagtgtccttaaggttcatccatgttgtggcatgtgctaggatttcctttcttttaaggctgaataatattccattgcatattttgtttatccctttatctgttgatagacacttgtgttgtttttacctttcggctattgggagtaatgctgatatgaacatgagtgtacaaacatcttttcgagaccctgctttcagttcttttgggtatatgcccagaagtggaattgtggatcatgtaattctatttctaattttttgaggaaactccatactgttttccatagtggctgaaccattttatattgccaccaacagttcacaaaagtgctaacctctctgcagcctaatactttttctttttttcctgttgagatggagtcttactctattgcctaggctggtaggcagtggtgcgatcttggtgcactacagcctctgcctcccaggttcaagcgattctcctgcctcagcctcccaagtggctgagatgacaggcgcatgccaccacgcccagctaattttcgtattttagtagagacgaggtttcgccatgttgaccgggctggtctcgaactccttacttcaagtgatccgcccgccttggcctaccaaagtgctgagattataggcgtgagccaccgtacctggccttttttttttttttaaggctctggatatcccttttagggcaatacttattttgttaaaaaaaaattttttttttgtaatagtagccatcctaatgggtgtgttttaattttttttttttttttttttttaagacagcgtttcattcttgtcgcctaggctgaaatgcaatggcatgatctcggctcattgcaacctctgcctcccaggttcaagtgattctcctgcctctgcctcccgagtagctgggattataggcttgcgccaccatgcccagctaatttttgtgtttttactaggatggtgtttcaccatgttggccaggctagtctcgaactcctgacctcaggtgatccacccaccttggcctcccaaagtactgggattgcaggcgtgagccaccacgcccagccctttaatttgtttttaaacttaattttatcttttatcaaactgagttttagatttgttttgtttttttgagatggagtcttattctgttgcccaggctggagttgcagtggtgcgatcttggctcactgccacctctgcctgccaggttcaagtgattctcctgcctcagcctctcaagtagctgggattacaggtgcccaccaccacaccaggcttgtttttgtatttttggtagagatgtggttttacattgttggccagactggactcaaactcctgacctcaagtgatctgcctgcctcggcctttcaaagtactgggattacagacatgagccactgtgcccggccttgagttttagattttcatgcaatcagatttattatattgttcctatatgggtgtgtgtgtgtgtgtgtgtgtgtgtgtgtgtgtgtgtctgtcttcatgaaggaatcctcccctatatggaggtaatggtttcatcttatattttcttctaaaagttgtaaaagtttgcttttcacctttaggtctctaatccacctggagtttatttcgatgtttcctgtgaagtagagatcacttttttttttcataaagataaccctgaaatatggatccaattttctttccataaggataatctagtgaccaagcatcctttattgaatagtccatctgttccctacaacttttctaatgccacttaaatgtttccatatatatgagagtttgtatctgtattttctctattccataccattggtctttttgcctatcttgtactacactgccttaattctcatagctttataataattatttatatttgatagggcaagtctcactcccttgttctttatttttcagactttctgtcatactggtatttttttttttttttttgagatggagtctcgccctgttgcctaggctggagtgcagtggcgctatctcactgcaacctccgcctcctgggttcaggcaattctcctgcctcagcctcctgagtagctgggactacaggtgtgcaccaccacaccaggctaatttttgtatttttattagagatggggtttcagcatgttggccaggctggtcttgaactcctaacctcaggtgatccacccgcctcagcctcccaaagtgctgagattacaggaatgagccatcgcacctggccagtttggtgtgtgtgtgtgtgtgtgtgtgtgtgtgtgtgtgtgtgtgtgtgtgtgtgtgtctgtatatatatataatctttttttgctttttttgtgagacagagtcttgttctgtcaccaggctggagtacagtggtgcgatctcggctcactgcaagctccgcctcctgggttcacgccattctcctgcctcagcctcctgagtagctgggactacaggcgcctgccaccacgcctggctaatttttttgtatttttagtagagacggggtttcactatgttagccaggatgatcttgatctcctgacctcatgatccgcccgccttggcctcccaaagtgctgggattacaggtgtgtgccactgcgccgggccccaaattggtatattttaatgaagctatttgttgtccaaaatatattcacatgatatataatggacttttcctaaagaaaagaaaaattacaccttccttatctagtaactgatcacttgttttgaatgagcctacaatttccattcaacttttagttttgttggagtaattttatatagggatatcttcaaatggaagggaaccttattataatttggtgtcttgtataaggataccaaataaaacagtttgggtaaaagcatcgaagttttatggtgtcaagacttccttgatcataaggaaatgaaacctattcaaaccagttcatataaaagagtttctgatgccacatgcagggttgaaaaaaacataagccaggggagatttatctaaaggaaaaaggaaatagctgttgcagaatctaaggaaaagctgaacaaccaaacctcagaaaaggctggaaccaaaacagtagcagggtcttccgcaagagtttatggactctagtgttctgctgtaaataggctttagtctccatgaggcataattcagattcctgggggagatctgatatggtcagttgaaaggttgattttcctccgggccagatacctgccccaggttcaacttcagttgcgggtgaggaagtgggagattttggtacaaacagagcagttttgggagtggctggaatcaggcgtatttttcttagaacagtgattctcactgtcgtctcaggagtttttacactgttaaaaacttttgaggaccctaaagagcttttgtttatgtgggttatataaattgatatttaccaaattagatattaaaatggaagacatttaaaaatatttattactataaaataataaacctttctcgttaacataatatatttttatgaaaaaatgttttagaaaaattcatgagaagagttgcattttttacatttctgcaagtctcttaaatatccagcttaatggaaggcagctagattttcatatctgcttctattcagtctgatgtgacaatttgttttgattgaagtacccaaagaaaatatggcctgaaagaacatgtagttggaaaagggagaagtattttatagccttttcagacaattgtgcatattcttctctgatactacaccaaaacttgacaagtgttagtttcttataaattaagttgcagtatgaaatctgaaatcatattgatgttactgttacattaaaatccattaacctgacttgcacttgaatggatcttttacccatatgtgattttagaatatcatgctgcggtcttttgggaaatacttgttaattgagttaagcagatcttctaaatgtttaaacattttataatacaataacaaaaacccacattagttatatcaccacccatttcatcagcaaagtctataagtattgggaagctgtcaagtagctacagattttccagaattctagtttttctctagaagcctggtttttatcattggcaacaaatactgtcacttgttttcctcaaagtgacagactccattttcaagaaaatgtctgctaaatattcatgtctaaataaccagtttgttctttgttccaagtaaaagtagggttccatggaaaaagcagctagttcaactcacaactcagagtcacaagtgcttttcctggagacagcccattgtacttgagtatcttgcagaagtgctttatgcatacttcccagtttttttacagactatttaaaagacctacactcaagggtttagatttaattaataatttttattgcttcatcaagaacattcttaagtgcaagcaattgttttttaaagtcacctgtgtgatggcaaaagacaatgactgtagtacagttcgatgtcattacttatgctgatgagtaatagctcatgctagcagtggtccccaacctttttggccccatggactggttttgtggaggacagtttttccactacctggtagttgggatggttttgggatgaaactgctgcacctcagatcatcaggtattagattctcataaggagcttgcaacctagatccctcccatttgcatttcacagtagggttgaggctcctttgagaatctcatgccatggctgatctcacaggaggcacagctcaggcagtaatgcttgctcgcccgtccacctctcacctcctgtgcgcctggttcctaacaggccatgggtcggtaaggtctgccgccctggggctggggacccctgtgctaaggcaccagcagttttacccattattgctcttgtactatcagcacaaatatcaacataatgaaaaaggcaaacaatttcttggtattgttatgaaaataatgttgccttcacagaccacttgaaagggacctccaggaatctactgggaccacactttgagaaccataaccttaagagagggtgtgggtggggaaacaaaggtcaatacttgaagtacaggtgtttcctgatggaattttaccggatcgttagtgcagtcacttaacatcactgaacataatgtcaacacgaatgggatatttttaaagatcataaaaagtttcaaatttcttttgaacagaaatgtttttctaggaattatcatttacttttttttttttttgagatggagtctccccctgtcgcccaggctggagtgcagtggcgcaatcttggctcactgcaacctccgcctcccaggttcaagcgactgtcctgcctcaacctcccgagtagctgggattacaggcgcctgccatgtggtggtgcccggctaatttttgtatttttagtagagatggggtttcaccatgtcagccaggctggtctcaaactcctgacctcaggtgatctgcccgcctgggcctcccaaagtgctgggattacaggcgtgagccaccgcgcctggcctggaattaccattttctaacagcagagtttatggtgtttggattttcagccagatagtctttcaagtatataataatcttaggggaaaccattttaatgaagcttatggaatttgtctcatgtagtagtacatacagcttaacatttttttcaagcacttgaatatattttgaaaatctgtcacaatctgaggggggcaaaaatctgagctttaaaaattgcatttgggcaggtcctgcctttctagaaaaggcatagaagagaaagttcatactgagaattctccattctagctttgtatcttttggtcattaaagggtctctctaaagaggaagagacctccctacccccaaaaatttaaattttttttttttttttttttttgagacggagtttcactcttgttgcccaggctggagtgcactggcatgatttcggctcaccgcaacctccgccttcccagttcaagtgattctcctgcctcagcctccaaagtagctgggattacaggcatgcaccacaatgcccggctaattttgtacttttagtagaggcggggtttctcaatgttggtcaggctggtcttgaactcccgacttcaggtgatttgcctgcctcagcctcccaaactgctgggattacaggcatgagccaccgcacccggccttaaatatgttttatggtagagaagggaagggaatagtgttaactgacttttctttttaacaaatacctgctgagtgactataagcaaaagcatagtagaaagacagggaggggtatgttccaaaatgagtgggggattaaagcagtattatatgtttggtgcttagaagaggaagagttctttggggaagctggggtgagattcaggactgtcttcgtgaaggttacctttgagctgggctttgaagggtgggtattttgaaggttggatttccattggcagagatggggaagggaattgaggcagaaggaatgtcatgagtgaaaatgtggaggtggggaagctcagtgttagtatagggtgtgtactgaaaatgatgaagagcatagcatggctgaagcagaagatgggataatggatgataagactggaaaataaatgggctcagagcttggaaggttttcgaccatggccaagcagtttgggtttaatgtggtaaagcatgagagattgaaaacttttgattgaagaaataacatgattagggtgtgctttcacaaattttgttactgatttattaactatttttttagtaggtactgtgtgccatataagtgaggcaaagtttgtataatggtgagcctcatagaaaatccccactctgatggaatttgcagtctagaaaaggaacttcagcaagctaatgcagttataaattattgtaaatgtaatgaaggaaaggaataaattattttttatttttttgagatggagtcttgctctgtcacacaggctggagtgcagtggcgcaatctcagctcactgcaagctccgcctcccgggttcacaccattctcctgcctcagcctcccgagtagctgggactacaggcacccaccaccacacctggctaatttttttgtattttttattagagctggggtttcaccctgttagccaggatggtttcgatctcctgacctcgtgatccgcctgtctcggcctcccaaagtgctgggattataggcgtgagccactgcgcctggccagaataaattattaaggaaaataatggggagattaaatttaggtggaggagtcagggaaggcctttctggggcattaaatattaattgggtaccagttatgtgccagatgctattctaaatgctggagacaaaaacagacaaaaatccctactctcatggagcttatattcaggcagcaaacaagataaataaaatatatggtttattggaaagtgataagtttcaaggagaaaaatacgacccgaaaaagggatagatagagaatgttggggtgggagtaggtgttgtgattttagatagaatggccagggaaggcctcactaactcacatcaaaggtaatgcttgagtaaatatctgtagaagatgcaggagagaactagcactctagacaaaagaaatagcaaaaaccatgaggtatgtatgtgcctgccatactcaaggaaccagcaaggaggccagcatgactggagttaagtgaacaagagagaaagtagtagaaatgaggtcagagaggttggtggaagtccaaatgttgtagagcagtggttctcactcttagctgtttgttagaatcacctggggaactttttctactcctggtgcctgggctgcacccataccacttaagtaagaatctctgcaggtgggacttagtggcagaagagatggagagaagtggatggatttgagaagtatgttaaagaaagaattcatttaattatagattgagtgtgggggttgaggaagaggaaagtgtcaagaatgactcccaggtttctggctgaagcaactggatgggtagacgtgtcactgagatgagggtgggagataggaatgggaggagtaggtgtggaatttggagggaagatcagaaatcaggagttcaattttagacatgttaaatttgagatgcgaatgaggctaagtataaatatgttaagtaggcagatatatgagtggagcttgaaatgaaatcagagcttgaggtaatacaattttatatcatccgcttgttgatggtcttgaaagtatctaaataacatcatgtaggacaaacttaatggtgaaagaactggagatatggaaactagcctactctactaatctgaacaagaattggtgctaatttgaatcaggatagtgtcagtggctctagaaaaatataagtaggttggaggtttaaggactgaggagcctgtgtgtaacggaggtggacaataggcaaggaatgaaagataactttgagatataaagcctaggtgaatgatccgtccattagcagatacgaagctgtcggaggagctggtttgggaaaacaggtagtgattggctttggttgtattgatgtttaggagaggctgcctagcaggcaggcagttgggtctattgcactgagttttggaagagtagatgaggttcaaaacgtagatcaagaaatagattttcgtacattgaaaatgaaacactttcatttgcataaaattgattcaccatgggagcagcaacatttatgaaaatagcaacatccccagatttattctgacctgttaggatctctgtgatgtggtccttacctgtttcttttagtgttttcctttgatgaccgtgttcaagctatactgcccttctttctattcttccagcatacccagctaggtcctcctttgggcttttgcactttttattttctcattttaactcttctctccttcttagtagagggataagagggctgagaaaaattcagaagttggtgtctgggaagtggagaaagttgcaagcagatctttgctaaggtgtgggagcatggatgagcacatgaagtagaatggctgtgggagcccttgacgttgacatttggtcaacacaaagacacagagtaccatgttggtctcagtgtatcccagtactcaaatctgttgaccagagatgctacagcagtggtagttcttctccgcttggttgtctgatgatggtggtggtgatggtccacctttgaaatatgacttgactcattgctatctgtcctgccaccgccgatggaaacatcttctgcataggtgagaaactcccttcagtgaaagctatgggtaaattatttcagaaacttgctggcttgaagaaacaacatgaaaacagcagggaagttccttgcagtccactttgacatattgttaggaattacttctcattaggagcacctatgtggctctttattggtggtgttagtagtaaaagggagtaatgcactccacatgaatccttaaaaagagatttaaaaatcaacatggtattttttcagaataaaagtatttgcttttgctgattatgaaataatttgtggaaaaaaatagaaaagtataaagaaaaaagtaaaaaattaccccaaatcccaccatacagagttaactacagttaacgttttctgaacatcttattgggcatttctctaaatgtgtatgtgcatgtagatatttatatctataaaaaattgattgtgtgtttttaaaattgctttaaaaattcagcatattgtagacctcttttatgccagtaaaaaaataacttctcaaagtaactacatagaattctgttttatggattaatcatactttatttggccaatttcccaataatgaatttttttcctccagtttttccttataaattgtgctgtgatggccaggcgaagtggctcatgcctgtaatcccagcactttgggaggctgaggtgggcggatcatgaggtcaggagattgagaccatcctggctaacatggtaacaccctgtctctactaaaaatacaaaaaattagctgggtgtggtgacacgctgctgtagtcccagctactcaggaggctgaggcaggagaatcgcttgaacccggggaggtggaagttgcagtgagccgcgatcacgccactgcactctagcctgggtgacagagcaagactctgtttcaaaaaaaaaaaaaaaaaaaaaggccgggtgcggtggctcatgcttgtaatcccagcactttgggaggccgaggcgagtggatcatagggtcaggagttcaagaccagcctggccaacatggtgaaaccccgtccctattaaaaatacaaaaattagctgggcgtggtggcgggtgcatgtaatcccagctactcgagaggccgaggcaggagaatcgttagaacccaggaggcagaggttgcagtgagccgagatcacgccattgtactccagcctgggtgacagtgcaagactacatctcaagaaagaaaaaatttgctgtgatgaacatcgttgtacataaatctttatacatcaatcatattgattccttaggatttattcctgaagtagaattgctgtacaatattagatttttcctaattattccttaaatattcttgtaattgaaaaaatatgtaaacagcattaaaggacattttgataaaggtaaaaaaatcaactttattcttttttttttttgagacagagtcttgctctgtcgcccaggctggagtgcagtggcgcaatctcggcgcaatctcggctcactgcaagctccgcctcccaggttcaccacattctcctgcctcagcctcccaagtagctgggactacaggcgcccgccaccatgtccagctaattttttgtatttttttttagtagagacgggatttcactgtgttagccaggatggtctcgatctcctgacctcgtgatctgcctgcctcggcctcccaaagtgctgggattacaggcgtgagccactgcgcctggcctaaatcagttttattcgtatagcaactgttttcttctttccatctgataagttgttttttaagtaccaattcctagatctcactagacctataaaagagaattttggaatagggaaaaacatacagagaattaaaattctgggcatcctacgttaattggcagctaatgggttcttagtaacatttgttaactgccaagaaagtgacactaggaatttagagtatactggggcagttaggaaatgcttcagaacaaggtaggacttgacttggacctggaagggtagtattcagataggaggtagaacatttctggctttcggggtggtatgaataaatttgagaaaggcatatggttgtatgtatgagctgacaaacaggctagagtcaactaattggagaggagggtttgtgttgtggtgtagtggagaggtttttatgggagttatgtcccagaggactgattttatttttagtacatctgaagttgtgtagtatgcaagtgtaagataaagcagtatctagatgtggcctaattttaagcaaactggatacattgaagtctctttttacaagaaatactggagaaaggttctttatatgtggattatttaaataatgatcttcccaatacttaaatatttattttactttgtagttctctatagatagactagttgcaacttttgtggatctcagattcttttgtaatatcaaagagttcagacaaggtggtttctgaagttctttctggcacagagattattacataacttttaagaatacctggctgggcacggtggctcacacctgtggtcacagcactttgggaggctgaggcaggtggatcacctaaggtcaggagttcgagaccagcctgaccaacatggagaaaccccgtctctactaaaaatacaaaaaattagccgggcatggtggcgcatgcctgtaatcctagctactcaggaggctgaggcaggagaatcacttgaacccgggaggtggaggttgcggtgagccaagattgcgctattatactccagcctgggcaacaagagcgaaactctgtctcaaaaaaaaatttttttcattcgaaaattattttatggctaagactgagctgttagaatatgctgtgagatcgagagaaattattatatagtagttttaaattatcctcatatacattatccatcaacatttatctcatgctgagttcctattttatcttgaattcactcccatgatgtcttttaatctatgtccaggctacgtaaataattactattatttcagccaagatagaattttggatgtaaatctataggaaaaattacatcatgcattccaaactaaaatgttaagaatttcctttcttttttttttttggagacggagtctcgctctgtcgcccaggttggagtgcagtgacgcgatctcggcccactgcaagctccgcctcccgggttcacgccattctcctgcctcagcctcccgagtagctgggactacaggtgcccgccaccacgccaggctaattttttgtattttcagtcgagacggggtttcaccgtgttagccaggatggtctcgatctcctgacctcgtgatacacccgtcttggcctcccaaagtgctgggattacaggagtaagccactgcgcccggcaagaatttcttttttaatacctgttttggaatatttatatcactttttacatcctttaatatggaaaattgagaactgactagtacttttttaaactcagtaactttctttttaaagtatataaccatgttcagagcttatcaggggtgtatgttaagtatctccttcctagtgttacattcttttcactaaattatacaagttttgaccaaggtaaggcaccataaggtgactgactggcttttctgacaggccctcttaggatgctgttaacttggtggagtcttaaagattcaggatctgttcctcagttttgctagtaaactcagtttcttcattgttaccagagttaattggtcttgggaaaagtagttagcaaaactcactaacagttgacaaaataaaccagaatgccattttattttattttatttatttacttttttgagacagagtctcactctgtcactcaggctagagtgcattgatgcgatctcagcccactgcaacctccgcctcccaggttaaggcgattcttctgcctcagcctcctgagtagctgggactacaggcatgtaccaccacgcccggctaattttttgtattttagtagagacagggttttgccatgttgcccagggtggtctggagctcctgagctcaggcaatccgctggcctcggcctcacaaagtgctactgtctctttaaaaaaaagaaagaaaggaaaaaagaaactaacataatttccaaagtggatgccatgaattaatttaataattacttattcagtatctactacatgccagacattgtaacagttatttaattaaacatttagttggctgtggtggcagcatacctgtagtctcagctcctggggaggtcagggtaggaggatcacttgagtccctgagtttgagaacagcctgggcaacatagatagacactgtcactagtaaaaaacaaacagttttaaaaatgcctgaagaattgttgtctatgtgttttactaacatgtttatcacctctggaattgtgcactgtcctatttaattgggggataatggctgcattaataggtatcctttgtcagtgacaaagacaaagaactaaattcactttcactgtgctaataaccatttctgggtgaaagaggccagattatatgtagaggaatttagttgtacatttaaattcacatcctgatctaagacagaattaggccttcttgggattcataggatttgcaatacaagttgctcacctactctccttgaatagaaaaaactttttttctgtctgtatcttctttcagagctctgcaaggaagcatcaacacttaaatcttgtaaacaaagtaccacatatcatatctattatatacttatatattgtgtatattatatttatattatatatttatattatttttgtatttataaaaggcatttctgactttctctttttttggtctaaatctcactggctcttctactgaaaggttttttttgtacccactcttctgtgactatctctgaccatcctgaatgtatcaaagagggtagatgctcaagtgggagtcacattggaagtacatattgatatattttggagggcaatttgacaatatcaaaataaacagcatgcaggctattgggcctacttgtgcttatgtttagatatacttgtttgctacattgtttgcagtagcaaaaacatggaaaccattcggcagggtaacagtggaattctctgcaaccattagaaagaataaagtgtgtctacagggaaaatattatttgtattttatatatatatatgctggtagatgcctgttgtgttcattttttgtttgtttgtttgttttgaggatataaaaaatccctctctaaaggctttagagagggatttgaaatctagaaggaaacttacttttcaattgtagcttcctgtaacttttgaattacttaggttatgtatatatattgcttttctttaaaataaaatgcatatatgaagaaaagtagatacaattttaacagtgtttccaaaggggcatagaactttagcactgaagggaccttagagattcttacacagtcaccctcaattaaagatgagggggaaaaaaaatgaggaaattcagattcaggaaagtatcttcaagcctgcactagaattcaggccctgaggatagcaatagcttatgaatatattgacttgttcttattctaacagtttatttaactgacgtccatttctcattgtgaaggattgatttttggaagacccaataaaatgctgacctttgtaagacagttcttaaagcaactacctctggcaataatgataaagtggtagttttaactcttccccatgttttgtaactttgaggggcccaatcccttagaaatatatttataagttccttaagtattatttgaagcgaatttgggtctagagtccaaagtttcccttcctgatttgaattcctagctgactattctagatgtttaaaattggttttactgtgtttttgttccatttggtatgcagggatgaaagggtcagggtatagttttggtgacttctaaatggcttgctatttaaaggaagaatttactgtaagagatggtaggaaattgtctagaggaggaaattttatgtactgaagagaaactcttaagttcttgaacatatgagttactcttttaagttgagtcttttcctggctcttcaaggccagaaacactttctccttattcaaaccacacaaagacattggtaatggtgagattggcagttcagcatgggactggacattcaaactacattcaatgaatattttttatggttgattgacttcagttaggcacaagcaatagaaacacatttactaatgttaagattagttgttagctttaagattaaaatctgtctctctggtgactctactacaggttgaacatcccttatccaaaatgcttgggactagaagtgtttcagattttttatttttttctgattttgaaatatttacacccctaatccaaatactcagaatccaaaatgctctaatgaacatttcctttgagcatcatacccgtgcttaaaaagttttggattttggagcatttcagattttcaggttagggatgatccacctgtagtagtattggtggggaaaacttattcttccaattttttttttttttgagaatgtcactctgtcacccaggctggagtgcaatggcacgatttcggctcattgcaaccttcgcctcctgggttcaggcaattttcatgcctcagcctccctagtagctgggattacaggcgcccgccaccacgcctggctaatttttgtatttttagtggagacagggtttcaccatgttggccaggctggtctggaactcctgacctcaagtgatctgcctgccttggcctcccaaagtgttgggattacaggcatgagccatcgtgttgggcctattcttccaaaatttaatgatccataggcctatcacaaaatgggtactctaaatatttggtaataatttgattaagatgataggatgaatctttgctttgaaagaggaaataaaggaagccttttattccggaaataaagacacctttcacatcttaagaatcagagtcaaattatgtctgtgctgttttaatcagtaaagatttggttgaattgaaaataaaaggttacaggagccaagaacaaatagagttgcaaatttatctttgtaactccatatccttaggaggaatccagtttgtatagccactttaattttgttgtgaatatagactgagcagtggaattgagtagcttgacagttgacttaatttgaacagtcacattagataagactggaaagctaggttgagggaagtcaattttgtgtgtgttttctggttttgtttctagtatcgtttctgataatgaggagaatttggtggcccatttggaccctacttaatggtaactatagtgcctcaccaatatctttcttgtgctattccaatttatcaatcattattggacccaatatcctgaattacagtctgattatttttcaccaatcttttatctttcatttacccacactgaaattcttgagcccaacatctctttttttcctcacataactgtggggagatagtatgatagctaggtactgttctaaactccgctgctggcttcctgtgtgtattattaacacattgggcaagccactaagctgctttggggttcagttccttgatctgtaaaatgaaataatttgactggatattattaagtccttttatatctccagagctattttattcctttattcaccagacttttcttgtgaagcaccttctctgtgctaggcacaatacaggatgttctgggtacaaacttcttgcccacaaagagtatttagaacttccatcactttattcaaatcagcttagtcttttactctggaaaaatttagtattagcaagttttgtcaatttttactatcactgtataaggtatttgttaaaattgctggtattacttagatcttcatctccaaaaatactcatatctctactttttgtttttctacttatttatttattattgttattattatttttgaaacggagtcttgctctgttgcccaggctggagtgcagtggcacgagcttggctcactgtaacctccacctcccggtttcaagggattctcctgcctcagcctcccgagtagctgggactataggcgtgcaccatcatgcccggctaatttttgtatttttagtagagacagggtttcaccatgttggctaggctggtctcaaactcctgacctcaagtgatctgcccgcctcagcctcccaaagtgctgggattacaggcataagccactgcacccagcctgtttttctatttataagccaatttctcatcctggaaaacaaatctcatctccccggtcccactatgagtagttgttgttttctaaattgatagaaagtaaactatgggctgggtgcggtagctcacacctgtaatccaagcactttgggaggccaaggcgggcgaatcacctgaggttgggagttcaagaccagtctgaccaagatggagaaactctgtctctactaaaaatacaaaattagccgggcatggtggcgcatgcctgtaatcccagctactggggaggctgaggcaggagaatcgcttgaacctgggaggtggaggttgaggtgagccgagatcgtgccattgtactccagcctgagcaacaagaagcgaaactccgtctcaataaataaataaatgaaagtaaactatgtactataaagtaagaaactagtggtttctttttctttttttcttttttttgagatggagtctctctctgtcgcccaggctggagtgcagtggctcaatgtcggctcactgcaagctcctcctcccgggttcacgctattctcctgcctcagcctcccgagcagctgggactacaggcgcctgccaccatgcccggctaattttttgtatttttagtagagacggggtttcactgtgtgagtcaggatggtctcgatctgacctcttgatctgcccgcctcggcctcccaaagtgctgggattacaggcgtgagccaccgcgcccggcctcttctttttttctgagaccgagttccactcttgttgcccaggctggagtggaatggcacaatcttagctcactgcaacctccccctcccggtttaagcaattctcctgcctcagcctccctagtagctgggattacaggcatgcgccgccacgcccagctaatttttgtgtttttagtagagacggggtttcaccatggcggccaggctggtctcaaactcctgacctcaggtggtccgctctccttggttcccaaagtgctgggattacaggcgtgagccacagctcccggcccatagtttactttctatcaattaaagagaacaaaaactagtcataatgggacaccaccgcttctggctgatttctttaaggcaaataaaaaatacagaatctagaggtgtgatgtaatttttaaaaagagagacctaaacaacattataggaaaattttctaagattaagtatggctttgtttaaaaattttacacccaggctgggcgcggtggctcacgcctgtaatcccagcactttgggaggccaaggctggcggatcatggggtcaggagatcaagaccatcctggctaacatggtgaaaccccgtctctactaaaaatacaaaagattggccgggcgtggtggcgggcgcctgtagtcccagctactcgggaggctgaggcaggagaatggcatgaacccgggaggcggagcttgcagtgagtcgagatccgccactgcactccagtctgggcaacacagtgagactccgtctcaaaaaagaaaaaaaatttacatccaaagtaaaaagagtttagtaggtactctgttgggcactgaaaagaaaaagaccagggagctgcttctgacgtagaaatgggcattctttgaggagagcccccattgtctaggttctgagtctcagcccggcaggaccacatgtgattattctaagtgcacccacagtgtagaggattaagtcacatgaaacattcatagcaggtgtaggagtagagctactacttttggctatggtcagagaagacctaagtaacaagaagcaatgtgaatatctggaagaagcgtcttccagcctgagggaagaatgcaaaggccctaagatggaaacaatcttggcttgtttgtagaaagaaaacccagtgttttggagtaaagttagtgataagggagagtggtaggtgatgaatttggtataatgggccagctcttataggactctgtaggttcagataaagagctggaattctaagtgtggttaagtgaaggagcaatatctggatttacattttaaaagctcactgtggctgctatgtgaagaatacataaattgggctacagaggaagctgggagatcaattagaaaccagtaactattcaggtgagaaaactctggcttggacaaaaatggataaatatggaatacattgagaagcaggacagctgacaggacttcctgataaagaggataggaaaagatagggtttttagcttaagcaattgagttgaagaggtgccagttagtatggacacctgaaatgaatataattaaagaatggtaaaaattgtgcttttctgtaagcttgtggcaaaggagaggaaggtaactgtggagaaagacactggtttcttgaaaacttagactagaaaaattactctggcagttagaacaatagatattttatttgaaaaaattaatgatgattaggtgctaaagcatgaaaagtcattctaaaataattacaacataggagggccaggcgcagtggctcacacctataatcctagcactttgggaggccaaggtgggcaaatcacttgaggtcaggagtttgagaccagcctggccaacactgtgaaaccccgtctctgctaaaaatacagaaattatctgggcatggtggcacacccctgtaatcccagctactcgggaggctgaggcaggagaatcgcttgaacctgggaggtggaggttgcagtgagccgagattgcgctactgcattctagactgggtgacagagcaagactctgtctccatctcaagaaataaaaaaatttaaaaaaaataaaaataattacaacataggattcgttcccaggatccagtcatggaagtagacacgaacccattaatgatttgctgaggtctccattaataatggtgctccaaattcattagaacaaaagaacttttttttttttttttttttttttttttttaagacggcgtctcactcactctgtagcccaagctggagtgcagtggcgtgatctcggctgtctgcaacctctctgcctcctgggctgaagcgattctccagcctcagcctcccgctcagccttccgattagctgggactacaggcatgcaccaccacacctggctaattttttttttgtattttttaatagagacagggttctaccatgttggccaggatggtctgcaactgctgagctcaggcgatgtgcctgccttggcctcccaaagtgctggaattacaggcatgagtcaccttgcccggccaaaagaacatactttcatactgagttgccacttgaaaatgaaattggaactgaaagctagagaatataagtatctttctcaggtattttttccatttctacatgttgaataaaagaccatacctgatctaagagtcaccccaaaggaattgcaaagtgttggtttaggagttaaaagactttgtgttctaaactcaagcccattaatagccatgtgaccacagcaaattggaactctgagcttctgttcccttatttgtaaaatacttgcttgctctgtgtgcctcacagagctgttgaaaatcccaaataagatcataaatgtcagagtactttgaagactgtgaaacattgaatactgcttatgagggagtggttatatagcttaaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacaggtaagtttgattttgctctcttatttggcaattagagctttattcctagccataatacagaaaggaaaggcagcaaaatatggttagtactttttatgtgttttttcccctttatttgacctttgggctgtggagtgggagcatcttttcctttaagaagtgaaaaatataaatatgccagaggcttgctagcagttgaaagcaactgttggtcagtgagataatggaaggaaaaaaaaacaacaacaggttggagatgggaaacgtcaaggaagaaggaggaaaaacatgtttgaaagaaggggaaaaaaagcttaagtgaattcaagaaggcaaaaaagccttaagtgttctttttataatctgtctttgagtttcaggtactaaaatttgagatgattaaaagagagattggttcttagaggaataaataaaattaaggcaaagtataaggatttatggtctttatgaagatatgtcagattactgtggacattatttttatttaagatgtgctttctggctgggcgcggtgactcatgcctgtaatcccagcactttgggaggccgaggtgggcagatcacaaggtcaggagttcgagacccgcctcaccaacatgccccatctctactaaaaacaaaaaaaaaattagttgggtgtggtggcacgtgcctgtaatcccagctacttaggaggctgaggcaggagaattgcttgaatctgggaggcagaggttgcagtgagcagagatcgaatcactgtactccagcctgggtgacagaaggagaccccgtctcaaaaaaaaaaagaaggaaagaaagaagatgtgctttcttattgacatttatgaagtcagtccctatactttctctgcttaaggaaccccagtgctgtataatttccatcagctataggaaaaatatttaccaacacaggattttccttagtgagatgatctggactgaattcataggctctttttggtttgatttaggctgcattagtatctatttaaaatattgctttgagctatttagctttttttcctatatcacaagtcattaagcaatctttagcttttctaatttaccatttttcctgaattcatcgatttgaaaagcttaaaaaaagaaaaagccaaacaaaaagagactgtgacactgtcagctaaagttttatttatttatactttcagttctgtttccatccttcactaccagagacaacctattgccatgaatttagtgtgtatcattccagtgcaatatagatgtgtatgtatgtatgtgtgtatgtatgaaaatgtattgctttacgtgtttaatttttagacaataaattatatacatatgtgtgagtatatatgtgcatatgtatatatatttatatgtatataagttctgcagcagtcttattttcattctttttttccaaaatctgtacatgttggtagattcagatctaggtcttccattttagctgttttgtttttattatacagtatgaatatttcacagtttttccacaatccctttgatggatatttaaattgttttcctttttaccccccattacattacagacaactagtgaacaaccttgtacatatcttttctggtctttgtcctcatcatcatcatcttcttcttccttctcctcttcttttgtttcagtggtttgattttgtcctaaactacctcattatttgagttctcccactgggtccaacactttggtatttatagtcattatttgagggagggagagggatgaggaaaaccttctatactttgaaatgatactcttcttttatcagagaatgagaggctctgaaattttctttccttatggattctttttggaatctgataaatttggcaacttcgcattttattttaatttagttaattttttagagacagggtctcactatgttgcctaggctggtcttgaactcctgagctcatgtgatcctcctgccttggcctcccaaagtgttgggattacaggtgtgagccacagcacctggccagctttgtattttaatattttgcatttctgttgtctcatgttattaactgttttttaataaatttcagttactgctcaccttttattctccttgtaagctttcttttactactttttaactcctagaatactttcttttttttttttttttccttgagacgggtctcactctgtcgctcaggctggagtgcagtggcacgatctcagctcactacaacctctgcctcctgggttcaagcgattctccttcctcagcctcccaagtagctgggattacaggcacctgccattatgcctggctaatttttgtgtttttgtagagatgcggtttcaccatattggccaggctagtcttgaactcctgaccccaagtgatccgcccgcctgggcctcccaaagtgctgggattacaggtgtgagccaccacacccggccttcttctagaatattttctccctactgtgtgggactatttagtgatctccaatccagttcatgttcttcttatattactttataagttcagtgtgatccagacatagttgatatttatagaagggtttcttgaagcattcttagccaaaggtagcatttaaaaaatatgtcttcacctcgatatttgattagaattattacatttaaattttgttcaaggaccatatgtttcaattgccagtggttttcatttataaattttttctggagtctttaatccactgtgccttattcattattgtgaggttgagtatatttttaatttttatgctccatgttttttcaccctttaaacctggctcctattcagagctttgagcacttggaatcctgaagtgttacaaatgaaaactgttactcttctctaataacacactctgcctgctgcaagcgtttgagtaggacttcctttcttaacaactagtttgggcagccacctgtctcatgaatatatcaactatctttaagaatttgagaatttatgtgctgaattttttttaagacaaccaataagaccttcaaatagaaatcagagtaataaatagaactagtatatcagatgcctgtgtattttatctcagatctgttcttgtcttagggtttggttcaggtaataagtattgtggttggaaagtaacctttggatctaggcttacgccaactttaacatagatgacgtattccatcaaaagtacaagcactatatgtatactcggaagtatctgtcatgtcacccaataggcaatttcattcagtgaattatcttccctatgccatcatagtcaccaagtttgattggaattgtttacctgctctttgtcacatcagtcccacattttatgctacagagaaatgttcctatcttaaatctttctttagaagaaaatgatgctcttatatggaacactaacactgtagggttcgttttcccttccactctggaaactgctataaaactttttttagttcctaagtaaaaaaccattatttttctaactgtagttaccctcttgagatatttcatctggatatgtaacagaagcctttattgcttttgttggagtcaaaatacaatataaagaactttctctttttttgagacagagtctcactctgtcacccaggctggagtgcagtggcatgatctcggctcactgcaacctctgcgcatgccagcatgctcagctaatttttgtattttttggtagagatgggtttttaccatgttggccaggctggtctcaaactcctgacctcaagtgatctgcctgccttggcctcccaaggtgctgaagaacttttttattgaaattatatatttttttgcatgattctttcttttaaaaaccttttttttctgactataaaagtaaaatgtgctcactttttacaaacttaaatagtatatatagtaagtactcaatctttatcctacatattgtcaagtagttcccataatagttatgctgatttgcaccgcaccagcagtacatgagagttcttgtctctttgtgccctcaatggcattgttattaaaaacaggtattacacttttttttttttgaggcggagtctcactctgtcacccaggctggagtgcagtggcgtcatcttggctcactgcaacctctgcctcccaggttcaagcgattctcctgcctcagcttcttgactagtagctgggagtacaggtgccaactaccacacccggctaatttttgtattttttggtagagacagggtttcaccattttggccaggctggtctcaaactcctgacctcaggtgatccacccacctcggcctcccaaagcgctgggattttaggcgtgagccaccgtgcctggccactattacacatttgttaagggaaaatatgtttgtatcaactttttagaagtcttaactctgactcattaatattaataagtgcataaacctgaaacttgttagtaaaataaactttgttaatttgacatacaaggggagaaacattctgggttttttttttttctttttttttgtgctatagagttactgtctaatctttcaagcacgggaatctaaaagaaaacattaattcagtcatttattaaataagtatttgtagccttccatgtgccagacactgtctgggtgcagcagcaaaacagacaagaacctgtcttggtagagtttattttccagttagagaagacagattgtaaaaagatacaggatggtagatgactttatgcgctatagaaaaaaaaatgatgaagcaggaataggattgtggttgttaacggagggaattgcttttttttttttttttttttttttttggagacagagtcttgctctgtcatccaggctggagtgcagtaatgcaatctctgctcactgcaacctccacctcccaggttcaagcgattctcctgcctcagcctcctgagtagctgggactacaggtgtgtgccaccacgcccagctgatttttgtgtttttagtagagacggggtttcaccatattggccaggctggtcttgaactcctgacctcaagtgatccacccgcctcggcatatcaaagtgctggtattacaggcgtgagccaccacgctcagccaggaattcatttttaagggtatcagggaagacctcacagagatggtgacaaggaaagtcttagcaatggtgaaggagtgtgccctgagaacatctaggggaagacttattcagacagaaaatgacacgtacaatgctccaaggcaggaatgggcctattctgaggaatcacaacaaagaacggcagtgtagctggtacatagtgagatcaggaaaacgtagttggaaatgaggccagagaggtaatcaagtccagattgtgcaggacccttttggccattgtaaggctttcactcagagggagttgggattttactggaggttccatcagaggccatgattaaactagtaaaaccaaaaaatacttgtgtcttggctttgctttttcagaagattttgtctcaaaataatttggggattaactcatggttcctggtggtagtcatatgtagatttaaacctttatattagtacagaaaatttccctgaaatatagatcttaggtatggcatttaaattcaaagaacgtaatagaaaatcctgcctataggtatttattcctgggtggccctgctttattactgacttctcatcctaaattgtctttttttttaaaaaaactgtattatttgcaagatgtactcacacttatatattattggaggctagatagacatctactctattaggttattttaataatgtatgctttgaactttttttttttttgagacggggtctcactctgtcatccaggctggagtgcaatggcaccatcttggctcactgcaacctctgcctcctgggttcaagtgatcctcccacctcagccttccaagtagctgggattacaggtgtgcgccaccacatctggctaattttttttgtatttttagtagagatggtgtttcaccatgttggccaggctggtcttgaactcctgatctcaagtgatcctccctcctcagcctcccaaagtgttcgaattacaggcgtgagccaccatgcctggcttgaacatttttattatgaaatataacagaaaaatacacaaagcatgactgtataatgtaaggattaattacagaaggcaaatacctaggtaaccaccagttagacctagaaatatatcattgccagcacctggaagaagcctgctgcgtctcccttctagatcataacgtataccattgctcagaataaccactcttctgacatgtgtgataatcatatccttatttttctttatgattttaccacctaggattcattctaaaccaatataatttagttttgtctgtttttaaactttgtataaattggaataatacattatgtgatttttacatttttatgtcttctttcaggaagaacctaacaatatatatgttcataactttcatccatgttactatatagaactgtagtttgatttcattgccatatagcattctgttatatgaatataccacaatttatgtattcattctgttgatgaacactttgattgtttctagtttttggctgttaatgaacaatgctgctgtgaacatgtacagaagtttctctaggccatatacttggagtggaattgcagaatctttagtcttattagataataataaactattttccaaactggtggtaccagtttgttctcctaccaacagtatgatagtctccctgttcagcccttaccagttttgtcagatgctttaaattttgagaaacccaaaccttaagcttaaaaaaaaaagtggagagtaagggactaaaggtattggtttctgctttaagaatcacagctatttattttcatttgttagagttggttgatatcttctgccttaaaggcattctatctttctatcctcagagggttgggaaccttgtctgtctcttttaccactgtgtctcaaagaatgccctgcagttggtactcagtaaatatttgttgcatgaattcagcctgactcctgctattattaactgaactacgtgggattgttggctcagtctctgctcactacaactgccacctcccaggttcaagcgattctccagtctcagcctcccaagtagctgggattataaacgcccgtcaccacgcctggctaacttttgttatttttagtagagacagggttttaccacattggccaggctagtctcgaactcctgacctcaggtgaatttattttatggtatctgattaagactgccctgttttagcatcagtcatttagcacagtttttggtgatggctcatttgatcactgatagtaactggacttggtttaccaaaacctattatagtctaagagaagcttatttgtaccatgtactagttaaagttggtgcttacattttcaggaagagattctattttttttttttgagacggagtctcactctgtcaccaggttggagtgcagtggtgcgatctctgttcacggcaaccactgtggggttcaagtgattttcctgcctcagcctccccagtagctgggactacaggcgtgcaccaccatgcccagttaatttttgtatttttagtagagacggggtttcaccatgttggtcaggctggtctcaatctcctgacctcgtgatccgcctgcctcggcctcccacaagtgctgggattacaggtgtgagccactgtgcccagccgagattctatttttaaggaatcatttacccatgatttatgcaatactttattttctcacaaaagggaatatagcagtggaattttctgcctatgttagactcctagaagcattgctacttctcttatcccagtttctgttttgagctactttgtaggatatggtagattatcagaggttggtgttgcttggctatctctccagtcttcaacaggaacctctttctctcccttgtataatcactattaatccagtccattctgcatctcattgtcacagttatttattaaaaccatagggccaggcatggtggcgtgtgcctgcatagtgccagctactcaggaggctgagatagtgcactatgatcagtcctgtgagtagccactgtactccagctggggcagcatagtgagaccctgtctctaaacagaaaaccataggatacatggctttgtttaaatgcatcttgctttggtgtaatttacccatagagcacttttttaaaaggtgttttacataaaaacttataataattctttaagcattttgtgaaagagctggcaacagtgatctctcttttcttgtaaatattgacacaggacaagtcacctcatttttgctgcactcataggtcagtttattagaagaactagcttggggctgggcgcagtggctcacgcctataatcccagcactttgggaggtcgaggtgggcagatcacttgaggtcaggagtttgagaccagtctggccaacatgacaaaatcccgtctctattaaaaatacaaaaattagccaggcgtggtggcaggcacctgtaatcccacctacttgggaggctgaggcaggagaattgcttgaacgtgggaggtggaggttgcagtgggctgagatcgctccactgcactccagcctggctaacagagctgagatttcatctcaaaaaaaaggagaaccagcttggatttttctgacttccatttctaagtataatatttttttgagagatgactaagaaatagagcattcagagctagtgagataaaggaatggtaatttttttgtttgttttttttgagagagtatcactctgtcacccagactggagtgcggtggcatgattttgaggtcaccggaatctctgccctgccctgcgtgtccctcctccaccgggttcaagcaattcttgtgcctcagcctcctaagtaactgggactacagtcgtgcaccaccatgcctggctaattttttgtatttttggttgaggcaggatttcaccatgatgccaggctggtcttgaacttctggcctcaagtgatccacccaccttggcctaagaatggtaattttgactagtaaatttttactagtcatttcttctttcatatatcacctgcttttgtgagatttttcctttttaggaatagacaaagtaagtaaagacttgtatgagattcagaatctagttaagtctgattcatattctctatttccaacagagatttcctgttagacaagacaaattagagttttcctactgacttaacttggtgagtttttacatagttttattttaaatatagtttaatcatgagggaaaaagcagaatgaaatgcataaaaacatttaccatgacttttaaaaatacacctcttgagtacaatctactgtttcattttagtgcaaatgataggtaaagttaaaaagttaaagtcatataaggtaagcgtgtaagattttcttttaaaataagaattattacagtgttaaataaacattttctataagtgtcttcaaaaaaagttttattctaaatattcttacctggagtaagccagaactatttattctgatcttctctggtgatttctagatataggataagactttacagtaatggtggaggggagaaatgatatttgaatttaaatttttaatcaatggttgataatatatgatacggaaaccttagagtcagattatttttcttcctagaaaagttcttcaggaaggtcgggcatggtgactcatgcctgtaatcccagcactttgggaggctgaggcaggaagattgcttgagctcaggagttcgagaccatcctggtcaacatggtaaaaacccatctctataaaaaatacaaaaattagacaggtgtggtggcacatgcctgcagttccaactactcaagagactgaggtggcggataatttgagctcaggaggtctaggctgcagtgagccataattgtgccactgcattccagcctgggtgacagagcaagaccttgtctaaaacaaaaacaaaaacaaacagaaaaaacataaaagaccttcagggaaattagaattacagtttatgaaaaagagatacttgggaccaggtgcggtggctcacacctataatcccagcactttgagaggccgaggcaggtggatcacttgaggccaggagtttgagaccagcctggccaacatggagaaaccccatctctactaaaaatacaaaaattagccaggcatggtggcacgtgcctgaatcccagctactcgggaggctgaggtgggagaattgcttgaacccaggaggcagaagttgcagtgagctgaaatcgcaccactgtactccagcctgggcaacagaacaagactccgtctcaaaaaaaaaaaaaaaaaaaagagagataccttaaagaaatttgtaggcttcattttactttataaaaggagtttgattttgaacaaattgcctttgtgtattttaccttggagctcatatctctctgggtaacttacagaaaaaaaactctccaccattttgtgtaacatctgaaaacttgttactttgtagtatgaaatttttagcttccaaagcttgtgtatgttttgtcagagtcatgttgggttaaataggtgttattgcattttaatcttttaaattctgacacaaatcatcaggagccaggaaattctgttaagacagacattctgtctaaccttccctattttgtctgcctgtgtggttttactttttccttgagtcatgaattttggaatgaacatttaaaactgagaaattcctgcccatcctttgttccatttcgtttacttagaactgtaacattaacatagaattttgcttatttttaataatgttagaagagggaatttattttctgcagattgtttctaggtaaggcacgtggtccatgtaaatagtagttaggcttttttagttaagactgtaaaggagaagattaaaaacatacatatacctcccttctcttttaaagttggaaggaggtctaggtgcctttcaggaagaaaagtatctcatgggaatactgaattctttactgctggatagtaatagttaatgctgaacataatcagttgcccttgtaggagaccaaatcccctggagcaggtgggccttttcagtttccaagttaatgaacttatttcaaattgtatgccctaagactaattagactttctcctttgaaattcattccttgggtcccttccatagccgaatcatgttagcaagaaatatttttaaatggcttggctgaagtatagatggccaaagagaactgcctgttgaatttggcttctataaaagccaggggactctgtggggttatataagctctatttgtttcatgaaatgactcttctgtttttgaattccttgcagattggacatgcttaaatagtattagggccagccttttcatctgtttactgtttagattttataaggttcttcatagtcatcattgaggggagtgggtcaaagaccataacctctcaaattggaaaacagctgtgagaatattaacttatgtaataaatggaatcttcttaccatagggcttttccctgcttcctccttttctgatcctttttcagctcttctttagaataagtaaattttctcagcctagaggaggcatcttttataacatgtgggacgtgttaaaatcttcatctttcccaagttcactctttgtggccctagagatttgtgcccaagccatttagtggaatcaacacatgattctaatttgtgagaatggagaagttgttgattgcttgcgtttgcctttctgacttcatttctaaagatgttctcttttggaactgagacccactctgaagtgaaatagcccctttgtaatcaggtttgtttcctgattcggattcctgtccttccatttcaggtatttcccagtgtggaaaagtctaatctgaggaactctattttctctttttctgttttttttttttttaagcagctggaggagtttttcttcctagcaggggttctgtaattaacaacagcagcatgtcacctgatggtattaacccagatcttgtgaaacctgtgcttgttgcggccattattctgctggatcctccatccaaatggagacagaggaattttttcctctgatgttgttatgtggatgtgtttagctcagtaatcctttgtgcctaaattaaaagtaaaacaaaaattcaagaagtctttttaaggtccagggagttgcagtcctacaaggtgtttgagtggcatctgcccctttctaggacaaacttcggcatttggagcagagatacattgcattcttcctggacatatttttggggtaaataattttgctaacatgtttatatcaataactgttacatagtggatagtttctagggcaagggaatgatccccctgccctaacttaacttggcattacattttctgcttttttgattttttttgctgactggaaaagttgcatccaaagtgagaattattccatattttaacctttgagctggctgctaaggtctccttggggacaaggacagtttgtagttatttatagcctgaaagaagagcagtaagcctgtaaactgccagcacacaccgaggcttgatagtcggagcattctgttgttatcctattgggtttagtgacttgagagtcatgtaccttcttgttcatcttcagcttgccttgatctatctagatgagccttactagctaggcatttctataaaattataacacagattgaggagaggaaggagaaataggctttttatgtacaagtgcatatctaatcctcacaatcattttagaatctatacttacctaagaaatacctgtaaactgggaaaatcttaaaagtactgacttgaacacataatactatgcttgtttctaggttttccttatatacaacagttacaaagtagttcagctcttaattagagaaatatttggctatgccagaaatgtgttctacatcttagcctggtatagaaaaaatttagttatatgcctagtcatgtttttacatatgtacatatttacactggtctgtatttaataaatgttagttatcttttctccatacatccagaatccaacccagtgtcagatacaaaaacaatagatcaaatataagtagatgctaaggatttccctcacttaatatattggaattttattataatatatagtatttaacttgaggcaaggcgtagtggctcacgcctgtaatttgggaggccaaggtgggtgaggagttcgagaccagcctgaccaacacagtgaaaccccgtctctactaaaaatacaaaaattacctgggcatgttggtgggcgcctgtaatcccagctacttgggaggctaaggcgggagaattgcttgaacccgggaggtggaggttgcagtgagccgagaccatgccattgcactccagcctgggcaacaagaatgaaactctgtctggaaaaaaaaaaaaagaagaatttaacttgaaataacttaagagtttagcttgggttcctgacagctgctgtaatggtacttctataaccaggattgacttattctgggaaatgtacttttctcactattgtcttgtggattcaggaactccccccatagctctgtacgtttcccttttcttccgttttcttggatttgaaaagatttttaatcagggaagggtataaatagttttgtaatgtactcaataaattcttaaagttggagtgacttgatagttttctttttaaaatgttttattgttttaaaagtatgcctggattcctatagctacattcattcaacaactcctaaactttaatttattaactagaactcattagggaaaaatgatcccaaaagagaaggagtctaattgctcaaccaaaatttcattgaacaaatatttactgagtgcctgttatgccattctaggcacagggggatactattctcgttgagcttaacttctagtagggaacacaatagacaagtgaaaaaataaaaacaagataatttcaggtagtggtaataaagaagaaaataaaatagggtaatgtgatgagaggaataggctagaagtggaagtggcttcagattgggtggtcagggaagactcctctgaagataacttcatttgctaggagacctaaatgacaagaaggacccacctataaaaagacctgagggaagaaagagctttctaggctgaggaaagagcccaatgtgtttgtggattagagttaaagccctgagtgactaaaacatcaggattgagaagattgttagagaaggtcagggaggtatgctgaggccatggtggtcatgatgaaaaggttgattttactcagatagcaatggaggccactgaagaattcctttcttgtctctcatgtgggtctcgatgtataagcctcttcacaacttggaaaaattaattgtaaaggctgctaattcctttttaaattttttaatttactatttgaataggtaatatatttacatggttcaaaattcagaaagtattaagaggaatacagtgggacttcttcccactcaggtgtacccagtttcctcccatgggagtaaccagcatccctagagccttgtgtcttttgggagatattctatatgttaaaacaaatgtatattttctattaaaaaatggagcttccttattttttaagagatgcatattattacattatctgtatcatagtttatttaatccactgttgatgaacttttaggttatttccattttcacgtgttttataaatagtccccacagtgaaaaaccttttatatttgtcctttaaaacatatcagtagggatacatttctagaagtgaaattgctggattaaaggggatgcacattttttactttgatagacattgcccttcacagagattgtaacaatttatacaccaaccagaaatgttttctttaccctgggtaagtgttatcaaacattttgatctttgccaattcagtgggtgaatcaatgtgtgatttaatttgcatttttatcttgaatgagagttgaacatcttttcatatatttaagaaccattgggtatttccatttctgtacaccgttggttgttctttgcccatttttctgtaaggctgtggacttttttcttgatctctagattcacttggtatcggtaatccccctataggtgcagtgtaagaatttaaaaaatgaaaacaggctgggcacagtggttcatgcctatattcccagtgctttgagaagccaaggcaggaggattgcctggggccaagagcttgagaccagcctaggcaacatagcaagactctgtctatacaaattttttttaaaaaaaatttaaaagaagaaaacaaaaaaacaggcatctttaatttgtaaagttttacaaagcatgaacccgataaaagacataagagaacctcagtctttcctttgctgattgaggtctgtctgaagccctgagtttcattttaagcagtgtctctaaaaattttttaagtatatttagtattttgttggactagattgaactgcagaaagtttactcataacaaatattcaaaagtcatttaaaccttgcaacagtagaagtcagtatgacctgtaataactacccttggggtaatgagaaagaaaagattacctcctgggctgtgtatgattgagcacactgtaacagaaaaaacaaaaggctccttttggtcacattagtttctcaaaaattagtatacaaaagtcttacagtttttttgtttgtttgtttttgcaattgtcgtcaatctttttggcatcttctgttttggaaaacgcaaacatctcgggttgaaaatagttatgacactggggcttttctttacttggaaactgtacaaagctttaaaccagaagaaagcagagagagaggcttttaaaaagtccctaacagaccattctctggtctgttcccagccatctagcttgtacatgctgtgtattatgttgaaccacatgaaattgctgatattcaactatttttgtcatataaaacaacagtttcatgattcaatctaatatcttcacaatcttgttcctgtcatcttaaaactgatggatataagtaaggctaattcatagatatcatgtatgagattcatgcctctctctctgttaactggttgatttaattctctggataagtagattagactgatgatggagaaatgctcatgggaaataagtgaaagatttaaaaagtgactgcacaagctgtctgtgtaacacttttcagagggtgttctagcctagttctgtaaatactgcaaaataaactattgggacattttcctttattgtacagggaatttgtcttctatcttgaaagaattctgattatgcaagagtttagttcagataagttactgatttttgttttcaaaatgaaattataacaaggctttctcctcttgtagaataaatatatacttgatactggatgaaaaactcagttttaccaggactgggattagaggtaccgggctgggagttttgggctttgtaatataatttatctgaaataacaaattaattattctcattacattgcaaatctgatatactcagcattgttcaaagggctgttttagagatatgtgaaaaaaaaccagaaaacttaatgaacttgaatgcaactggatgagtgtttcagtcatcagagtattttttatttttttttttgagatagagtcttgctgtgttgcaggctggagtgcagtggcaccaactcggctctctgcaacctctgcctcccaggttcaagcgattctcctgcctcagcctcttgagtagctgggattataggcacgtgccaccacgcacggctaatttttgtgtttttagtagagacggggtttcgctatgttggtcaggctggtcttgaattcctgacctcatgatccgcccacctcgggctcccaaagtactgggattacaggtgtgagccaccacgcctggccttcatcagagtatttgtactgaattccttgagttccaggcaggctgtgctaggtgataagggatatatagaatagttgcaggttctgtttaaggagcttgaagtctacaggagtcagcagaagtgttcataagtataaaagaaggcaggaaagaagtgcaccgtaggttcagttgaaagcattatctgtgcatcacgacagcattacaggttgaatatccacttatcggaaatgcttgggaccagagtgttttggatttcagatttttccagattttttggaatagttttgttacgtacttactgtttcaacattcctaatctgaaatccaaagtgttccaacgagcatgtcatgtcagtgctcaaaaacttttggattttggaacttttcagagcagggatactcaacctgtaattcattttttttttttgtccttctgtctgtcctccaaagtttaatattctagttagaaattatattgttggcttgaatcacatcaaaactggttaatgacttcatggtcttataatacccactaggaagcattccattagagatttttattagttgctagctgatactaccttcgttggaaattaagcagtattacagttgacagagatattttaaagtgcatttttttatgtaactcgaagaggtctgttctcacaggtcagaatttaatagagtaagcaggaaaataaatggtggtatatgttcagcctcagagtttgagcgtactagaaagtttggtaagctttggaaaataaatttctcaatagagaatgcagacagactgtcttaacttgtttgaaggcaagagcaatatattttggctttagctgtctgctgcagaggttctcgaactctaaccctcaggtaggtctcctcttttctaaaatttttttctgctggtcatctgcagcagttggcatgaagtgctagagagttcatgtagcactaggctactttgctgatgaacactttgcccatggttcctgctatgagtgaaattaattagacttgtgctgtcctagtcaatttcctttccagcaggttgtttggttaagagctcctcagagtctgagacagattctccagttctgctggctgtgaggttagagatttttaaaaattagaagaagggaaaagatgtagctacaaaataagtcagaagcaaaaaaaggtgggaaaaaatggtcaagatcaaagtagtagtttcttttttctggttataataatgaaccaaggatgagtaacaacaattaaggcattaaaataaaccagttattaaaatttggccttttcctgggcttagataattcataaattgttcattgttagatcagtttgaagtttttttaacctcaaaataagttcaaattggtattttaggattactcagtgtagagctgtgcctataatccacctctccagagccaaattttttgttcttaactaatgcataaaatcaaaccttcattgccaccctgtcccaaagtaggaattttgaaatttcattctggccattaatgataattgggatttgtaaaactagctcatttatacttacttgttaatggaaaaataaaacagttctttaagaatgtgttttccatcaaatgcaagcctatcttggaggtgaccacagtagcatttggcttcttttcttcatgttatcatggaatcatgaattgcacaagccagggaggcccaaatgccactgcagtgcttaggttgctagcttaagtgagacagcacaccatgttagcttcatttgtgatttcacagattctttaattgtaaattcctggccgggcgtggtggctcatgcctgtaatcccagcactttgggaggccaaggtgggcaaatcacgaggtcaggagatcgagaccatcctggctaacatggtgaaaccctgtctctactaaaaatacaaaaaattagctgggcatggtggcgggtgcctgtagtcccagcaactcaggaggctgaggcaggagaatggcatgaacccgggaggcggagcttgcagtgagccaagatcgccactgcactccagcctgggcgacagagaaagattccgtctcaaaaaaaaggaaattcctgtaagatagtgtttatgaccatgggaataacatctcatttcatttatgagtattactctgtgaaagtgcaactgtagtttattaatctccgtgtttattatttaagtagtcagtgaatatttgtgagttgagttattgtgtgatttgttgttactttttttttttcctctgtctcccaggctagagtgcaatggcgacatcttggctcactgcaacctccacctccacctcctgggttcaagctactctctgtctcaacctcccaagtagctgggattacaggcacgcattatcacacccggctaatttttgtatttttagtagagatggggtttcgccatgttggccaggctgatctcgaactcctgacctcaggtgacccgcctgccttggcttcccaaagtgctgggattacaggcataagccaccatgcccagcctgttgttacttgttatacctctttctgcagaggatttgaggcagattccaaaaatacttaacatataaaagattaaaagttgagagaattatagcaaagggaataattaagaaaataaaactattatagaatgaactataataaaactattatagaatgatcctgtataaaatatagcatctaaagcaggcatatgggcttatagttttaaaagatgagtcacaaacttgtctcaggatttcttagtagccaagcaaggagggcaacatgatcagttataagattcatattgtttggcctttgaaaacaaactaggtgttcaggaaatttctcccttgtatattataaaccagagatgtgtgatataatggaatatatccttacacaattgctccaatatcaaaacgataaaaataaagcagaacactacaaaaagtagtttatacccaagtacctgtcatccctaattaacagatatttgtattatcatattttctttgtatccttattttaaaagaatcacaagagataaacttgaagcatcttacattattttcccagtctccttctccttccttccctctcccagtatgaaactgatatataggctgtcaaggctgttttttgttgttgttgttgttttttacttttactgtatcgtatatctgtaaataatatataaaccttaaatttgcataaataatgtactgtacatgtcattcctaaacttgcttttttttattagctctgtgtttgatgtccatggtgctgtagatctagttcttttattttattttattttttgagatggagcttcgctcttgttgcccaggctggagtgcaatggtgcgatctcggctcaccacaacctccgcctcccaggttcaagcgattctcctgcctcagcctccggagtagctgggatgacaggtgcatgccaccacagccagctaattttgtgtttttagtagggacagggtttctccatgttggtcaggctggtctcgaactcccaaccccaggtaatcctcccacctcagcctcccaaagtgctgggattacaggcgtgagccaccgtgtccagcctagttcattaattttaaattctgaagtatagttttctattacatggaaataatacaaattagttatctattcccctactaaagattttcagtgtgtttctagttttcactgttattaatggtgccgcattgaaaacccttgtctgtatcttgtgcccacgtttagcgtttctctaggacagcagttctcaaaggatcatctgggaacttgttagaaatgcaaacttgggcccatcccaaatctctgaatcagaaactctgggggtggggccagcaatctgtttaaaaggagattgtggtgcactctacacttcagaatcacagctctagcacatgtattgttaaaagtggagttactaagttttagggtacatgtattttccactgtactagataacacccaattgatttcacagaaataatttatatatcaattttttattaagtccctttgtcatgtgttacaagcttttttttttttttttagtttgtcttttggctttgtttatggtgcttaaaaattgtaaccaaattcaccaattaaaaaaaattgtggccaggcatggtggctcatccctgtaatcctagcactttgggaggccaaggtgggcatactgcttgagtccaggagttcaagaccagcctgggcaacatggcaaaaccctgtctccacaaaaaaatacaaaaaattagcaaggtggtatggtggtgcacgcctgtagtcctagctactcaggaggctgaggtaggaggattgcttgagcctgggaggcagaggttgtagtgagccaagattgcgccactgtgctgcagcctgggttacaaagtgagaccctgtctcaaaaaaaatagtaaaaattgtatatatttgaggtatgcagcataatgttttgatttgcatatgcatagtgaaatgattactataatcaaaccaattaacatatccattatctgacagttaccgtgtgtgtgtgtgtgtgtgtgtgtgtgtgtgtgtgcgcgcgcgcgcgtgtgtgtgtgttcccgcgtaggtggtaaaagcacctaaaatctcttctggcaaacttccattatacaatacgatattattaagtatagccctcatgttgtacagtagatctctagatgaattcatcctacccatctgcaactttgtaccccttgacctacatctccccagtcccactccctcatccccaagttcaccagtttttttaatggctttggtatttagaaaggctgttggagggaagaattttgagttggatttgatttgctactgagacaccccattgagatatataacagttattggagaatggtctgaggcttatgagagaggtgagagttgtagagatttggaaaacttgtataaaggtagaaatttgacattgttgggatggatgaaattgccataaagatatgtctgactggtgaaaaaacaaaaaattgacacagagaatgtagattgagaaaatgattgaggattaaatgatggggagcaacagtggacgaagataatctagtaaaggagactgaggaatgatcacaaaacagagcaaggagaagaatctgaaatatcgagtgatgacaggaatgtaagcagggagagatcacgaatgctgcagagaaaggaatacatctaagaaaggtgtaaaaatattccccttcaagagagcagccagcaatgggttgaggaatagaagattccttaagtttgcagtgaagcataggagaagatgaagcaaacttagagagggtaacaaggtcattttgctttaggagtagagtatttttaccccaaaggaaggagcccatggcaagttatgtctgatgttaatgatgctgtctcctcttcaggcagccttttcatagatatactttaaataccctttgaataaattcattcagcaatagagttattgagtattgtgcagaggtatagggtgatataattgtgactaggtgactactttacattagatagtcttctctgatgttaacatttaaatttaggacctcggctgggtgcggtggctcacgcctgtaatctcagcactttgggaggccgaggagggtggatcacctgaggtcgagagttcaagaccagcctgactaacatggagaaaccccgtctctgctaaaaatacacaattagtcaggtgtggtggggcatgcctgtaatcccagctactcgggaggcttaggcaggagaatcacttgaacccaggaaaggcggaggttgcggtgagccaagatcgcaccactgcactcccgtctgggcaacaagagcgaaactatcaggaaaaaaaaaaaaaattttaggacctcagtggtaaggagccactcaaacaatgtggagacaaaatttccagcctctatcaggtcaaacaatagttaggatcgtatcttaataatctaataaagttttcttgcttcttggatctgaccagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacaggtaagttgaagttttcagcctgtgaatcttgcatctggggaggatttggtggacgaaaggagtaggattgcttttctacattgggcttcttgctttctctggaacataactgccaaagagcagatagataagatacttgttagcctcaggttccttagttttccatgtggaatctaaattccctaggctagtgtttttcagtggaggttgaaagggggaatctttgaaactagatctgcttacattgcccttgatgaaagtgtgttctgagtttcctctgttggggaaacaagtttgagatgtgcaaccccaggcagtgacatcaacattttaataacagagacccattttaagtacggttttatcatatgctttcccagccctgtccatggtggtggtgggttttttgtttctgtttttcctgtatgtttctctcactttccatccagtgttctcagcagctgaaaaaagttataaaagctattggtcagtgtgagatttcttaaaatgtggatgaggaacataaggtgagaaaaacctgaaaactgctatcttcctatcaggatcatgcagagggagggaggggaaatgataatctgcccttcatcctgttttttcaggttgtccacttcctatttaattgcttcctgtttttctatcaacagatcaaggtagtgaaattctcctacatgtggaccatcaataactttagcttttgccgggaggaaatgggtgaagtcattaaaagttctacattttcatcaggagcaaatgataaactgaaatggtgaggaagaatacgtctaactgtaaaaatttttctgaagttgtctgttttgtttggttttatgggacactgacaagaatgtaatttccatgaaggccaggacttttgttttgttcttactgtatttcccagtgcctagcacagtgcctggcacataataggtactcactaaatgtttgttgaactaattcaatgagtatatcagaaatcagcaaactcaagctatagggtaatgtaaataaataaagaaagccagtgttataaatgatatccataaatggaatgactggtgactgcttggcaaactagtgagtgttcttctaaaagaggtgctggctactcagctccagctaactatagctatgcatgagtaagggctgacccttgccagattttctgatttttcaagaaaagcaagaaatctagattttaacataaaaatctctttacttttaaattgcctgcttttaaacaagaaaggggatttatttgcttatgtaactgtattgacagggtataggatgggtttgaaggtagcttgatccagcaagccagtagttagagtaagaacaccatctctgccctggccctgttctccacgctcttggacatctcaggtctggcttctcttgtgcttaagggataactggcagtaccaatgggtataatctactacatgctagcaaaagtctttgagctttctctgaactgtgtggccaggaatatgtcgtacatgcaccaattgttttacgtttgcattccctgaaccaatccctggagcagggaaaatatgatccaggagtgaggatcagtctcattcagactatgtgtcatcttgcctgaggagcaggcagttgaggatacaaccatatacccactgcaaagaccaaaacgcaagtctctgaaccaccagttttgacctctgataacccaccaaaagttattttttcattcatttagtattttttggctatatattgtgcattttactactaagtgttgagagagatgtttattcttagacattgtatttaaatcctcatcattagcaaggtgtatagtaatgtatgtagcatatgcactccctagagagacactggattgggccacctgtttgagagaggtgcaataatacagataaggcttaaggatacatatgacctgtgtattgcatgtggtagaagcagtgcctgaaacccatgcatttgactaatgacatttacaacttagttgaacctattctgtctgaattttgttttgatctctccgtaacagattggcatctctaacactatttagaagtctggcctggaattctgtgctgcgtaatgataatttacttttgtctgtgcttccttcatattgcctcttttattttagtcttagaatattgttgccagattggtaaaatatctataaaagattatgtatattattatctataaaagattattcacactttttttttttttttttttgagacagagtctcactctatcgcccaggctggagtgcagtggcacgatctcggctcactgcaacctctgcctcctgggttaaagtgattctcctgcctcagcctccagagaagcagggattacaggtgcccactagcacgcctggtatttttagtagagacaggattacaccatgttggtcaggccattctcgaacttaagtgatctgcctgccttggcctcccaaagtgctgggattacaggcataagccaccgtgcctggtccacacatttcttttttttttctttttcttttttgagatggagtttcgttcttgttacccaggctggagcgtagtggtgtgatctcagctcactgcaacctctgcctcccaggttcaagcgattctcctgcctcagcctcctgagtagctgggattacaggcgcctgccaccacgcccaactagtttttttctttattttttatttttagtagagacggggtttcaccacgttggccaggctggcctcgaagtcctgacctcaagtgatgcgcccgctttggcctcccaaagtgctgagattacaggggtgagccaccgcacccagcctgttgtttactttttaaaaggtgacccattttgctttacgaaagtggttcccagccaggtgtggttgcttattcctgtaatcccagcactctgggaggctgaggcagacggatcgcttgagctcaagcattcaagaccagcctgggcaatatggcgaaaccccatctctacaaaaattagctggccatggtggtgcacatctgtagtccccgctactcgggaggctggggtgggaggatcacctgagcccagggagatcgaggttgcagtaagccatgatcataccactgcactccagcctggacgatagagtaagaccatgtctcaaaaaaaaagagaaaaaagttgttcccaactagtcattctactgaattatattcttctatggggcctgcatttgttttttaaacatctccctctcttgagtctgatttccagttctatcaaaatggatgcttttgacattttttttttctatctgttttggacaggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatgggtaaatgttctcctctttgttcaactcttaagtttcacatccagaagtttcatacactgacaagttgtggctttgatctggtttttgcgtaaccttaaatatgactttttttttccccaccccagagagtcaacgggcatataggtttgtgcaaggcaaagactggggattcaagaaattcatccgtagagattttcttttggatgaggccaacgggcttctccctgatgacaagcttaccctcttctgcgaggtgagtccttgtattctgctgagactagcagttcccagatctgatgagtattggtagacttaattatattgtatcagggatgtagagtaagaaaaagccccaagtggagtagtgctgcacaaatgttatttatgtgactgattgagctacctgatgatttcaaggttgttgggcatctcagctttccacttgttactgttcttaaaaacaaaggttgtatgtatgctaccttggtatgtgtcagttttaagttgcttgggtcaggagttttcactgtgggatttttttcagatagcatttgaaaggactgtcacatcaagctaaatatgtgtatctgttgtttatactttctggctccttaagtgtgagggccatgtgtgtttgcagattacttaccttttctgctctttgaactagattcttatcaagagttgaggcctatggtttgtcttgctggagtaattgtgaaataagaaggtgagaaccattttttttctagggtgaaggctatgtaaagctctctaactcacagttagctcacagagttatctgtagtcagttaggaaagtcctctcaccagtgacctaagagcttttcccaggtttacaggagaagccttgaaataaaattcccaaaccaagaatgagttggaaagtggtttctttaatgagtatatactgattagtcatttcatgctgttatgaatacatttagaaatactgacaagctcacagtgtaataaatgaataaaatctccagtcaactggggcattagtgttccctgcacataggttgaggaaccacttcctgagcagcaccgcttgataataataaacagtgtatcatcatgggggatggtacagttgttccccaattgccaactcgctcggtcaaataataggctcacactgtgagttaatgacagtttcaaaggcatatcaccacctgagtagcagggaatggagtcccttaggaatcttgcccttttgcagaaaaggcctagcggtcggtagcaggcttatgtattgctttctttcttttttttttttttttttttgagacggagtcttgctctgtcacccaggctagagtgcagtggcgcaaccttggctcactgcaacctctgcctcccagattcaagtgattctcctgccttagcctcccaagtagctgggattataggtgtatgccaccaggcctggctaattcttgtatttttagtagggatggggttttaccatgttggccaggctggtctcgaactcctgacctcaagtgatccgcctgcctcagcctgccaaagtgttgggattacagatgtgagccaccacgcccagccagccttctgtattgcaacagagtagttgcaaatgattagaaaactttggaggcagtttcttataataccacactaaatatgtaaaatatagtttgcataatttggtatcccctctcctttttaattaccaagtaaaagaaggaaatactagagtgatagcatctataataaatacataaaatgtggcagttcttttatgtctgataaacttggagtgtgaattctgtgtaaatctaacgtcacagattatactcagttgcctgaatgaagaaatgagaatttagttggttttacatgaggttagatgttatgtaaacagatcacagtttgaatcttcacctatcttacagacttgcatttcagaaaaacttaaaaatagtagaaaattctagtttctattggaaatgaaagccaatctttaaactgttctctgaagaaaatctcccctaaatactgcatctggcagtgttaggcaataccataacctttactgcagcttttttgagtccacagtgggtccagccttttctcatatgcttccccctctcttcccaatccattccagctgctccaacccctgtcttcacagtcttgatttggaagccagttggcctgccctcacttggcagtctcttatcctgtggttaaatccgaggccaagttccagctcgctcgctctctcccttcacttccccatatgaaattctcttaggagaaatcctgtggttaagtttagatgtgccttgacttagatgggaagtgagatgacactttagaaacgaggagatgttgaacagggtaacgtctgctgggttctgctgatgccatcggtttcttaccatcgaaccaggtgtgccatctgttcctctcacacttctctgttggccacaggtgctgagtgttgcttctcatacttgggcttatgcctagtgagacttgtttctgttccaaggctctctgtggacttagtagcattcagcgttgcaagacggttgcgtgggggtgtgtattggatgtgtgggttttaaggatgtctgcagctcatctaagttcttagcacttttcatagctagatcatttttggtgcacattttatccctttgacctgttgtttcccttctatcagtggaatatttataaacacatttgttttaattcatatttacattttgtttgttattggtttgattagtattttcatattgtttagaggcttttatgaagttgatgtccagatagaaatctaggttctagtaccccagtgccccattcgtcactcagcctttgactgaggcacttctcattctcatcctgatacaataaatacagttgtttcatagggattctggtgctcccagaggccacaagagggactcctatggtggaagaccgagaagcacccttttatgtttggcctttatttcagtggtattcctgttgttgaatgtttaaatgaaattagattgtggactctgaaaatgatgaatgggtggtcttgtttataatgtgccctacattgagttcactttcagacaaaatcaggcgtgttcagggtgatatgactgtagacactgagatcactttcagttctcagtgatgttttacctattaggaaatgtggcagttcttccaagttgttattgcttagttaacttatttggaagcatttccaaagcatttcctgaattgtcccttattacaatcctttgagctaggtttagttctgttttcttcatttcatgttacaaggggagagaagcagtgcccagggagtcaggaaatttttcctaacattgtgcagcaaactagtgcgagggtcatgtcagctccctattttctatctctagtccgctgcactacactaagtggagctgaatgccattcacccaaggaagcacaaactcgggtcccaagttttcttgacagagcatttactttggtaatgaaagagagagacataagagtcaggagtggtggcccacccctgtggttcccagctactcctgaggctgatgcaagaggatcacttgagcccaggagatcgaggttgtggtgtgctatgatcgtgcttgtgagtagccattgcactcctacctggacaacataattagtccctgtctgttaaaaaataaataaataaataaataaatagagacatgaaggcatgtttaaattccattttaaattttctctttaataatttggtccacagaaaatcttcatgaaatagttcagcttctattgacccttttctccaattatttatattgaaaacaaatagccattagcaataaagaagcattgtattccaactttaccatatatgcctttgacaggtagataatcccagaacctctttgtcatgttgtaactaaagatgaaatatgaaataacataaatgtgaaatatccagacactaattaactttattttaattttttaagagatgggatcttgatcttgcccaggctggagtgcagttgcttaatcatagctcactataacctgtaatcccagcactttcggaggccaaggtaggaggatcattcaagcccagaagttcgagaccagcctgggcaacatagtgagaccctgtctctacaaaaaaattaaaaattagccaggtatgatggcacgtgcctgtagtcctagctacttgggagggtgaagcaggaggattgcttaagcccaggagttggaggctacagtgagctgtgatcacaccgctaccactgcactccagcctgggcaacagagggagaccctgtctctaaattttttaaactaatagttttatacacacacacacacacacacacacacacacacacacacacttcatagcatgggaataggtatttttgctaaattttaaataaatgaatctattcatttttacctttttatcctttaattattggattatttgaatatattatttgtactggatgaaaataccaatatttgcttgttcttgacctacacaaatggtgattcaataggtaacatcattgtaggttataaagcatgagaatatactaaacccaccactcaacctaaaaatatgaccaataacttggaactaacctgtaatgcttctccccaatccctaagatttgtttccccactcagaggatgataaatagctattttgaattttatgttatcatgcacttgtttattatttgtatgtctgaataatatattgtttaggttacttgttttggagctttataaaaatggtgtcagactgtatgtagtcatctaagatttgctttttcacattatgtttctaaaatttatataactatacttcatccatatttagtgctgtatataatagtcttgtgtgaatgtataatttattcattcttttgttgatggacatttaggttgttgctaatcttttgctagtagaaatagtgctcctgttgtaaataatttgtaggcagtgtctgtttttcctagattgttttaattatatagaagttaaaaaatgtatttccctgggttttactttatgtatagatgaaatgtacaagaattggcacaatctttagttttttatgaaatttgtttttttaagaaaaggattgactttaaaagtgagacccttttacaacttgaagttaaggagattatacagccttcctgagacattttcatgcagtcatttataagatgacataaatgtcacagtcacgtcatcttcacagctgcagttctgaatgagtctccccagtcaactttataggcattaaaaaaaatctttagtttttctcagaatggtctcattttagcatcatcatttgcagaggaaaacaatccctttctaagttaaaagtttgggctctgaagactcatttgtgaatgccatttagaatttatttttaattaagcgtatttaatgttggtgagaggtgccagacattcagagctctggagactccaggcatctatatatctacagaacaagcctggctcagacaataaaggtacattctcttttctgctgtgttcctgtctgtgtccagagagaggaattgccccagtgagagatgtcacagcctttgggccccactcattaccacatgtgcatctaaccagcagaaggcccactggtaactatggtttgattatgtgaaattcagtttagctcttcttgccaattcatttcacccagtctactaaattgccatcaagtgttaatgactttgggctcctgtcaacctggtttaattcaagctaggaacccagtgccaaaagcattctccattcccttcattggccatcccaggagattcctgcctttccctgtgagaaagttggatttaattggtcttttccttttttttttttttttttaaattagtattttagagctataactgagaacaggcaacttctactttcagtgttaatgttatgtcaaagaagtgagggtattaatatgagaaagtggcagaagcaaattagaggtcttataaaggacaagagagaatctctatgggatggtttgtactgtgtcctaggctattaaaataatgttataatctggctctgataaatgtgatactaatgccaagtatattcataattgattaacttggctgtttcattgcccaagaccataacagctagttttaaacaaatgaataaatttcttgacctgatagtaaatatctcactcctgcacagaaggaactacaggtcattaactttgcctctgggcttatgactgcgtttaagggatgacttgcatcttgaaggttaaaagaaatctgggtcattaaggatgttcctaagctgtctttctcatcttactgttaggaacagcaagagtggggagctaattctcaaggtttgtgagttctgctttgaatttaacttttctaacagaatgtgatgtaggagatgaagcataacaacaattgttaggcagatgactgatctgcagtgtcctatctacagttgggcaactgacatttattttatgatgttgtatgatttataaatccttgtatttggtaccctaacagatttatctgagtttcactgactcacctagaagttaacttggttttttacctaggctgaactggttaaaacatgcttctgctgaagccatagtgggaagttgggattcctttataaacctattgtcatcattatcttccaaagctataagtgcatgtgtagctacagccaagcatcttgtatgtcattatcacaactgactaaaggtataaaagtgtgggatactcacccagttttcactactagaaagatcttccaagtctggtccttactgacagtgggtcaataatgtcatgttcattaaactaatatttttgaagaagtgccagttatttaccaggctctgtagaagatgcgttttatgtgcatgttctcgacctaactaaaataacgtcttttaggcttcagttattagatttggcgaggtgcagtggctcatgcctataatcttagcactttgggaggccaaggatggaggatcactttgagcccaggagttcaacatcatcctgggcaacatagtgagaccttgtctctgtaaacaaataaaaaattagtcagatgtagtggcatgcgcctgtagtcccagctactccagaggctagagtagaaggatcacttgagcctgggaggtcaacgctgcagtgagccatgatcatgctactggactccatcctgggtgacatagtgagactctgtctcaaaaaaaaaaaaaagtgatcagattcttgtctctagagtttaatttaaatggtagtatttataggagttctttgtattgaacttaaggcagaataaggtaaatacttgaggtttaacatttgtttctgttagttttgtctctctggcacctttgcccaggtttgtagtccaagggaggtgaagcttattagaaactgggggaaaaagagatttgtggggctctcttcctattgtcctgagatggtatagaataagtctgattgtgacagaaaaggagttacttgatccggggctaaagccttgatttgtggaggtggtttcaagataatatgattaatattagtatctgaatgtactacagcagttaggtaaaagtcgtctatctgctggcaaaaaaattcctggtaacaaaagcttggcttgtgtttccttgtctttcacaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcaggttggtatttattcatgaggaattttatagttttggtgaaataaggaaaaacaagtgattgcataatcaccttttgaacaacttcaactttttgaactcaactacaaaacaaactgcagctaaatatatctttgtattccggtaacaatgctcagaaccaaaaaagctgctctctaaaatgacatttctgtttttcctctctgtagtggacctaggccatcattttcaaggcatggatgatgatgtacaaaggtattgaatgcctttgcccctagagagtagatgtcagagcaccagttaagagcaggtatcaacccctagataagggtttaggatgtaatggagaggattctatactcaggactaaatgccatctagctagtcctcagccctggaggggttagccctcttttcaatttaaacatactagaagaatgaaactcttgcccctgacatggaggatcaggtcttgctttaataggcccatggttttcaagaccagggagattgacaccaaggaggaactgatgaggaaggactgacttcaccgcccagggaagggtaacaatcaccgtatacttctcttaagaccataagacctaacaggaaattgtgtgaaccttcaagtaacacacttcttactaagaccctccgctccgtcattctaaagtacacacctggtaaaacctcagactgcctcagtctaaacattttcctgttccctctcacaactggctgttactgtgtaatactcaaggaagtcacgggcgcggtggctcatgcctgtcatcccagcactttgggaggctgaggcgggtggatcacctgaagtcaggagttcgagaccagcctggtcaacatggtgaaaccccatgtctactaaaaatacaaaaattagctgggcatcgtggcatgcgcctgtaataccagctgctccagaggctgagacaggagaatcgcttgaaccctggaggcggaggttgcagtgagccgagatcatgccactgcactccagcctgggcaacagagcaagactctgtctcgggggaaaaaaaaacaaaactcaaggaagtctataactctttggttagtgtctccacacttagctaggccctcaacactgccaatagtttttctacagatgtttaggcaactccctttcttaacgatagctgtctcaaaccttaaccactctttaactccttccaaactcctaaaagattaccttgcctacttcctccaagagaaaaggaggcccttttgtaggaacttcctcaactcttgcttcttacctcacctgcattctcagtggaggtgttcttcctcgtggacaaagcagactttttttctacctctgctctgttttatatcccatcttgccttctcagaaaccttactctaccggttatacccttgctatctatctagtatcttcactatctctctgttattgcctcttcaccttcagcctgtacaggctccaagcttctccctctagttattctctctctcttttccccagaactgagtttcttgagttagcatattcactttctacttcctttcctcccacttatcctcagttcacctccatgctatgaaagcagtttttcaaaattacatgatctactggttcctaaatttgaaggactttagttcatatactaggactcctctctcctgattctctggttgcttctgatgtgtggtctccttacttcttcctcaccaatccctttatacattggtgagccctgaggatctgcttcagttccgttttcattccacttcttctccctgagtgatttcatttattcccgttgcatcagctgctgcctatttaccgaggaccctcaagacctggctgctttggacccttccttctttatgaaaagcaccgggcctttagtctttaatttctgaaatatatttatttagttctctatggtctgtaacccttctgaaataagaacaatgagaattgatatcctttcggtagaaattaaaatactgaagttcagagggttaagtgatttgcccaagaatatgtggttagaaaatggcagagctaggccgggtgcagtggctcatgcctataatcccagcactttgggaggcataggtgtgcagatgacttgaggtcaggagttcgacaccagcctggccaacatggtaaaaccccatctctactaaaaatacaaaaattagccaggcgtggtggtgggtacctgtaattccagctacttgggaggctgaggcaggagaattgcttgaactcaggaggcagacgttgcaatgagccaagatcatgccactgcactccactctagcctaggcaacagagcaagacttttgtctcagaaagaaaaaaaaaaaaatggcagagctaaaattagtgctttctgacataaactataggccaaaatttccagttctctgttagctcaaaacctttctactatatattttgtccattctttcactcttaggtaatcgttggatctcagctttcaccagaacccctgatttatttgacaacatgaacaaatttgagttcttagccattctattacttttcgtggttgagattattatttttcatggtgttcattggactagaatgagcatgagttggagcactgtttctcaaccttccaaccttcattatccctgcctctaaggagaaaaactaaatttaaattctccctgatgagagaaataaaatactaaggaagaagattttatcaggtagggttgtgctttaaagggacacaaatcattataatatctaaagtttctttccccccccacctctttggggcaatatcatctctgttaggaatgcatagcttagaaaaacagacagtttgccataggtgagcatgcgcttcatctggttagtggatgccattgagcccagttcttgaccttcttcctgtgcagtccctggaggtgcagaaagtatggtgtcagttccaacaaaaacataggtattagaacaccctgcttgatcataagggaccttccatttgaaccccaaatctatacagagaacatagcattatcatccaacatagataagtaattttcttgaaatgtgaatggttggagtagagccgataagttattttggaagtagtggtttcttattttcctttatgtattataattagttacttattgttataatatatgaagaaaggaattttgtaattctgatgtaaattgaggtagagacctttcctatagcagtaggataggttagaaaatgatctctccctcatgactggcaacaaccaagagatttcactgtgatagccttatctgcttgtttctctttgactttgtagctcgttctccggtttttagtgccatgtttgaacatgaaatggaggagagcaaaaaggtatgtaacaagatgaagacatgtctgtttagccaggtatctagagtcagatgatttcccactttagctgcagattcattttcctaattacttttttcttactaaaatggagtatgagtccctaaactccttctgagagcagagagaagtggtgtagaagtattatgggtaaagcagattgacttattaaatgaggctgatcatccacacagttttgggtgagggtatttagacatatatgtttttactcagaaaactgaggaaaagaaaggtgaaaaaatcgaagagttgttttgctgttatgtttaagaaaacaaagatggaacatgtgatggacgaaaaggctattataatcaagccgggcaaagaaattttccattaatgttaggttttaaatgatacaaagttctctcctcactagagcttaaaatcatgaaaatagtttagtttagggattttgttctgttggaatgtttctcatattcagtttttctggcatagaatcgagttgaaatcaatgatgtggagcctgaagtttttaaggaaatgatgtgcttcatttacacggggaaggctccaaacctcgacaaaatggctgatgatttgctggcagctgctgacaaggtaagataagaatagaaaaataatcaggactaggagttattgtgacttcttgtgtttcatgaacaggattctatgttgcattgtgggtaaaatgagcatatatcttggtttggccaagacggtcctggtttacacatattattccaacacaattattaatagcacactttttattctcaaaagtgtcctgttttgaatagtaaactatatgatcacctaactatgggaaagaaggataagtttgacttctacctctcctcttttttccatctcaaatttaaccacagtgatagtaaagattcaaataatactaacatttggattgtgctttataatttacaaaatgtttttgagtttattaatgtatttaaactttatcagtaaaacagccctttgtatccatgtggactcaaccaatctcagatcacaaatatttgagaaaaaagaaacaagaggccaggcacagtggctcatgcctgtaatcccagcacttatcggaggccgaggcaggtggatcacctgagctcaggagtttgagaccagcctgggcaacgtggcgaaaccccatctctactaaaaaatacaagaattagctaggcatgatggtgcacacttgtagtcccagctactcaggaggctgaggcaagaggatcgcttgaacccaggaggcagagtttgcagtgagctgagatcgtgccactccagcctgggcaacagagcaagactctgtctccaaaaaaaaaaaaaaaaaaagaaaaaagaaacaagaaaaaacaggctgggcacagtggtgctgggtgtgcagtgcctccagcctataatcccagcacttggggaggccaaggaggaaggatcgcttgagcccaggagttcaaggccagcctgggcaacatagactccatccctacaaaaataaaaataaaaaaatttagccaagtgtgatggtgcacgcccatagtcccagctacttgagaagctgaggtgggaggatcacttgagcccaggaggttgaggccacagtgagccatgattgcaccattgcattccagcctgggtgacagaacgagaccttgtttcaaaaaaataaattaaaaaaatacaaataaaaaaccaaaatagtataacaactatttacatagcatttatattgtattaattagtatagataatatagggctaatttaaagtatacaggaggatatacataaagatacagggaaatactgcctatttatttgtttgtttatttttttttttttgagaagggagtcttgcttttgtcacccaggctggagtgcaatggcacgatctcggctcactgcaacctccacctcccaggttcaagtgattctcctgcctcagcctcctgaatagctgggattacaggcgcccgccaccatccctggctaatttttgtattttaagtagagatggggtttcgccatgttggtcaggctggtctcaaactcctgacctcaagtgatccgcccacctctgcctcccaaagtgctgggattacaggtgtgagccactgcacctggtctatttatttactttttgagacagagtctcattctgttgcccaggctggagtgcagtggcacaatctcggctcactgcaacctccgcctcccaggttcaagcagttctcctgcctcagcctcccgagtagctgagattacaggcatgcaccaccacacccagctaattgttgtatatgtagtagagacagggtttcaccatgttggccaggctgctctcgaactcctgacctcaagtggtccgcccacctcagcctcccaaagtgctgaaattatgggtgtgagccaccatggctggccaatactgtcaatttatataagtgacttgagcattcacagattttggtatttgcggggccctggacccagtcccccaaggatagtgaggcatggccgtaatcttttacctagtgtcctggttagcattttcaacttttaccttagtagttattgaaataaacagtatttcttcaaaattatgagagaattaatagcttaatagtagaataaattgtacttcatgacacatttcaatttgagaagtgttcaagtgtggaaataaaaatgcagatcttagaatcaaagacatatgatgattacctaaaataattcggtcagtgattcccaaaataaggtgaaatatcaacagatattaggttggtgggaaagtcttatgaaaaatactgagtttaaccaagacaaatagttgctatcttactgcaggatttctcagaacatgtagcatattaatgttactgtgaattttctaacaggaattatgatagacagcatttctccaatttagttaaccctggaatcctttttctcaaggatcacctgcaagattagtggtccccaaaacgcacattgggaaacggactttcattgtttaggtacatcagagagagaactcaatggtctgcccttctaggccctgcggtctgtggaaacatgacctgtggggaagggtgaaagaattggtgtttaccctgtgggagcttttcctgtgttggcggacaagtagagttggcgtgaggatgggagaagggcgtagatcctgccagcagtagaccctgtgagaaagagggttatctgccaaaagcacctccttttcctgctgtgatgctgcaatacccattggagggaaaagtgggctctggtctaaggacacaagagccttccagggtttgctcatgggatagtctcctacctccctttgtgcctgaggacagaggaaagtgcctgtgtttatagtggaggttttatctttattgatcagcttttggagtgtatgtggaggatggggcaggtaaatgccatcagtgctcctgatgaagaagattggaataataaccgtatctttcttgtcacttttcaagactttatgagtacaatgaagcaatgtgaaaattccatacccttccagtctacctcaattctgaccaggggaaacttgcttttaatggagacagtaagaaaatattcactgcaagctctgggaaagtagaagacacaatccaataactgccttttataaagttaattatgattctgcctgatctgtgctctgatttttaaggaagtggtcacttgtacttatacacatcatgtgtttatcctctcatcttctagattccataaggataagtattgcaaggcccactttttagacagaaatactaaggctcagagttgtatatccgcagagccaagattaaacttctgccatgtcccttagttttcattcttgctccctagccagaaaacctactggtaacctactgtaagtacacagggcatggtgatcagcctgaactgccatttcaaggatagcatttcagcacaatgtgttaacttgtggttttaaaagataaagctgttgaatcacggcagtgctttaaatttatgaatgagaagtaattgaagggtgtattttcaaattccattcagaatttccaactagacagtttttgcttcaagcctatttgaaaacgtttttacctttacacctcttcgtgagttttaggaaaacagaataagaaatctttcatggaatgatctaaacatctagaatttacccaagaggctgaaacagcttctcttaagcttttccagtctcctggggacatgtgtaattagaccaaaaacaacaaaactcgttgggctaggcctgggagacacaatttccatctcttgggtaagtactgccattaggcaggtttttcagaagcataattaagaaaaaactttgtccccaagggacaagaatggctacttttgtctaattatgcaatagggatcagagctattcacagtaaaagtccttttaaaagaatgtattgagaaaggataagaggaatcgtctgggcagcactgtataaaaaactgaacatttcagccttttaaaacaaaaacggcaacttcatttcttgcttatctaatgttattcctgttttccatggaaactgttttccagttactcaaatgtaaaaaattaaagctgcaccaaaaccaataaaacctctcttttttgctgcaggagatcacagtgccagcagatatgcctcctcacccagaattcataacaattaaattgtcctgatttgattgccatgattcaccctgaaggggcattgtgtcattgagttctggggccttcaagctggggcctataaggagactgtgcatagcctcaaagcaaactgttttcctgtgaactgatcaatgacattttattttgtgcctccttgtatttccttcctctttcctatccctcaagttcctagtaagttcataatctcatattagagaacaagtggtagagctgtatctgaaccaatcaagtagatcagatgtgcccagcattaacctaggctttccatttcaagaacatttatgcccttttcttagaaaatacaagtttttaaactgaagtttttaaactgaaactgcatttaggctctctgccactttgtccttttaccctgagaagcttaacctcaaccccagtaaaataagactctatttatccttctctatttaaaaggaggcctttagttgaccctcattcagaaacaactagtggcagaggtgttggtaaaagtcaccacagggctccttttcacaacctgatgggccagttgggatatcttgctgggctagtgacagtgcttaagtcaaaaggactgtgcttcaccctcttctggctctaaggggattgcagtaaataagggatttcacagggtagacaccaattctttcacccttccccacagatcatgtttccacagaccgcagggcctagaagggcagaccattgagttgccctgttgacgtgaagcagactgatgcctcactgtaattgtaagtggtgaaggtttaagaacaactttcatcacagtcaggaggagagtaaacttcaggatgcagatctaccctgtaattgccatttttctaataggtagactttagaactctaatggcagctttccaagttactttagctgtttacatttcaagcttaaacatctaaccttcagaaatggttatgttttatcattgcagtagtagcttttcatggtctgtgcagttctattcaagtatctagttaatatgatggtacagctaaagaaaacagcttcagtagtggtcagcccagaactattgctgctctgatgacagcagtgcttgtgttttacagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactagtgagttggcatcttcaaagttcttctttcaaaatagttggatagctgaagaaatgagaaaggctttgaattagtgggtaaagcaggcaagtagcttcattaaccttttggcagtaagaatagagttttcatcttttccttcagttgaccgtatggaattgacttcatgggttgaatcctattggtgagtaaagtgttttacttcctcatagtgaatcgaagtgatgaaaataacttgctggcctgaaaaagctgtatgccccaaatgatagtatctttacttcacactgagtgacttaataaaagacatgtagatttctaggaggatagacatatgtttatgagttagtaaaatgtacctcatgtttggttgtagaataaggaaaaaagaagggatcatcagtagctggtttcactgttttgagaaagaaatgttcattccactaggtctgttccttcatcttaagtgacaaatgacctggaaatactactttctgaaataataatatggaataataataatatgaaataataagaataataatatgaaagatgagttgtaactacaacccatcttctcagtgggacatgttctactcccttgccccatggagagagcaaaagctggaaaaaacccaaagaagaaaagccctcacaacagcagttctggggcaggacaggtctgagacattccaggtggatgagtgaacaatattcaacatagaaaattcccaaagacaggaaataacatcctctaggtctagttgtagaattattttctaaggagtgatcaagtgaggcagaagagggaggggagagacccatcagtgtgagttcctttgagtgcttactgtgtgctggacacttgcttggtgcttttgagatattaaccattgaatgaagtatggttatcctcccctcttttttgataatcaagtaggccccaggctctgatctgccctgtggttaaaggctggtgagtggcaaagccaggcagaagctcagggcttctggccgagggagcccatgctcctttttatgactagcatcaccggtgaatataaggaacataggcagtgttgggggcctggggaacattctgctttttgtttttgagaatatagtggctcaaagtcttggttttcagatgacgacagccacaggcaagtcaccagtctgctcattgtctaacaagcaaattcttatgcatattaagggttcttctgtttcttgcattgacaccctttatacctaacagtggaaaattaggctatctaggtggctgttgaattcatcccttgctcactccctttggtaacccatttctccacatttctcctagtcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaactggttctgtcattgacttgatgtgtttccagaaaagctaatactggagctcacaagaatgttctggggctccctgtctgccttttttgtggctctgttaggacagtgggatatattgaagaatgcatcagctatttggccagcctgtgtattttttacctttgatggaacctcaacctatttctccttctatttcccttcagtggaccttagactttgtacattttccgacttttcatttatcttactgcctctagaatggataaatatgatctgttactaacataatcaaaggcaggattagtttattggaaaccactccattgcaattcccggtttcccctgggaagcgtcccctgtgtgaggaagtacccagttctgcatgtgctggctgctggctgctggctgctgtcctgtgcctcctccatcctagctttccagatcagcacacaagtccaagaatccgggcgaactcaaagtctcctctacccatatcgtcttaggtttttccagctaaatttatatacagtatttcatctgaacttcccaacaacttgacgaacttggtgggacaggtgagatatggcatcttcccactgtgtagatgagggaagcagaaacccagagaagggacatgcctcagatcatacaactattgaatgccagatcttctaatggagtatcctgaagattacgtaattaactggaggaagttccatttctgaaatgtttaggtacaaaactgaaagtaaagcttccttcctgtgggaatagcaagaacaaagctctggaaaggtgcctctgctggcctgttcttcagaggttccagaaggacaaaccaggcttcagatttgctttcctcttcat

SEQ ID NO: 15596 - DNA, 38371 bp, Human; identical to SEQ ID NO: 12061
  misc_feature (1)...(38371): n = A,T,C or G

SEQ ID NO: 15597 - DNA, 38371 bp, Human; identical to SEQ ID NO: 12061
  misc_feature (1)...(38371): n = A,T,C or G

SEQ ID NO: 15598 - DNA, 18864 bp, Human; identical to SEQ ID NO: 12119

SEQ ID NO: 15599 - DNA, 13827 bp, Human
  misc_feature (1)...(13827): n = A,T,C or G
ccttaagacagctgagtgggtggctccaaaaatagccagggggacggcagggggcggggagtcacatggagaagctcaggggtgaggctgggcaggtgcccagggggttggcacttctgcctgctcccccagaacccttgggctcttcctctgcctccagaacctttcttcctccctccctctgtctctgagaagacagagagatggccaggtgatgctgggacaaatactgccttgcctgaggggacgctgactctggaatttggtggctctccagggatgagcgggtcagtcaggtggagagagagagaggaagggacaaggactgcgtaacctgcctaccagtcaccccatctgcaggccaacacctgtgcccttaggctggacccaagtgatccttgcctggggtattttgttgtccttttgaggccctggaggagaggtcacacaggcaccaaggatttgggaaccctggcagccataggtccccgcccccttctcagggcacctggggagagtgcccctgtgcctgccctaagtgagagacctggggagaggacaccgcgccccatcgcccctggactgagatcctttggcagaggcaagaaggaaggggaagcagggccgggcaagtacatcagcagcacagtcatcgactgagccaggcactgggctaagccgtccacatgcattctactcatcagcaatgtggccttggggaaggtatacacccctgtgcctcagttttatcatctgttaaatgggcacagtaataatacctgcctcatggaactgctgaggagatggaatgaggtaatataggtagatatatgtaagattctcagcacagtagctggcagcgctagctggtattacccactggcaggtgacctccatgtgggcagaggtttgcttatctttgcaatttcaatgtctgatacatagcaggtgtttcataaatatgcgctgcattcattactttgtggagtcctcacaatgatgccaagaggcaagcactattcttgccagtttatagttgtggaaatgggctagagggcaaatggtgcactcaaggcctcatccccagcaagtggccaaggtggcccacctccaggcctccaagtctatgcgccgaatgaaccctgactccatgggccagagagggtgcctcctccgctcacctgtctctagctggctggtcctgtccagggcttgctagacctccacgctgaagtgcttggactggggataaaggctgggtggatggcacctacgtttgctgttaaggaagctgccgccagccagctacacctactagttaccaggccctgtgccaggcccaaggatacaaacgtgacaagatcctagtcttcgaggagcttggagcagtctgtgtgattgtgttgtgcccaggaaagcacgcaggggctaaggggacacccagcttggcctagcagaagaagggaggtcagaaaggcttcagagaggagaggacatctgtgcagagtctggaaaggtgactggaaggttgctgcttgaatgaaggtgggaagggaactgcaggcagaggcaatagcctggacgacggcttggagacttgagagagtctgccaagctaggcaggagcggagtgaggctgagcaggggcctggggttggaagggtaggggcagaggatgggattctagaccagctgaccaggttcaggacaggccagaaagccaccaactggggatgagctgggaactcaggggccatgagaaccattagagttttaagggaggatggaggtggcctggttggtggtttaaaaaacactgtggccactggaggggacggttggagggacaatgagtgcgaggagggtgtctatcccagatttggtgcatgctccaggcggggaggggaggctgacgctgggacccagctgccccgagccacctccctccttccctcctctcctccctgccccctgtctctgtcactcaccgggcgggccaggccgggcagccatggctgagacactcttctggactcctctcctcgtgggcaagttggggccttgttcagcggggaggcccaggatgagggggcaggatttaggggtggtaagatggaggtgtggagggcccacagaagagggatctgggttgggtgaggcaggcgccagaagggctttggggtgttaatgccatggccagctggggatccagggaatggggctgggagctgggctctgggatgaaggggctgggagctctgagggctggaggtgtcctagggcccgggtgggtctgacagcacaggcccaaagggtcgtgggccctttaatgagctggctgggccgcagcttctaagcccaggctaaatttggccctgggagggagggtggagctggcggccaggtcctctgctcctctcttggacttaggattccttttgctcagctcctactggcctctagggcaggccttcttcttccctgtattttaggggaggaaggtgggggtctccaggcccagaatggctacccttcctcctctgtaggctcctggccccgtcttcctctcctctgggctcttgggcatttagcatgggattcttttcccagtgcctttcacacatacacaccctcacacacacacacacccacacacacccnnnnnnnnnnnnnnnnnnnnctcacaccccctcacacacacaccctcacacacaccgtcacacacacaccccacacaccgtcacacacaccccccacacacacccccacatacccccacatacccccacacaccccccgcaaacacacaccccccacacacaccttcacacacacacaccctcacacacaccctctcacacacactcacttgcacacacaccctcacacacatcctcacagaccctcacacataccttcacacacacacccccccacatcccctcacacacacacacaccctcacacacacacttcccagtcaaacatcagtccctgcccactgcaccattaataggggcctaaaacaaggaatggaaaggttgtgggagaggttctccctcgaatcccgaaacccagacgattaaaatgtctagcccagcagggcttgctcccccatccccaccccaatcccttcctgggaggcagcaaaggaagcgcttctctcggtcccttaggggctccaaggacttggtggggaagggagcttatcccctgcccaggactgaggctggcctgtgtgtttgggacttgtggggtccccacagttctcctggcagggctgggggacaccgaggcccagcagaccacgctacacccacttgtgggccgtgtctttgtgcacaccttggaccatgagacgtttctgagccttcctgagcatgtcggtgagcggcctgacaggcacccaggcgggcgggctggggtgtaccccgcagggctcctgctgtgactcgaatcccctctcctcgcttccaccagctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtgccgtcagggaccctgagaaaatcacaggggtgggccagagtggcctcctaggagcagccctatgaattgggattgggtgttcattcacagtcatttacatataatttacatacctctaatttggtatctgagtcctctcctgccaggcccccgctgtgccacgtttctcccctaacccacttctcagatgtctttcccatcccccaggtcacagcctacaatcgggacagctttgataccactcggcagaggctggtgctggagattggggacccagaaggtacctctagctgtgccccatcccttccccaccaatgccagtcttggggaatctctcccggagggggagggggctgtggacaggagaggcttggagaggagtggagcagggcatcctggaaagtggggacaaggctctcagggaatgggtgctgggctgggattccaggctctggagttctgttactcgctgcgttgcagagactattgggacttggcttgttggggtctgtgatggatggggcattgaggggcctgaaggggtgtgcagggatgtggggaggagcttcaaggaggctttgcggggcagagctggggctgggtgcagcctgaggtgtccacctggccttcccaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggtaggtgtgcaaccctagaggacttcctgaaagaggaggatgcagcttgtggcgggcatagaacaagggtctccctaatttccaggtggggctttaccacgcacatctccacctcccagcttcacacccctcaccactctcctctggctatacccgcatctccttgtccttccagagcctagaccctagttaccctgaactctgtacttcctggtgcctcatgaggacgtaccagatacatccattaaaagacattccttagtagggagggtaagaccccctagaagaatggggtgctctgtgtactctcaccatgatctcagatctctgggaggactgtgactcctgccagaccccagctgtgccatgttcctcccttaatcctccctcttaggcgtctccctcatcccatccccaggtcatagcctacaattaggaaagtttcaacaacccctggcagagtggtgcctcgtgccccctgcccccactctgctgacagtgacttctatctggtcccagggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacacacccctgaagttctacctttcccccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgaccaacagagcagggactcattcagggtccacagccagcgactggtaattgacaacattcttgagcacttgctatgtgcttggcactgtcccatcaacatattttatgctcaccaccactccaggagacaggtgctactattatccttctgacattacaggtgatgaaacagaggcacataatcatcctagctaagcacttgtctgagtctggattcaaaccaggaggtcagaccctagagctgtgcgctaaccagtgcactgtcccgcctctgctggactttgtgtctcctgcctcctagtcctggcccctgccatgttcctggggacctctgtgtccagccagccacttcctgcgtcagccctgagctctctgtgcaggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggtgaatgtgggcatgaagggcgggggagcacctgctggagctcacacccatgggactcacagtggcacttgtgctgtatgggacccagacaccatgggaatggggttctcaggcacaaaaggagtgtggggcccctttctaggcaacttggggcttgagacctgcctggcctggcaccaggagggcattgtggataattgcacacagacctccactcacattggagccctggggcaccttggggcgaaacccagagctgggctaaccctctccttcacttttccacaggctgaagagagacctggctacctccgagtgagtaaaggaaagctgggggtggggtgggagcccacctagacagttgttggaccccgccaccaaactatgccatgaacagcagagacaaaataaataactccagggtgatgctcaccccttcccttgacctctgtaatcccagcactttgggaggctgaggtgggaggattggttgagcctggaagtttgaggccagcctgggcaacacagtgagaccccatctcaacaaaaaaaaatttttttaactagccaggcgtggtggagcatgcctgtggtcccagctacttgggaggctgagataggagaatcgcttgagcctgggagattgaggctgcagtgagccgtaatcgtgccacggcactccagcctgggcgacagagtgaaactctttcccccaaaaaagaaaagcctgttgtgacacaggggaatgggacctgctgccactctgggggaaagggcttgagaagcaacttaagagactcccagtatcagtatgagtcagacacctgcggtccaggccaggctctgccacacaattactctgtcacccttctttctggcttcagatgctccacctgcaagatcacgaggttggactagctggtgtctatgagtgcttccaattctgccagccctttccaaatccttcctctcttattttggcctggtttcccctactcatggccttacccctcctatgtgcccccagccctcttcctctcccaataccctgaaccctagattccaggaggcagatgtgaaataagttatgttccttttattcccactgcactgagccaatggcggtcttggcacccctgactgcttgcctggcctgcctcattaattgcagtggcacttggccacccttcgaacccccttgataagccgcttgtgcccctgtttggagcccagtagtgacctgtgctgtccaaaggggcgctgcccagagcgccacctctgctgtcgttgcctcttgaccttgagcttggacttggaggcctgcttcttgcccagggtgaaggagcctgaggcccccctgccggtcacctgctgagcccttgtccaccagccccttgagcacacgcttgaagtgataggcatttcgggccatgtcgtagcccgtggtggaaacagccttcttcagggtggccagggacacatacttgcaggtccccttgtccgccacagccctcaggatcaccttggacgtgctgggcttctggcagggtttggcacaggtgcgttgcccagtcgctgtcttgctagggacacgctgccctgctggcctccacccatggcagtatttgagttcaacagcactgatggagacagtggcgaagtgcctttctgcttctctccctggggtaggtgaagtgtcttgggtgcaaggacctccagggcggctggaagtctccagtgggctgcccctcacaggatggctgaggtgtgtcccggttcctggtcctcgctgaggcttcctcttgagctccggccctcacctttacctgtgtggccagaaagaggatcaaggacggtcacccacggctggcctccacagacttgtgctcttggtgcaggggttggtgaggttatctctgtggtgacctcagaggctaccagaattctgtgtgggtcacagtggccccattgtttcctccggggaggggtggaccggagatgccagatggtggaggcatgtaacatgccaggtgtcctggggaggagggctgcgcttgtgggccagacagcgggcctgcacggtgcgtgcacatatgcatgtgtgtgtgcacatgcctgggcggattttattttttaaaaaatttttagagagagggtctcactttgtcacccaagctggagcacagtggcataatcatagctcactgcaacctcagactccctgggctcaagcgatcctcccatctcagcttcctgagtagctgggactaaagctactgcacctggcctggcccccagttttaaactcaccattttgatcccaccatcttgacccactgggtttttgagccactgggttgaagaatacaagctttgcaggcatcagggttataccaacatttatgaatttttatggggaatatagtttccaaagtgaacagagatgtacgctaagttgacttacgctaagttgacttaattcctcaagcaactttctatacaaagcagttaaaaggctttgcttttattttctgttttcaattttatagaatttttccccatggggatcagtgatttttcatgtacatttcactaggaagattttattcctcaatttttttggactgaaccaaatttaaacactaacatctactggcactggggatattctcttgtgaccagtatttcctccacatccagccttccccgggtcaactctgtagctctgatgttgtcagaaaaatctgctgcctcagtcaatgtgaaatcaataaccgttttaccatgtgcaacgttagccttggctggtttggatttcacgttgatgtatttctacaaaatccaatttttcacttgttcaatgtctgccacttttcagattatccacaagttatgattctgctgcctgcttttcacctagatcagatttcagcggtcacagagtcctccaggccccacgaccctctcctggggatttctgtgccagaggcagtgctttcgggactgtgtgttggtggtggagtgggtgtgggtgagacctaggccacgtgtgtgtgtgtctgtgcgtgtgcctgagtgtgtaggaatgcctgccgtttgtctgcccaagtgctgatgtggaaggaccgtggggaagccactgcggggtctggcctctgctcttgctctagaaaaacatccccagcacatttttccacctgtgtgttgccagagtaatgaggtccagatgtggggctgggaataaggagggggcccactgactgaggccttcctctgccagggcctcacctgcccagctgtctctatctcagcatccacacactggttgctttctttcccctcagtctccccttgcctgggaatagaaaattgggtttcggacaactcagctcaccgaattccagactcaagagctcatcttgaccctcccctggccttagatggtgactccacctcttcctgctggcctccccgcaggaggagcatggcccattcagcgtgaagctaggtcttttctgcagtctaaactgtcaggctctaaccggagtctgtgtccactaattgggacctgaacatgggtggggatcacttctcctccctcatctcatcagtaaccaagtggcaagtggggtcgcttcagccctgcctggggccccagctcctctaagaaaaccaattcttggctgggtgcagtggctcatgcctgtaatcccagcactttgggaggcagaggcaggagggtcccttgaggccagaagttcaagaccagcctgaacaacatagtaagacacctgtctctacaaaaaaaattttaaattagccgagcatggtggcttgcacttatagtcccagttactcaggaggctgaggcaggagtatcgcttgagcccaggaggtagaggctgcagtgagctacgattgtgccactgcactgaagttggcgacaaagtgagaccccatctcttaaaaataaataaataatataaaaacataatataaagctcagcaaacactggcttctggaagaatatggcccctgtggatgtctattcatgtctccatatcttgtgagcgcttatcacgtggtgggcactgttgtaaacactcagccacattttctctttcaatcttcacagcagtcctaggaggtaggttttggtttttttttttaaatagagatggggtttcaccatgttggtcaggctggccttgaactcttggcctcaagtgatccacccgcttcggcctcccgaagtgctgggattacaggtgtgagccactgcgcccggcctggtggtaggtgttattatctccatttggcagttgagcaaactaaggcatggagtggttaagcaacttgcccaagacacacagccttgaacccaggctgtctacacccacagcccatgtcttgaccactgggcactgagcaggcaccatagagctttcttttttttgttttttttcttcttttttttactttgagatggagtctcttgcgatctcagctcactgcaacctccgcctcccaggttcaagtgaatctcctgcctcagcctcctgagtagctgggattacaggtgcccaccaccacacctggctaatttttatttttattttttgtagaaacagggtttcaccgtgttggccaggctggtctcgaactcctgacctcaagtgatctgcctgccttggcctcccaaagtgctgggattataggcatgagccaccacgcccggccccatagagctttctgtttgttttctgcccctgcatcatgtgtctgagtctctccccacataagtggtggggaggaccgcagggtggctcagaggcagttccaggctgtactccagggcagctgactcccagagctgatgactccccacctgtgcctccagcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcccagccaggtaggtctggtgggtgatgccagccttatttctgggaacaagatggcctttatcacaaggctggggcaaatggtggggtctgggagaggtcaggggaagaggcacatagacttgtctgcccctctgaggccgctgctgggggtcctcaccagtgccagggctatgaccccaatgccaagcactcgcagttggagtgtcagggtggggaagtcaggagaaccagcatctggccctctcagccctccactctctcttcccacagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctcactggctctgtttccctttgtgctttctgggaggccccataggcagccagtgcctgccggcctgccctttggactcttggcattttgctgttttctcaaattctctggaagaaagagggaaggacctgctatctgtagccctcccacgaacctggtagtgaggtatgcctggatcactatccccatttcacagacaaggaaacagagaccaagggagagtcagtgacttacccaaggctacagaacaagcaagtggcaaagcttgaatttgaccctggcacttctgcctccaccctgccttctacagggttgaggggttctggaagcaggaaatccagacccttacctgtagatttctttggcacctcaagattccctggagggagagtccctctgtctgttgtgtttggagagaagccaatctagatatggagagcgaggccgggcgtggtggcttacgcctgtaatcccagcactttgggaggccaaaacaggcagatcacttgaggtcagtagttcgagaccagcctggccaacatagtgaaaccccatctctactaaaaatacaaaaattagccaggcatggtggcacgtacctgtaatccctgctactcgggaggctgaggcaggagaatcacttgaacccaggaggtggagttgcagtgagccgagatcacaccactgcattccagcctgggtgacagagcaaaactctgtctcaaaaaaaaaaaaaaaaaaaaaaaaaagatatggaaagagggaggttggaatgcgggtcccggaatgccctaggctcaaggactaccccccgccttgctgagctcctccagagatgggcaggggtgcagaggacacagcacagcctgggacccttgttggactgagtggtgctagcacagcttgaccccacacgagctcagaagagctcagctggccatgagaaggcctgagcttgtttttcccaggtggacacaaccaaatggggccgattctgccccgatcactgccatctggccatgtccaggctcatatactcccactcccacgtgaggacaggccagggactcagcccgagaggggcccggctaaaagagggatagctggcaaggccctcccctagtggcaactccgagagaacacagacaagggctggcatcaccactccagcctccttctccttttcctctgctgggaggccctggctcccacatccacacaactagcccctcactgcaggttctgtctttgcccaaagggcacctcctcagagaggccttccctgtccccgctgtggtcccactgcggtcccactgcctgccctgcgaggccttcctgctctctgagaggattcgcgctgtctcggctcacatattccgagtcctcttccgcactagaacatacgattctttcagcctgcagcaggtgcagtgcctgcacacagtgagtgctcaggaaggatgttctgaaggaaggcatgaagggataccatgtgtctgggtttgctcagcgttctttcttttagagccagcgtctcactacattgcccacgctggtcccgaactcctggcctcaagtggtcctcttgcctcagcctcctgagtagctgggatgaccgctgtgagctaccgttcctgtgctcagtgttcttaaggaggttgctccccttctcagggcacaggggttgagcaaggccatggctaaagcttcttccattatctcctgagcctccctgtacccattagttagtcaatcaactcatcaaacactggtttcgtgagcatctgctgaggcaggctgaggtgtagtgtacgtgcttaataattgcctgttgaatgactagctctttaggtgcccacgccataaccaaacgggttctttgactagcgggtgcctctggcttctccttggctatttctttctttctcctgaaggaaaccaggagttgcgcagaccggaggctccagcagccagcctgctgcctggggtggctccttgat

SEQ ID NO: 15600 - DNA, 7960 bp, Human
gcgggcactcacccctgcccctcagtccgcggaccgtgccctctgtttctgccaactgcagctctcaaagccctttggactgccggaagcctgctgcgcgagtctgactttggaaaggggcatacagccccctgtacactgctctgccaggcagggtcttcggaggaaacccctccccgaggcttggccgggcgccgggctcggggagctgcagagctcgaaggaaccacgaggtggcgcgctagcactgcgttcgcccggcgaggcagggcgagtggacgtggggtcgacggagcgagccgggcaggctgggaactgagatttggattctctcccccagagaaaggcgaagggcaaaatggggtgtgggaggcagggatgagctagacgttgggaacagctagcatgacctagggggcccagcttggtgggctagacaggactaaaagctgggggtccccacagaggggagccattcttcagggcttttctggtgcaggaggaattcagtggagcagtacagctcccagctactggagatgaggaaggtactaagcggtctagacacatctgcctacaaccacatgttcacacgcggatggccctccactcatgctgcctgcaccccgcccccgacacactcctgcatgcatgtacctctgtggatactgtggaacacatgaaatcctcacatcacacaccccaaatacactcgtcccatgcacccagtccccaaaagtgtcccaattccccagtgctgtcccatgatacacaaaatctgccctcagacttactgaagcacacagtcacagagccagcctgtgtccacccaacctcgtggggaccccaggtcccttgctaccttcagcaagactgggccatctgtgaaactgcacatacatagctttggagatagttctggtatcaccggacaggctgtacatccccaacaacctctaaatccacacaggtctgcttccccttctccaataggatcctcctagtgctaaattatgtctttcataggctcaagacattcttgcccggtgggcaccttcctaaataaaaagaaaattttttaaattacgtttttgtaattatgtaatacaaggatataatagcaatgactgcattgctattaagataatatattaatatcatatattcaaacattctctttcacctaaaaggtgttttccttttcttctgattttaagagaaaccattttcaggggctgtgagtcctcaccactttgggtacatttgtgtgcctgtcatttgcacagtgcgtgcacacgtgtgcacacacacacaaccataccccaccttagaccatctctttccacaaacacacaatgggcaaactcccctccttgcccacctcacctaagcccatctctcatcccccagccagagaaacagactgacagatcctgggggctccacagagcaacccttcccctccacctccacgcccctccttcagagaacttatctgggctggagctacaagagtagcgagggtgtgtgtgtgtgtgtgtgtgtgtgtgtgtgtgtgtgtgtgttttgagtaacaacaaagactggggaaaaagaagagagaggagggaggagagaaggaaaagggagagagagagagagaggagagcataggagcgagagagcaaaagcgtgttttgcctggaaggcaagacttgcagccaatcagcgcgtaggagcctccctcggcgactccactattgagtctataaccggctggccgggcggagctggcagcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccaggtgagggccacggggtcgcgaggacagtgggagacactggaaggttcccgagggaggaaaaggcatggactggaagccaaaatctaggaaaacttctaagaaaagtactgtctggagttagagaagttggcctagatgaccctcagagggaccaggcgaccttccagccccgggtgtgcaagcatttggggcgcgatgtgcgcagtgcgccgcggtcccggatgaggatcggggtgagctgagagaggaaggggaaggctgtgggttgttaggaaacctccgaatcgaggtgatttcgtgggcatttcagcaggcgatcctcgatcaagtcgcagagggcttgggggtaggcggcaggggctggaaactctaggggccctcctttggataagggatggggagactaggagtcgtgagggggcaatgagaaggacccacggaagttgcgggaaagcggagggaagcagccaccgagaggcagagaagctgaaaaagggaaaagtgaaggcagcaagagggaagtatggaaagacagtgagagaaagggcagaagaaacaagaaaggaaggagagaaggaaggggggaagaagggggacagggaaagaaagaaagtctgcactatccttgcaacttttctgaaaatctaaagagattctaaaatgaaacttttttaaagggcggggggcggacgggaaggagcgagagaaacaaccgacggcgagatgggactgggaagggggcggctagcagccgggcggcgaggagccccgaggctgggaggcgagccgggaaggcgtcgtgagcgaagccgaggcggtcctggcgcaggcggcggctggcgccggggacagtgctgcggcggccgggcgcggagctgggagcgccgcgttgtgggccgcggccagttctggctctggggccgcggctcccccctgggccgcgggcagcggagcgcgcggccgggaatcccgcggcgagtcggtgggcggaagcgaggggcgtccggcggggccctggagggtcgcaggagtcgcaggccgaggctgaaccgccccctcttccgcccggtgcgttccccgcagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggttggtgtttggctgtccagggccgcgggggcgcgcgggaccccgtagttccccgcgcgctgccgagcctggctggccactgaagggccctgcgggctcctggaactcttgcctttgggacgggggcctgcgaggttcaacttcggtgggaaggttctgcgttagcacgtgtacaagtgagcatagttgtgaacccgtgcaactgtgtatgttcccctactccagaattcccagctcccaagtcccccagcagtgctagtcacttagtaggagtccacatcgtgttttccctccaggctaggcatgtgtgcagactgtctgtgtgcatgtataggcgagtgtgtttgcacacatgctgtgtgggtctgcatgcaccggaggatgctcatgtaaggagtgtgatcctgccggggtcattgtgcataacgatgggggcatgtgtgtgtgactgtgcgccctgaatgtatatgcgttctgaatgcatgttcagaaatgtgtgcttgcatcaaaataccacattcctgctcagcacttgaacgctcaagagaggccaaattccctacctgaaggagatggggactcaaaagtgagtgccgcacccccaccctcatccagtccctaaagcccccagcagcctgtcactgctcaggggaggagcagtggatgcctggctccctccaggtgttgacaggcgggcctaggttgtggctgtggctgcgtggggccccatccgccgggaatctgggtcacctggtgaggagctgattcattgtttgtaccagtcatggggtggggagtggcagggggagggggagataccccaggggaaatttggggaatcatggctcacctgctcctgagtccccaggtcacccccattatccagcccgagcccaggagaacttctccacacctgagtgtgtgaatgtgggtgctcatgttgtggggtgcttatctgggtgtatctgtgtctgcgtgtatttttattgtctggtgtctgtgtgtgaggctgtgagtgggaacgtggctgggtatggagatgtgtatgtgggtgtgtttgtctctgtgtatctgtgcacctctgcttatgggtgtctaatgtgaatgaaatgctacaaaccgtccatctcccacctcaacggccttttattgagtgcttactacataccaggctgctttaagttttttatatgtcgtaccttatttgagcctcagaatgaccctatgaggcaggtaatagtgctgttctcatccccattttgcagacaagaggaagtcaagaacaagagaggttaaacaacttgcccaaggtcacgcttagtaagtgacagagcagaatttggacccaggcagctgaacgttcctagccacaattctatcccagatccaagaaactgggagtcaggaggcctgttttttgcctgattcttatgtgaaattgggttctggcctttctttttcttggctaggttcttcccagggttgttttagcattctgagaggctaactagctacccctttcttctctggcccaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacatgccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaataaccactgagctctttgaactggaggctggtggcagctcttgtggggagggtctgagagttggggaaggtgtccagtgaggaggcacttctgcgctctgagggagacggggcccctaggaaaccactactaaggtgctgggctgggcctggcccctggtggcaggtgctcctgaaaccatggctgtccccaatctgggcaggtctttgggggaggctcccagcagcagcttccctgactccactgcttggcagcttggtgctcagaatcagacagctccctctgcatcgccgccgggtcacctcagggctggtctttgatctggagctcacatgcagacatgcttgcacatgtgtgtaaccccctgcctccacgcccaggcactcctggcccctcaccctcctgtctgtccctttcagcttggggtgagggtggggcctcagtcagggggacacgactgctccctcagtggggagggacctagcactgtgatccaggcctggtgatgggggaggggtctgtgtttaattctcaaggagggctcaggccctgactcagagccttttccctgccgccaccctcctcttctaggtgcccaactccaaggctttggagacggagagctggaggtggcagaatgaacggaggtgtgtgagagtgacacatcttggcgcagatgggagacagcgtgaatgcatgcacacgcttgtgaagctacctctctctcacatgcatgcatcaagacacacaatgacatctccccatcgtcacacacacatggactcccacttgaggcaaacctgtcatctgcagacacatccacagacgcaaacacacacctgagacatgttggcatcacacgaggtacaaagccaaagccataatactccaagagatgcgggctgccaacacaggtgcacagccacacatcactcaagtcaccctagcatcagacacacacacacacac

SEQ ID NO: 15601 - DNA, 70308 bp, Human
atcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtgccgcgggtgcctcctacccgatctccattcgatgcagggtgcttaagattgggttggggagttttatgctggatttttcttgtggagggaaagactgtgtcaagagcttttttagcaagtgggggatggggttaagctggtccaggttactcctcccctttcacaaataaagagtgctcctgcagaccaggtatgggggactgcaggcccgcgaaagtcttgaggggacagtaatactgtcagtgtgttcactaaggaggactcgggtccaccaccccagcgtagactccgcagataggtttggggaatgcaagccccacattccagggagatggatttagcactgctccctgtctgcccaggctggagtggtaggggagaccccagcccagtcagaccctagctcaaagcgccacttgacagacgcctggccccaagctccctggcgggtcctgccaccgggggaaggaaaggtggaggggaggtgttgctgccatctcaggtctggacagcttctctgggctccttccttccagctcagaggttcttatagacccagggtgggagaccccaggtctcccttgtagcccctgtgagcctagcagggactctgctttggggaaggggggtggaaggttggtgccgccctcactctctgcagctctgctgcctctagtgcgcaaagcagggatgagcttgtggcccccccacccccatcctctacaccttgtgggtctttaggaagctcccctcatcacatcctcttctcatccactgccccttcttcctttctctctgagctgcagaaagagaggtgcaggcctcagaggtctgtgttcttgctgaataggcacaatcttgaggtttgagcccccagccccaggcccctttctcccaggcagggatggagatggagaactgatatggctggaaaggatgggttccgagcaactctcctctctgcccctaatcatttaccccttccacgaatgggaaaaagcatcaacctctatgtcctccttctcaagggtcccaggggaggtagagagagctcttctctcccctctccctgaaaacagacctctaggctagcatctcttctcgcctgccctatctccaggtgctagtggagggtctggaggcagactccttcactgagtggtctggacgggggcaagtgttgaggcctggcatgggggaggagaggtgggaggacagcactcaccttgggagttggggagcagcttcccccaggggagtggtagttgggtgtgtggcatcagcattactaggtctggagaagcctgggttggctgaggatgggttgagaacaattttttggcaggggactgcctaagctgtgcccctcaccactgccatcctacccaagtaccaagagacacctgtatttttgctgccagaggggctctgaactgcctccagggcctccctctttctctttgtggtatctgtgactccccacaggcttcaggagggtccctgtacgcctctgagccggagggacataaggacactcccctccacccccaactaactgaagctagttaggcttttcttggtacattctgcttcttggcctctcctttttaagggaccaggtttcctagagaggagatctagacccaggtaggaagtgtgtgtgtgtgtgtgtgtgtgtgtgtgtgtgtgttgcaagggaggacagcaaaaggctcagaagtgcaagctttggtgtggagagcaggggtactggcagacagtcacccctgcctcagatcagaggggagcatgctggcctttccagtatgtgttcctgcaagtgtgagggagcgcgctcccctctcggggaggagttcctccgcattccctctctggctgttgtgtcacatctggaagtttgtgtaggagtttctccaagctcagagcccagcacagctttttctcatttggaaatcacaggctggcatttgggatgccgagagagggggagtgggaggggggccagagggggagaggggagcctgccaggagtcgggggaggagaggggggggaggcctgaacggcaggagccctaatggcttccagaagtgagtgtgagtgagtgactgtgcgtcactctgtgtgtctgagtgtgtccctctagaggggtgggggcacaggagtttctggagccttccttgccacactgtcccaatgccccaagtctgcctatttctcttacctagggagaattctccatttctgtcctcagaggaaatggtggggggagtgttcttcctgtctcttcatcaattccctcctccaatttaatttccaaaccctaagctcaccagaggagattctggggagaagggctggggctggagaattgaatgggattgagggggggccagatcaccccttggcatgctttctgccccaggcccactttccttctgggtcacacacacattccttcccacccgctctgctccaccgctctgctgggggactccccatcacccgtagtgccagttggagccattcctgggattacccccaccacacagccccccccaccctcgcctgctcccgcccagcactcaccccgccctgcctgcctcagccaggatggcgacagacacaactgctcacacgcagacatgcgcacgcgcgcgcacacacacacgcgcacacacacacacagagtcacagacgtttgaatcagatttctggcctatttccccttccaaagattccagcgggccgtctctcttgtgtctctgtgtctcatgtctctgtctctgggtggagccggctgcctttctgtgagcttcagttttcaattcagctggaagcctctctccccctacacccacgcactgaagcgtggtgaggggggaaccacagggaaataggcttgtggggtgggggggggggttctgctgggggaatccccctttgagctttggagcagggcggagcccctacatcccatgttaccctaggggttgccgaatccgatagacaccaggagcctctctgtgggatgggtgaggcaaggacctatccccctacctcctcatttactagaaggccaggactcctgggtccaggcccattttctcctcaacgttccttagtctcacatttccaggctcctaggtgggaatggggccgctggagggcctgcttgccttctcagcccatgcccagagcccctgtgcccctagaggtgtcccagccacccccctcctctccctactttcctcacccttgcggctgccaggctaagcaagggctctatctagataaagccccacacagaggactcatttgtggagataacatgctctagttctctctcccaggagggaggaaaggaggagggatggaagtggggttcctctctctgccgtttcctttttctctgcttttgatggtgggttgtggggagaagaaagatcctcccctctcctaccccctctttgggatccactccagcccggacagtcaccatagcaacagtagacatgtgactgcacaggtctctcatagtcactatggcaaccagtgtcccccgttcccttggttaccatggggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccattaattattcctctattcagagtgtcccaaattgtcgtgtgccttggtctcttccctgtccgtttatgcttacgtgtcgtggaaggagagctgtacagggtgggcaggatgttacttggaagtaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataagcagttcacctctgtcaagggaaacaaggcaggaagacctgaatggggacacacatctggcttctaggcagggagacttattgattggttgattcgttcattcattcattcagtcttcccaggtattgatcatctgctccgtgccaggcactacagcaagctccgtaggggatctaaagacgtatcagaatgcccctgcctgtcaggagccccagctcagcaggggaggtcgacaagtgcacagattactaacacggtggaactctgccattagaggggtccaagcagatgtcctgggagcccctcttcctcagagatctactgcctccacacagagacattcactcactggggctccttccagacccccctttccctgcagaggagaggaggggacctgcatggggaaagcagaccagttcttgagggtaactgtgtctttccctttccaaatgatggctcccttcctgtccccctttttccagggtgacccctggctgacccccattctggggagagatccactgcactccggctctactcagaaaaacaattccgtggaaacagagcactttttatttcctccctgtcatctgcctacccccaaaaacctagaacttttttcttaaaccctcttattcttgtgagggggtgggggttagggaaactgcagtgcattaggactctcggggtaccacggacaggtggcgagcaggcatgtgagtctaggggagaagggcctgggtggtggagaagagacaggggagggctgtcaggggtttgagggattcatgggctatgggggagggcatgtggcttgggagtcagaacagagatgggctatggctgggaccagctgggaggaaggtccataggttcctgaacattcctgctggcctcttcatgcctggccaaagccttctcattccagaagcaagattccacctgctctgggccctacagagtctggcttggtgggtcatgccaggagctgccacaatacctcccccatccccattccccagggggtctctggtctcctttccccaatctcctgctctctgatcttttctagcctctttactcttccccacccttctcatattttccttaaagaaaataggatacttggtcatttaaccgtgagtccagtgcctggaaccttctaaggtccggaggccgttttgtacattctcctgctgatgggctggaaatgagtcaccccatagaatccactgtatggaaagacccagggtttagaaagaacccctctctcctgcttgctgttttggctggtctgggctggaagccacaagcaggtgtgatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagcagcggggactgcagctgtggacgtctgccttacacctagtgccagggcggtcatgacaggcagttctgcctgcctgagcagctatggtgtgcagaggaaactatcatagatcaggagcttggaaaccaccgtctcatcctgccttctcgggtgaccttcagcacatgacttcggcatttctgggcctcaacttcctcgagttctggggaagaaaatgatctaccccagatatttcacagggctgttgtgagcatcaactgtggcattgtgtgaaagtgcttggtaaactgtaaggcaggcataatccgactttaggtttgtataacacattcacatacagtatctcatttgcttctcacatctaccctgtgaggtagggagaataggattcagattctgcagcaaactcatggtgtctggcatttccacaggcatgatcgatttattccccaaatggcttgtgcaaatagtcagggtatttgtggcttgtcttcctttacagatgaggaagctgggtccagagaggtgagatgaccaaggtgggactccccttctctgatgaggagtctggggctgggggctggtctgcgtgtatgtcagggccctggcaccacacctgcttagcctcagatggagccaggaggtaaacgaggaggaggtgttagggcggggtcggggggccggcctcagctccagccttggccagctgtttccttgactgccagtacctggtttgagcgcatcagcatgttggtcatccttctcaactgcgtgaccctgggcatgttccggccatgcgaggacatcgcctgtgactcccagcgctgccggatcctgcaggtgagtgtgtgtgtgtgtgtgtgtgtgtgtgtgttgtgtgtgttgggggttggcccctcttaatcttaataccctctactcctctgcaagaggccctgacccaactggtggggactagggtgggactagagggtattccctcacccacgtctcagtttcagccacctcttgtccccacatcaggcctttgatgacttcatctttgccttctttgccgtggagatggtggtgaagatggtggccttgggcatctttgggaaaaagtgttacctgggagacacttggaaccggcttgactttttcatcgtcatcgcagggtgaggacctgggctggggtgggagagcaatggatcagatcggtcccttccccggggccagggttctgggcctgtgacctctcagctccagcccagttacagcaccactttctccctggctatctcctgagggtctgaggctgccctgcctctagcactgtagcctatattctaaattccaaggccctattcctaattctgcccccttctctgatgggcaatctgtccttgtctcggggtagccttgccccccagacagagagccggatcttcagggtcccttggtgaagaagaagaaggagtcagaggtcatcctgctgcccctaaagcaggattcctcattgacctcttgtgaccccactgtggcctcagactcaaagggcctccctttgggcccctccctgcaggatgctggagtactcgctggacctgcagaacgtcagcttctcagctgtcaggacagtccgtgtgctgcgaccgctcagggccattaaccgggtgcccagtgagtgacccctcagccctcagcccctgaagagagccccaggaggaaatgtggaactctcagaccccacctctactactgtgtcctcacctgacccctcacaggccccgtcagagaagggctcagtggggagctgggattgctggaacaaaatggaactcctgaatgtggcactatgggagttacctgggaaaaccccacctcattttagcctggctttaggtcagagtctcagaaacatctcagatgaccctcttccttcagctagatgaccactccccccaggaggataggggtgtggggactggagaggctgacaggcaaggagtggacgcaaagtgctaatggccttttctagccagaacagcctctcatgcaatctggttcttgctggtgagacacgctggccacgctgaacgtgacttctctcaagacaaggccactccatgtctcaccctccgcctctgtccccttcctccttcccgcccccttccaacccattgcagtaactgccgggcccattatctaaattaaactgcattggtttctggagccagcgaggctttggcagctctagttctccctacatactgccccctccctttgctcaggccccctttgcaactccccaacctacacaagctgcagatggtccctgctgtggtcctaggagtggggtggttggcgaggaatgcatgtttctggggctcagtgcctgtttgtgtacctgatgtagcagcagccccctgcgctctgtgtgtgtgtgtgtgtgtgtgtgtgtgtgtgtgtgtgtgtgtgtgtgtgatgttgctgctgcccctgggagggcagagctgttgaatgtgtcctctggggctcggggtgtgttggtgttaacaggagctccagaagaggggcatgcctcgcctcctctcccgccccaggtgatggctggcagatttataggcctctgtctaaccaccggtgtaattcccttaatgcaaaccctgaggaattgatctcagttggagcacagagaagctgaagggggatggggtaggaggagggggagggagactgagtgagaaaactgggctggcaggggcgaggctgggcgctgcagtcaccaagagggttaattagctgctgcttagcagcttttgccctggaggggccagggggccatagatggcactttgggggtgaagccagccattagagatctgtctgcttgacgagggcttggcggactgggggctggttcagaccatttgggccggttgggttctagacctggagtacggagagagggaagtaaccctaacagggcttttgaggagggggtttcagtggctttccctatggagggggttgtaaattgatggacttctgagaagacagtattgtatctcttcaggtcctgatttggggatctggaccaagcagggaatagtttcagggaagcagggctcagagccatagtgaagcacagggcatcttggcccctgcctaggagctggctctcaaaatgagattcctgcctgctgtcattcctcctggagttcgctgcctcagtttccctaatgactctggtggtgataacttagaaaggtcaagtgactgtgcctgttgagagaaggaagtaggtagggagtgtgcgtgtgaatgtgtgcgggtgtgggtgtgtgttggagagggattcggaagccaaagcctgggttcgagttccggcacctacacttagcagctgtgtgatactgggtgagtcaagtcatttctccaagcctcagacttctcatctgtgaattgggagtgatattatccacatgtgatgatgttgggagagttaggaggggccacagtttccccagctcactgttggtggtactgtgcagattaccgtgggcaagccacaaggggaagtgggtcggggcaaggggctgcagaggctatctggggagtcagaggtgtctgttggtctcccctccagcttgagccgggccgtctcagcctcagagtccctggtggggcccctccgggagtgctgccgggccgtggcagtcagcctagcccggccagcctggtgtccccagcgtggcttctgcccccacaggcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctgtgagtggtggacagggtccagggaggacctgggagtggttatggggctgggcacccccccaagttcctcacttccggttgctactgacatatctgttctaacatctgagacatatctggttctcaaacttggctacccattggaaccacctggggagttttaaaaagtactgatgcctgggtgccacctccagagattctgatttcattgctctggggctcagcttggatgtaaggattttttcaacccctccagtgatcctaacttgcagtgaaatttgaaaatcactattccaggatgtgaccttccaacatcctgagtctggagtttccccactcaggcctcatgctcctggtgcccacaaatccctgccctgcccagtcccttccccattcttggttctgccctgctcaccctatatgcctcgagcactcgtgccatctctcccttcctgggccctctccctggagagcccactccccagtctcacccctgttccccttcccatcctgcagccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtggggcagcctgggccccgggagcttccccagaacaccagccccaggacacagcccaggatcggagtggtcgctctcagggttggggtgggggtcaaggcctctggaggagactgaaggaggatttggtgggcccatagtcagcctgcccctctgcaccccctaggtcatcacgctggagggctgggtcgacatcatgtactttgtgatggatgctcattccttctacaatttcatctacttcatcctcctcatcatcgtgagtgactcctcagatccccgtggggatgggcgatcctggggacacctgtgggggcagtccagagaggggatagtttgctctgtctgaagtttttagctctcaggacaagtcctgtagagagggcatccatcatatagtaggagggacaccagatgcagagtcaggaggaaatccaaggtcaaggcgggacttaactgctattgggaccttgggcaagtcattctccatgaggcctccagcactgctctgggcctctgtttcttcatgggtaaaatgaatggttctcaacctgagatgataccacctctcccagagggcatttggaaatgggaaagggtgattctggttttgattttttttaatagctttattgagacataactcacatatcattcaattcatccctttgaatgaatccagtggttttttaagcatgtttacagagttctgtttttttgtaaggacaaggggagtgcaattggcaatttgttactgggggaggggagagaagctaaacatcctgaaatgcttgcaaataaagaattattctacccaaaattctgatcagtgatcaattggtgttaaatgctgcctgatctcttattcctgccagttcagaaattgccagactttaagaaggcagaagacggaggcaaaagcagcaatatttaatagttttaatcactaccattcatagttaataacttcatcgccaccactttgagctaatatttattgagcacttactatgcgccagcccctgatctaagcactttcaatgtgctggtgcatttaatcctcaccgtgatcctctccattttacagatgaggaaactgacatttcctcatttatctgaccctaccagacgctttgcctatgctgtgtattaatctccaagagtggggcatcactgctgacgtatgctgtaacatctgctgcctgtttaatcctcgtcgtcccctgtgaggtgccagggcagggattgtggtccccatctcttaaatgagaattcagcgccccagagggtgggtcactgggccaagatcacacagaaagtaagcggctggggctgagaattcagtcccaggctaacgactccacattcagcctttcttccatgtcaccaagaggccaacgacagagccagacagagggacagacattgagagaaagagattaagaaagattaagatctactcaggacctaggactagctccagagagagatgaagacaaaataaggcagctccttgtgagagacagagggtaggccctgagaaagagcaagtccccaaggccacctcattctgcctgcgtaacttcccctggtgcggaagagtgggcaggcttggggcgaagcctgactggaggcctgttcccatccctggccaccacctcaaggggtgaggccagtgcttcagggaagtggggtcttctcaccatgtgccccccccacccccactccctttccctcctgggcttgggagagggggaaggaagcagacagggagataaggggcctagtttccaccctcccacacaccccctgaaaaatctttcctaacagctctctggaatcacactagtgaagctaattatcataattactaggacacgatctagaaaaaaaaaatctgctttgtcaccataaatattcatttccttcatttgggattgttgtccaagcaatggctgttccagagttctggggaaactgaggcgtggagatggggactggggtagtgtgagcaagtcaggtggcagcctgactagtctgtagggtcaagggttcagcccctcccacatctgagggaggggggcacagggaaaatggggacagacaaggccaatggtccctgttttcagatgaggatatgaggtcccatggctaagggtctctcgcccaaagtcacacagctagaattggggctagaagcaggagtcttgtaaatgatgtttttgtcaagatctcaaggctcaatataatttgaaaaccccatgtccctaatattgcgttcatttccacagcattcgctactcctaatggaaattgcggaaggggtgctgcgtctctgcaggtgtgcgtgtttagggacagggaatttgagagattgcaggataacaccatgttcaatagcaatatcttggaatttcatagagcttggttccagtcttagccttgctctgaattagctgagtgatcttgggcaaatgtttgacctctgtggacctgagtttccttacctgtctgatggagattacaatagcatcacctcctgaggctgtcttaaaaataaaatgagataatgcttggaaaataactgagcgtggcgcttggctcataggaatgcctccgtatgtggtggctggcattgtgattcacttttcttcaggacatttcctcttcctgtccccacccctacaggtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgagaactctgggtggaggcatgtgggtgccctcgtctggggactgggtggcgtcccagaggggactagggggtctggagtcagagggaccagggcttatattctcatgctgcctctcatggcttaggcaccttcaaccagtcacatccctgctatgagctcgaattttctcatctgctaaagtggaactcataattcctacattgtaatagcagtaactatcatgtaataagcacctgcttcgtgctgtttgcaatgatgtctagcaactgttgcacacagcaatggctgtgtgcctgtcacatgctttgcgggcaaaattccattggatcctctctacccattaagtgataggctttcttagcatccccattgtgtggatgagaaccaggaggcttgaggggattgcatgacttgcccaaggctttgctattggtgaggggcggactcggggcccgcactcgggactccttgttgtgaggctcagagaggaaatggtgtgtgactgtgcccagcttcatgccccactggctaaacctgagtctcattgcctccgcacagggagacccagttcagggagctgcttgtctgatgggtgacactcccagtgtcgtgggggcagtgagacacatagggacgtcgggctctccccagcagacaggttcactgtagctgcagcccacggcctgtgtttcaggaaggatgtggcacgtggggagcagcgggatattcgtggggatgttacgtgggaatgtgggctgggaccagaaggtgctatcacagaacccagagcgaaaggtttctatgccagctcctccactaccctgccacgggacgtgggccagtcacatgcacccacgtttttatttcctcctgtgtaaaaggcaaggctgggcccataattactctcagtgggtgcttactgactccctcctgtgtgcagatgcagtcaagggagaaatgtcgctgagagcccacctggggccaggccctgagcggggggcttccacatccatgctttacctggtactctctgaggttctcatattctgtgatcaaagctggatttaaagggacattgatgtcttgggctaggtccctgagtgtgtgcgcacgagtgcatctagtatgcgtgtatgcgtctatgtccatgaaggggtccagtgtgtgtgtgtgcgtgtgtgcatgcacgtgtctggtgttcatatgcatatgtgtgcacatgtgcttgatgtgtgtaggtgcatgtgcgatgtgaagctctttccttggtgtgtgtgcatgtgtgcatatgtctggcatatgtgccgtgtgtgaatgtgtttgtgcacacatgtgttggtatgtgcatgtatgtgtgcccatatggtggtgtccaaatagtatacatgtgtacacgagtgtgcgcatctggagcacgtgtgcaggtgcacgtgtctggtgtgggtgtgtgtgcaagtgcacgtgtgtgggcgtgtcttaaggatcccatggaaagtgctgctcagaacagtgttgatgtagtcctggcttctgggaaggggaaggggagcgaggctccttgctgaaggcacctaggatataggagctgtccaggacctcagaggacatccaggccacctctctgagccccaggacactcagcagtgactgtcaatgaagtgctattgacattagggcatcttgtgggtcaagactgcccaccttgcctgacattcagcacccctggcccactaagtgcctagcaccccatcactgtaacaaccccagactccctgactcattttacacatactcacagggcagggtagccccaggtacgagactctggagcctctcacctctactctcctgttccaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcaggtaggagagtgggcagaggcagggctcctgccagctgcttttcgcctggggctggggccttctacctccctccgcacccctcctcctgagctcagcttcctctccatgctgctagcccacctggcaggtaggaggggaggtgggtgatggagcaatgcatggggattctctagagggagtgcttaaagtctctgagtatggaggtcgcctcaggtaggccacagggtatgttctacccaggaaggctgctcagaggaggctggctttgaaggatgtgaacaagtggtgagcatcagcatgtggggagaggcgcgtcactgggagatgtttgggtctttggagaaggtgtagtgcggagggcgggtgttggaggtcctgtggcatccatctgacccactaagtccgggtgtgactgattggaggcaggaggggccatgtaaacaggggtgcagaggggagggttggtgcctgcgcctgggtggaatgaaggcctgttggggtcagggagggaggcaatctttcctggcctcccgtctgggagccgtgctgtgaaccagggcagctcagggtggatgagagtgcccagcatggcaaggggacttgaagccatcgcgtttgaggaatgattctaagaaccgggatgtttagttaggaggagcaagggctcagcagggacaggcaagctgtcttcaaatatttgaagggctgtcatgtggaagaggaagcaggcttgttttgtggggctgatggctacaagcaataggatctgggctgagggggaggaggcttttctaaccctcagagctatgcagagatagaaagggtagcctgggggaccccactgatcccccatcatgagctgaagatgcccgcttgttgggggtccaagcaggcaccatgggtcctcacaactgggtttggctccctcttccacagggttctttccagaagtcgctccccctccccccagtctggcctttcaggtcacccctgtggctgattcttggaaaaggagagaggctagcaagcaggtgctgcagttcacggtcctcccaggctctgttctcctgggtgttctggcctccctggggtagcacggaggcactgggccatcagaacccaaccttccctggtttggaacgaaggccatgcacctccccacctccgcaccctcccaatcaggagcagaggcggagggggccagtggtgtggagtggctcttacaccagcacagcaccctgtgaaaggggcatctcaaaaaggtggtacaggcagggtggtacaggcatgctgggaggtctgggttgaggctgaggggcacaggtcaagccgggtctggagcagacagtgaggtgttcacttttccgggggattcgaagcccgcccccacaccactgacctctgcacctgcaatatttcgagcacccagcttttacccaagactgctcgacctggccaggtgcacccctccccatcaccatcacacattggcgtcccttcctctaacctccacagggccccctccaagcagccatgaggtggagagagagtgggaccctggctgcagtgccagcgggtgggcgcacttgacaccacggtgggcatgttgtgtctgggctacgtgggtgtgggtgtgtgtgcacatgccaactctgccagcctcccagggagaggtgctccactctgccagattggtggcagtggggggtgggcagcattttctgcttccgggacccaggtggtgacagcccctaacctcccattactcaggctccctgaacctcagcctcctttccctcacccctgttccggccatggtcaggtgcccctcccccagggggcacctccccagtgccccctccctaccccggggggagcacccagcagtccctgcccagccgatgctgctggtggaggttttgattgcactgggaagaagctgagtcacacagacccagggcagatgaagccttggtaagagggctttcagttagatgtcaagaaggacgcccctttggagagaaggcagcagccgtcagtcaggggtgcctgcaccttcttcttgctcaggctcctgaggaagggcggagacagcccagggctcccactaagtcctcagcagcagggaggcctcactcagtgacagcagtgtctgctccagggagggttttgtccgcatacctggtgctgagggccccatgggggtgagcgggagtccccagcaggctgggcagatgactgacagctgtccagcgggctcaggggtgcggagagtaagaagtcccagaagctgccatggccctgtgcttgcaggcactgcggcgtgaacgtcccgccatctgggccctggagcctgagcaggctgggagtggggggttgccagggaaggcagcaaggagatgtggggggctgagacagagacacagagtgggcacagagagggagacagagacacatgggggaatggggacacagagggagacagagaggagactgatgggggcgagacagaggcacggagggcaagatggagacgggggaggagggcaggaagagagacgcgcaggcaggggagaaaggatatggagggagagatgagccacagcggagacagacagagacaaatggagccacagagacacacagggagacagagacacagagagggagctgaagacagagaccgagtcccagatgcaaatgagggcagagacggggtgggatggggagacagagactcccctggagctggctgcatgaggaggctcacggcttccctgcggtgcccttaatgaggcaattgtgtccattgatcccggaatcgattggatgggggggcgggcactggaaagggtgttgctggtgctttgccagaggaggagtccctgccctccctcctggccgtcaccgctgccctccccaggccctgtcctctcccaccatcccctggctgactcatcattcgcttgtcccgtccccccaacctgcgctaccccaccatcctcctgactgaggaagcacctatatgtgataccccaccccgcccggggctggccccatgctgtcctctgtctcctgcttcctccaccccttaaccaccagctggaggagaactggcaggattgggtttgcccagagggctggtgagaaggacaagaacccaggagactgaggagagagcaagaaaatgacctgatgtcgaagtgtgatctgatatggggccagcctacatgtgtgccccatccgctcagggcggtacatggagtccagaacctttttccaattcatccttttgcactggagttgggcctaagcagtgatttgctggtaaatgattaacaactagcccttctaaaataataaagtcctgatctgtagcatttgccaatttccatggtgtaaatgctcccaccatagctggttttaagctaccaacacgattccaccgaatgtggggttgggaagagacgtggacaattggttctcccaagccagtgagaaacagctccagcacgccactgggcccaaggcactgtccttctttttaaagaggtcacaacaagtaaacggtcatatttacttgatgtggcacatgctcagagagggatacgtggaggaggagcccttaacccagaccagagaaggaattcagggagggctccgtgtaggaggtgacctctgggctgagtctgaaggaagagtaggacatagccagtgaaggtgaagggcagggcacagtatgagggctccggcagtggtccaggcagttcatactacatcttcatccctggaaatggagagcagagggctggggagagctggctggtagctggatctgcaggacccaatcagttggaaacatgggttgagaggaggcagcaaggatgactcccaggtttctacctggggtgggagcagtgtggcttgagcagatgtgggctgggagacatgttgcatacaaggtgcctgcgggccatcctgaccatatccagcaggctgtcggagctcagaaaagaagttgccttctcttctgtgtcctgcctggctctgcactggggccagacctctccaggaagaggggagtgcaggagtggggccttggagacacaggagcttcctaacatctccttcctggctctgggtcatggtggggtgggggacaggtgctagtctaatgttctagaagagggacaacagcatatggggagaggggagctacatgtagcccagtggtctcctgggctgtagacggggagaggagggggagggaccagggtagatggccttgcaggctgagagaggacagggcaggtgatgactctgctcattgctcacactctggggccatcctgtcactccagatacatgtccagagagggtttctatttataagtgagtgagtttggctgttcaaggcgagagaagctgggggtggggcaggaggaggtggtccagatatggtaagtctgaactttgaaggaggtcatagactccttttcagttctgctgaaggctggggaccctctccccagaaaatccccatatgcctggacaccctaaatgtggcctttgagggcaaaggttgatggacacctcccaccccagccagtcccttggtctccagatagaggagccctggctgaagagctagggctgaggaccaagcagagctttgggggatgatcctttgcagctgactggccccagacattcaaaggctatctggtgtgggagggagaggggcattgttttggagatgtctgctaaggtgttctcttgttcttttagtcatcccctggctccaggctctcccagttctgcaaacaaggggagcatatcctgtgcacagcacactagaatagaatattagaatatcagggggttgggggctgagccagaaacacccaagaaatgtaggttctggtggaaaagtcattctgtttcatggatgattatgccaaatgccgcaagagaggcttcaggggacaaaggagagctgctcatccccagctctccttcggaagggcttcacgaaggtggtggcttttgaacggagcctcgaaagatgaatggaattgacagtggcttgggtggtgggggtggggggaggtgggagatggaggggtgggtaggagcagagagatctaggtggagggattaaggcacatgcacagggtggcactcgatgctctgaaggacagtcaggttttcctccctgccctggccccgaggtgtctgagcagtgattgatgttagcccagcgaggaagccggtgcttcccattggtgcaggctgggtggaggagggcctagaggctatttctgttgttcagatcagaggcaaagagggccccaagtaaggccatagctatgggaacgaggggctgtgggtaggacgcaatttcactggcaggttctctgggccggggcaccttagtgtccagagggaggaagggtgggcaagaatcctagataacccgaagtttctaaggcagaatcccgagcatgatggcgccacccgggaaggagcaggtttgggagaggaggcgagagggtttgttttggatgcactgagtttgagatggctgtgggccatcccaggagggagatcaggcaggctctggatctctggatgagaagccaggggcttggagagattgtttagtgtcgtctacaccccagtgacagccagagaggtaggagtgggggtactggtggagggagcgggcttagactgaactctgaggaatgctggcctgagggaagagaggcggtgaaatgagcactgggaaggggaagaggtggttgctcagggtcggggaagccaagggaggctcagctgctgctgaggcatccactaagaggagggctgggaagagggtccctggacagagctggagctgtggggcccagagttcagaactgaatgagtctggagtcccacagaagctttctgcttttaggcacgggggaaggagattggagaagtaatggatgcaggcataactgataggccagggcccaggggagccgggggcgggggtagggggtgacaggggggcggcgggggagcacatcaaagaatcaaagtgcaggtggaggaacggctggctcccttccaggagaggaagagagacagtgggatgcacaacacagagctctttggaggagggacgtggagccccccatgtaagcctgcaacgaggggccaggtggggagtagggctgggggctgcagagtccagaaggattgaggcagctcctgggggagagaggagacctaagaagggaggaaccagggactgtgaataaaggcatgaaacagccatggggccaccacccacagggaatcacttgtccagtcagcacatgttcgtgcctctctctagcgatactcagcacttccagagccgcagaggagaggaggagggcaagggcacttacctgggctggggctgggcagggcaggagctcttgaaagtcttcgtcagaagggcagcctttatgtggcctactgtggcccaccatgggctagacgctgtgcaggtggacaaggcacaggggctgcagctccagcattttattatttatttattttaagagatggaatcctgatctgccccctgggctggaatacagtggcttgatcatggctcactacagcctggaacttctgggctcaagcgatcctcccaccccagcctccccagtagctgggactacgggcacctgccaccatgcctggctatagctccagaattttaagtagcaggggccttgggtcagctgtcttgaagctgagtgggcaccgtgagtgtgctgtgcctagttagcttgtgtgtttacttttgagggcttcggggagctgggaaatatcatgtcacctacaccccaatgacagtggagaggtgggagtgggggtgctggtggggggaataagcgtagaatgaactctgaggaatgttgccctgagggcagagaggcagtgactgtggctaaagcctctccttggcactgcctctgattaggaggccctgggggcaccatgacacctagcagtgtgcccagtgggcaggagggcacaggaggggggatccaaactggagagcttccgggggctggggaagaccaggaccatgatctacatgatgaggcctgtgagatttccaggaaacctcctgccaccgaggtgttccctgacttcccacacctccttgaagacttgcctcccactgacccagtgaccctcactgcctcactgcagcctgtctgcgcccctgtcctgggtgggtgggagcagcaggcaggcccatcagaagcagaggtgaggtgagctgaggagtctgaacagaagagcagagatttcagggtcagtggagcaggtggaagctggggcgatggcagctggctggggtcgggcttgggcagagcacgagtgactggtccaagcctctgctcagctctgacgaggcctgtccagcccctcatgacctctctgcaagaggcacatcactgtctgccagagctggctctcaggcctcctgcctggactgctgcagtatcctaattggtttctgtctctaccctccaagccgtccacacgctgccaccactgcagccagattaatcttcttcatacactgctttgtacatctccttcctcccttcccacccgcccccagggcctcagtggcagcgtggtaggcagagacttgtccagagggagcagaggaaggctgttccacctggccctgccgaccttgtagccttctctcccaccagcccctctcaccctctgatctgggcagacaacttgattcttggttctgcactgtgccctgcacaccccttcccttgctgtccccagctggggacaccctccatggacatcctcccaggctgtcctccccactggcccactgacctcagccgggattgagctcccgtggctcctgggttttgcccccagtgtggtgtttagttgcagccttgcagatatcggtcctgccttctgtgagcttggccctggggctggggtttctcacagcctttcactcctttgttctgtagagcagcctcccaggaggtagtgttaccctgtttaacagaagaggccactggggatctgagaggcaaagggaattgcccaaggtcacataggaagaaagtctcagagttggtggcacctttctaacaccagtgtttggcacacagaaggcacttttagggctagttgatggagcagctatgaggcttggggagccccggtgctgggaagtactgagcagcttaacgctgctgcaaggtgacagccggaggggaggggagtggaggtgttaggaaatgggagatggagatttacagtcaacatcagcacagacaagagacctgggacctctgggtgggataagctcaggctgcctggcctcatttcaccgaaacctccactgggccttgacatctgtgaacagcaggaaggatgcaggctagacccgggaagggacttccacagctgggggtggccagtgaggggtggctggctccagcctgatgagtttgtgtgctctctgtgtgagctctgtctgggtatatggtgggggcgatgttgtggaaaaggtcttgagggcagagatgtagagggaggcacaacggacctggctctgcacctctccaggagggtgatgtgacctccatcaaggcaccatacccctcggagcctcagtttcccagactatctaggaggctcacagccctccctcgtttgttgtgagcagggaggaaatgaaatcccacgaggaggtcttcagcctagttggcctgtggtgggcactgccagatgttggctccacccctgccccttttcagccgtaattacagctctggtccctggggcaactttgttgctaagattgtgtctctatgtcctcgtcctgcattcgcagatcgttcccagcctccaatttagtaacttggacagacctggctatctgggggaggagggctctttttccatggctcactggagggaataccggggccctggagaagaagtggcatttactctaagtgttgcagggagactagagagagcaaggcagggccgagggagtgcgccaggcccctttccacctgcatcaggctgccctgcttttccaggcctggagtcacttggctgggcaaaacaggggttccagcctttgctggcacagcccttgacaaggttcaatgaggcaagccttatgggacggcaggcttctcaggagcctggcatcatccttctccataagcctctcggtggtgtgcaggagagtgaggtgtgcacgtgtccacaagccatcagtacagactcctgagagcccagtggataacatcggggagtgaagagaacagtctccttttccacgcacagtagtagtcggacttttagaattcactgattgagtaaatacatgacatcaaaagctactgtgttttcagcaacttttaaaagaacgtttcattaatttttatttttagcagctttttgggggtatagtttatatgccatgaaatttgcccattataagcgtacctcagctgtgtcttcacatcgagttggtctttattcctagaactctgttgatttgaatataattttagaagacacgttgtgtatccagtccaccgtgtatctggattcacaagcccctcaccatcaccgtggcttggttctgaatcctgactgtctaatattcttggagtcagagggatatgggattgggccccaccccagctcttcctgccctgtgactttgaattggtcaccctccatctcttggcgtcttttgcccctatgagactagcgtggcaggactactgtgtgaatggcatgaggggagggtgcatggtgggccagagaacccataaaacatcatacctgtgcagtccatgctcattttaatctaatccaaggcccgaaaacacggcgagtggcagagtgacaggcaggagggtttgccgactcccgctccctggcagaccggacttggaagtacagagtggggggatccacttagccaggtggggtctgagcccagggctttatatgcattgatcctggccccgccccacctcctgtactgtgctcacgccggagacactaatggccctgtgtgaccgggctaaccaggtcaggtggcagtgcccccactcacaatccacggagctacgacttacttgagatctgctggagcaacgggctccatgccatactggcccccacgacagccactccccctctgcatagctggctgtctgcctgcctgctggccctgactctgcccccaggcctgcctttgaacagtctgaaagtttatctctctctgagtaactgttgtccccgaggctcccaaatgccgctcacctgctagtcagaagccccttgttccgagtcttttcacctcccatccaagctggctgcacaaactagggccattaggatacatttgggtgtcctcaggcctggctgcaggcttggttgggcagctggccagcgaggcagtgagaagcaaggagaggtgtctgatggaatgagtgcctcatttgaatgtttcattaacccatactttttgagcagctactatggacttggcctctgccctccagaccagacacctagtttgtccagacatccatcaggtggacagtggggtcctttgagccaaccatatctcttcttgcttccccagccctctgcctggccacacccctcccttcttcaaccagaaccaggctgaggttgctcatgatccccccaccccgtgccacaccacctagacccttggctggggagactccacaaacccttaggcattcaagtgctgcctctctcccaactaagcctttctctgtgtgttcacccctcaccttttctcccctgaactcccggacttgctgcctggataatttattttggcactgaagcatttaaggcctcttgtggttattcagccgttttgtgtgtgtacaacgtgtttctagcagacactgagctcctgggaggcggggcgtgtggctggcatgtttttgcagctcctttaatgcctggtgcattgctaggcacttcatattgaaagcgaggtcactagtgagctggaatggcagatgagacagggttcgtcattcgtccttctgaggactctagggtgcatcctcagtcccagtcccagactcgggtaggcagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcatttttctctctctctctctctctgtgtgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacaccacaggcctcccattgagtttgtggcccctgaatctgagacccagagctggggctatgggtttcacgtggccctttcctggggcccctgcccctgggtgcatttcctcctggagcctttggggcagggtcctccccatgggcctgagcatccagcaacccctccgcacaagcttgctattcctgctcctcctctccctggtgtcccatgtttggaggactggatcgaggggctcagtgataagccagctgcctcacatcccaccctgccctgcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcaggtatgactaccccccggcactgactctcagttgaggaatggtagcaggggtggcttggggccaggggccatgccacctattcccctggggtggaggggtctggagtcaggccccactgaccccacaggacctgccactcctcctaggtggggggctctctgtgtccccatgccccctccatctctctcttggccccaccttgctcctgttgaccttgggctcacctcttcattgcccaggcccctctttagtctcctctctccacttctacctcttgtccttgaccccacccaggcctgggatgggcgagggtgagattggctttagaggagttggaagaggtatgaggcctagccagctgcccggctcgaaaagtgcttggaaatcatctcagacaccagcaacttgctttagggtttccaagaccttgggaaagtgctccgtccccgcaaggcctggggccaggagaaccactttattgcttttggaattggctttagatttcattagaagagaacaaagcaaatattccataacttgatgcagttgcattggccagatttagggagggagttgtctactgccaggatgtgatctctggcagggaggagagggcggagggggccggggctgtcacccaaatcctcactatcttggaggctcctgcttagaggtctgggggcccacctgtgccccattttctctcgacgtgcccacccagccaggcccttgggtgatactgagtcctctccgagggagtagggggagagggtgaaggtgcagggggctcaggctgcctgccccctttgcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcaggtgagggcggcatggcaccttgccggctgagagaccggccaggccgggggcaggagggcctgaggggtgaggagcactgggctctgatccctagcttgtggcccccttgtgcccacagcatcctgggcatgcatctcttcggctgcaagtttgcctctgagcgggatggggacaccctgccagaccggaagaattttgactccttgctctgggccatcgtcactgtctttcaggtgcgagggtaacagggcagggcgtggacaggggccgtcaggtgcccctagtataggccctgattcctgtcttctgcccgcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggtaacccactgctctgcccacctcaccctgcccacagcagtcccacttccaattggctgcctgtcttgagcctcctccctctgttgccaactttgggggcctgggaagtcccacaggaagagcctcttagactaagccggggtggaccagggcgggaggctccagatctcgtgcagcccctcatcacatgggacacagggtggttgtttggggtccctccaccaaagcttagctaccgagtagacatccccttcagagttggctagaccccttccccagagaggcagaccagataagtgtctgcctgtggtgcagctggactcctgagcacagtgctctatggaacacccggagaggacccctctgagccgaggggtgcaggaggcttgtgtgcaagttatctgagctctgactgagcagatgaagatgccactaagaccagagcagggctgagctgcccagggtgagaaatgagcccaattagctacgggcatggcagagatgagcgtcctatttccagcccaggctccatcaccttcgtcacaggcagcgtcatcaattaatattgatttacattgatcctgcccttgccatgtcagcgagcagcctctgcccagagggctgcaccccctcctctccctcagctctgcctctcttcccacccgagcccccagacccaccccagcttgctggggcttcaaacagggcagtttgacccaacctagaaacgctccaggttgggtctggagaagctcttggtccagttctctctgggtgacccggatggaaactcccgctgcggcctggtctataaatacctggcacacggtggaaaaacaaaaatctattttccgactctttcccagtctttcaagggagggcttttccctgtgggccggctgggttggtggggtgcagcgtatctgtcccacactggtctttctccccgctacccttttcagtctgtagttatccgttatcgcatttcctccctcctgtggggcagccagggcagctggtgggggaggctttggtgatggctgtgcctcttgcagggaaggagggagggacgccggtatgctccctggaatgggacactaatttgggggttccctgaggcctgaagaattaaggggcaccacagtactcccacaagagccagtagactcactctgctgctgctcagggtctataagaggaggagctgagtgaggaccgggccccctggccccttctgaaggcagctcctgccagccacggttccctcagaaaaattcccgtgcaactctgtggagggaaatggaaaacaccgcgggcctattcccctcccctcctctgccactcagccgccaaggcagtctggaggtgcccagcacagatggccccctccccagcactcagccctttcagcaaacaccttgttaacttgagtgcagctgagcggcctggttgctaggcaacagcaaagccagagtgtgggaatgagcgcagcctggccctggggcggcctggtcactctggccctgctgggggcctgggactgccccagtgtgagggctcaacaaggcccacgcagccacaccctccccaaccttcgcagtatcaggacctttgcagggagggtctcactcaggatgcggtgtcttgggctgggatgcttcaggcctggggtgggatggagaaaggactttaagaacatcccctctccatgggagtgggcagtgactgtggccccggagtgcccatgggaggggctgggccagttgctcccctgtcctgcatgtggtgggcagggctggggagtgtccttcgatgcccatggcctggacaactccaaggcacctgccctctcctgggtaaggtttcagggggccccacggtctggcaggggagtctggttttgctgttgtggtggcctgggatttttgtttttattttgacaaataagacaacccaccttggcagaggaagtggctgcccccattttggtgggcttccccagcaggaggcttcaagggtagcccccctgctggccttgctaccttgccaagagctaggagggggtggtccagggacacagcctgcttggctggtgatttcctgacttgcagggggcagcgccctgaatccctgtgtatttatcattcacacacttaattaaatgaacaggcagcaggccctgtgtgaggccattaattgatactaaataacatcagagccatcatctcagcattacttgtcacatcccatctcaaacggagcagctggatctgttctgatctgaagggacttaagctgagagcatgagacgttatgaggcctgacttggctccgtgttgactctgactttcgtccattcctttccttgcttcctacccattccccaagcccactgcctccgaaccggtgagaggagagtggtgttctgagccacagactcgggttccaggcccagatccacctcttactctgtatgatttggggcagtttccgcaacttctccaaatctcgggtttctcttgtgtaagatggcgatcctggaacccacttcctaccttgcaaggaagccagctggtgttaaggaggcagtttcccatgccaggcacacccttaatgaatggtggctgttattattaggattatggggggacctgcccttgtccccatctttttggcctctgcactcacccttcagattcattctggcctgagggcctgtagttgaattctggaaggctgttctgtcccctctctgcccccccattccccgtgtctctcagttcccctgctgtggggtttgcgcccctccttttcttcatcctctctcgacactgccgatatctgaaggccccgagcgcctgtgaccagcagccctcccctgcctccccctttccctgtaggaaatcagcaaacgggaagatgcgagtggacagttaagctgtattcagctgcctgtcgactcccagggggtaggtacgcgatcatgagccggcatgcctcccgtgccccatgcccgtgcccctccactccgcctccgtgtctctgtgctcgtgttcacgctccgctgctgtgcaacctgtcatagccgtgatggtcattggtgttgtgaggtttgcttcgattttaagtcccttcccccttgaggacacggaagggaggcacctccttgcctctgcccccatcaacccaccaagggcaccatctccatccctgccagactggtggatgggccggagaaggaagggacttagaatcctctgtgtgcacgtgtgtggggcaccccgtgtgtgcgtgcctgtgctgaggtcccggaggagtcccagacgtccggcttcagtggagtcaagatctggccgtagaccatactcccccatctcccaccccttcaccccttgccccaggcccctgttggagaccccgcaagctgtctcagctcaggacaagtccttggaggatgtggggatgggatgtggctcttgccaaaatgtaccaatattttaaatcacctctgagcctttggccccttcatcacccacttgggtccggctggcgctgtcagggctggctcccggtctggccccacgatgagcctgtgctctgctgttccctgccccagcaccagaattcggggcgaagccagcattcctgtgggaccccatggtgctgcatatcccgagcagccccctggagatcccacttgataattaaaggcctcgttagggctgtaaactgagttaatgaaaatgatcccctgagatgccaattacccaatatttatgtccttatcaaaagtagcaatcaagtattttttaataacttcttaaggagaagtgtgtaattactggggaacctactgacctgctaagaagaaagaaaaaactgtcccagagacagggagagaggtaaaaatggggccagggagggggccgggacttggggaagatgaagggaagacaccgagggactgaagtggcgtcctcgggctgagctgttctgtctggggtctttcaatttccttccagggtcctcgagtctgaggctcaggggaggggagccgtggagagaaagcaaagggcctccagtgaacttttgcaagagaggctctagtgaccacttcactcaggtccccaggtccccagccccctctggcctgtgccacctgccacctagctaccccttctctccccagccagccttggtgaccgttcagccaggctggttgtgctgtgggctcacataagctgtggccttttctgaggtgtggctggagaggcagaggtggtggggccctgggaagcctcgggccccaagcctggggggtctggcctgcgccgtgcatgtctcgtgccgtggttgctggttcctgtggcctatatgtggtgtgcgtgtgtgaagagagggaggcccggtccatcccaaccacccaagcctggccggatccctaatggtccgctgctcccctgccctagggagatgccaacaagtccgaatcagagcccgatttcttctcacccagcctggatggtgatggggacaggaagaagtgcttggcctgtgagtacctatcctggggtgcgacttttggccctgggccagccctgtgtggactcgggatctctccctctctccccgtgcagtggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccggtagggggtgcatgtgggtaccctgatggtgggagatattccaaggaggacaggaggaagagaggatggaggcaggcgggtccaagggcacagcccctgccccatgggctggatggggcctgggtgtgcctggacaagcccctggggaatctgcgccggtgatgcaaaccagggtaggagccctagcctgggggctgaaaacagggcctaagctgacctcttctgtaccctagctgagtgacctcgggcaagacgccaccgctctgatctgcttctgtaaaatggaggtggggtgtccatacctcctcaagactgaataataataatagcagaccctcatctaggtactgactctgtgccagacactgttctaaacactactccgaagcattctaaatgcatttaatcctcacaccaaccctgggaggtaggtaccacaatgatccccattttacagagggggcctgagcctcagattgcagaagggaatggcagagccagcattttaatccaggaggctagtgttggtgcccatgctctcatgattttatttatttttaatttttttaaatttcgcttttaattgacaaatactaattgtgtatatttatggggcacaatgtgatgttttgatatatgcatacattatgggatgattacatcaagctaattagcatatgcatcacttcacatacttattttttttgtggcatgaacatttaaaaatctactcttagcaattttgaaataaatatgcattacgttattattgactatagccatcatgctgtgcaataaatctcgaaaattgattcctcctgtccaactgaaacttcgtatcctttggctaagccttccccattggtcccatccttacctctcccaaccccagcctctgctaatcaccattccactctctacttctatgagttcaatttttttggatttcacatataagtgagatcatatggtatttatttgtctttctgtgccttgtgtatttcacttagtataatatcctccagttcatccatgttatcacaaatgacagtcttcttttttaaggctgaatattattccacagtgcatgtatgccatattttctttctttctttctttcttttcctttccgctctgtcgcccaggctggagtgcagtggcacgatctcaactcactgcatgcaacctctgcctcccaggttcgagtgattctcctgcctcagccacctgattagctgagattataggcatgtgccaccatgtccggctaattttttgtatttttagtagagatgaggtttcaccatgttggccaggctggtctcaaatacctggcctcaagtgatccacctgccttggcctcccaaagtgctgggattacaggcatgagccactgcacctggcccatattttctttatccagtcatccattgatggatactaggttgattccatatattggctattgtgaataatgctgaaatgtagatgggaatgcccgtatctcgtccacatactgatttcaaatcctttggataaatacccagtgctggaattgctgggtcatatggcaactctatttttaggtttttgaggaacctgcataccgttttccataatggctgtattaatttacatttccaccaacaggacacaagggttcccttttcttcagatcctcaccagcgcttgttatctttcatcactttcataatagccaatccaacaggtgtgagataactcattgtggttttaatttgcatttccctggtgattagtgacgttgagcatttcttcatgtacctgttggccatctgtgtctccttttttttgagatggagtttcactctgtcacccaggctggagcgcaacagttcactgcaacttccaccttccaggttcaagtgattgtcctgcctcagcctcctgagtagctgggattacaggcgtgagccaccatgcccaactaattttttgtatttttagtagagatggggtttcaccacattggccaggctggtctcgaactcctggcctcaggtgatctgcccgcctcggcctcccaatgtgctgggattacaggtgtgagccaccgtgcccagccctgtgtctccttttgaggaatgtctattcaggccctttgcccattttttagattgggttgattttttgctgttgagttgtgtttcttcaccccattatatatactgccactcagctgatgataacacttctctcaccaaataaatgaggaatgagctctattgccatatctagtttacagatgaggaaacagatgcacagagaggcttaataacttgccccaggtcacacagctggttggggtgagccaggatctgaacccaggcatcagagtccagagctcctgctcacatccctacacttgatgtgatgccagtgaggctcccaggagaccgggtgcacatgagaggacagggctgctgggccctgcctgagaccactcctcccctgctcacccacagcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctggtgaggcccctgtgggcacagtgacccctcacccctgaccttgaaagaggggaggtgtgcctggcctggcagggtataagggagttaccattccaagcccacggaatatcaaggggcacctagaaaccgagctccaaacaatcccttttctccctctgcccgccttgccaagccccagatccttgtcatgcctatgcctggggctgcggctctgccacccttggtggatatgaatgattttggacagatgtgtatgaatctttcatggccctccccctgtgactcagaaagacccatcactcatctctccaaactgatgccccgcatccccctttctcgtctcaacctcatcacaagccatgacttcccactctatccatacccatgtgcccctgccccagcccctcatcaccaccattccccctggggatggggtgcagtgacctcagggttagcatgtgaagagcagggccagtgtctcctcagctgaggtgtgtctctgaacagacagctgtgtggggccagtgtttgataactgatgctgcttcccagctcagcagggaggacaggcagggggctgggctggaggcaggggtggggagaggggagagcggggttggggatgcaggggaggagagggaggaggtggagaggcaaggggtcctcagggatggggagggggcctggcaaggttgacagggagatgaggaggtggctttaggaataaaggaagagaggcagggcagagcttgggccccaggtgggagagggtagacaaggagtgaggctcgtgactctgctgaggagccaggagccggggaacctggaggcctggtcctgctcatactccagtgtttgttctgcagagcaaaggggaacgggtccgcgcgtggatccgagcccgactccctgcctgctgcctcgagcgagactcctggtcagcctacatcttccctcctcagtccaggtaagtgacagggcaggggtctgacctgtgtcccgacctcttcttctcacgggaaattaccgctggtgatgctgtcagggatttgagaagtggcaccctgcctggggtgtgagcagggtggcctcagctgggagggctctggaggggcaggggctgcgggcggtgcctctcgttgccacctgccctgcctccccctctcagccgttgcctccatgcctgggcaggttccgcctcctgtgtcaccggatcatcacccacaagatgttcgaccacgtggtccttgtcatcatcttccttaactgcatcaccatcgccatggagcgccccaaaattgacccccacagcgctgtgagtcaccagccccgctcagggcaaggcctctcctggggtttgcactcaggaccagtgagggaggcaaggaggccacagttgctgacctgcaagtcacacagcagggaacgagggggccaggactctcctttaggtctctcaccagatcctggtccccgggatgccccctgtgtcctctcctgcctcagtttcccttctatgatacatcagcccagctgggtgctttgtctcattccaggctatttctcatgagccagagccttgtggggcacacgcgtgagtcggggagtgctggggcggtgcaggggctgtgtgcagatggggaggcatcttgcccagtctgcctcagggcctcgggggcatgcagagtggccatggaagccgttctttgctcctggtcatccttccaggtcaaaaccaagtagattttcaggggccatagtggggacatgggtcacttctgcttggctgcgaacctgtcagtccttctcagaaggagagccagaggccctggacataccgccccagggtcgaaccccttcagggtgggcccagctcaccctgggagctgtctcttcctagcctggcattatagcccttcgctgtcggcagcaattctggttccagaaggatgggtggggggtggttgtgtttccgctcacggcatcctgcaccacttgcttagaggtggccagggtttgcctctcatccctctttgccatctcccacaccattgtttagatttcagcgctgctggggcttctgttttctattagggtcggggtggagggagcctgaggaatggcgggagcagcccaagactaggcgggtgagagagcacccgcactggggacctcacacccggagtcacagggtaaggcaggggcgctggctgcactccagccttggctgcctcccgcctgaggccctgctgtagagctctctgtcaccatgtcactgtctccacgtctctctcaccatcttcccactcagcttctccatctccagctctgtcactgtacctgctcctctccttccctcctctctgtgctcacaccctgcccgccacctctctagagatctgcgcctgcctcctggccacccagggagggactcagtccacagatgccagggaactagatggccttcctccctgccctgccccagcctgtgcctgggggtgcagagtctgtgtcaggaccccagcttccactgctgctccatttctggggtgcacagcaggaaagcaagtgaagagggtgggatggcaggcaagggtcagagatcaagtgagatcctgccccagtttttaaaaggaaccagggaatagggcttaggacgtgggacgcagatcacagcactgcagtgcagatcctctcccccttgggctaagtggctgtgggggcggggagctctggtcacagacaggggtgtgactgtccacagagctgcaggggagtcagggggcctggcactggctctgtgcgtgtatgagaggggcgtgatctacattgttgtggagggtgggggtcgttttctgagtcaaatgttagaagcaggttttgacttgtgtatgcagagcagacctggcccaagggtgggggcttcctggcgggcaacccctgcctcccctctcttgcaggaacgcatcttcctgaccctctccaattacatcttcaccgcagtctttctggctgaaatgacagtgaaggtgatgggggctggtgttggcttgggacctctggttcctggtgggggtggagacagcttgggctgagggtgggagggttggctgcagcgcagggagggcggccgatgacgtggcggtggtccccaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcaggtgactccctccccagcactggaacacctccaagaggtggccccctccgcagggacatctcccaccgccagcactccctgccacgaaacaaaagcccgcacaggccagcatcctgtctgtgacccccacaggcgatcctgtccccgccccagacaacactcagattacggccgcagtaatttccctccaggtgcacacctgctttcctcctcttcaacatgacatattcctcagggccgctgcaccatgtgatgtaaggtgactgcagccctgtgcagcacacagcacaaggggccacgagcaggactctcacagtcttcagctgcggctctcccttgtgtggcctctaggggtgacactcagcccctccccgtgaggtgacaggctcctcttgctggctttccccatcttcaggcgcctgccagtgaccaccccccggtgacatttctcctgaccagggatccaccctctcaggaatccctttccaatcagccagtcaccacccccaactcagattttttttttttaatagggatgatgtggactaatggcgatgcttccctgactgtgatagtccatctccctctgccccttcccctctctgcctgctcccctacaagtttatctcctggtgcccccaacccacaatacactgcatctctagggaacgcctcacttgagttgaatcctccccactcccaacccaaacaggtcgtacatttgacatcctgggatggaggtggagatgtggggcatggggatctctgccacttgttttgagagattacaataggggtcctgatggcaggggtcccatgaaaagaggacttgtgttctgccaccagaggccaggaagggaccagtggtcaaggttgggggtggggagcagggtcaagggacaagggagggtctgggctgggggaagccttatcacctccctccctcccctccccagggtgatcagccgggcgcaggggctgaagctggtggtggagacgctgatgtcctcactgaaacccatcggcaacattgtagtcatctgctgtgccttcttcatcattttcggcatcttgggggtgcaggtgtgtggggttctgggggccagctgtgggtgaaagcctgaagagggcccttccccttggcccctgggtcctatggctcaagctgctgttgctgccttcattccagaaaggaataagcagggacgcttccctccaggctctaggcccttttacctcctgggcatttcaaagaaaagtgggagcctagaggaaggccccaaggaggaccggggctgcagagaggcttcaggccatgggagccgcaggctgctgttcctgccctctgcacgcactccctgagcacagacgctggcccgcggtctactccgggatcccctcccttccttcccggctcgagcacagtgggctgcaggccaggtctggggatccagggcccagacagctgggccaggttagcagcgtgctggcaggcaggcgggtgcagaccccagacgaggcaggaagtgggggctgctggggaaacttggccttgggcccagggaggagacttggctttggaagagaaagagccagagctgcctgcaggattcagcagacgcctcagggggccggggagcccctccatcatagtcttccagggcccttggctccagctgtttcagctgcagggtagacagctggctgttcaggcagcgtgggagcccctgggtggctacaccctcccctccccgcccctcgttcccttggcttcctgggatgtccactctgccctgggttgggggctgttccctgacttcctagaaattctctagccctagggaacaggctggggtgcatttaccaaagctgtgtggtgcctctctgtacaccctccccactcccacccagtgcccttccccttcctcacttcccagcctccttgggtcagtagagtgaagcattgttgagcccagtccttccggtggatttaggtctgttttgagcagtttgctcaggccccctggtcctgccttccgtttttcactagtggtcatagcctggtttataatggaatgagggtgagctttccaatcagacagacctgggttcgagctccctttctgctacctgctggctatgggaccttagtgagtggattaacttctctgagcctccgttgttcttatctgtaaagtggggttgatgatacccactcccccacccagagctgctgtgagaattaaatgcccagctcagtggttctcaaacttgagtttgcgtcagaatcaccagaacggcttgttaaaagatcgctgctcccccacctcagagtgtatgattcagcagatctgggctggacctgagaagatgtgtttctagcatgttcccagatgatgctggggactcccacttggcacacgcctggcctaaccgttggtggaagatgaatgactgttacccgcctccaccctttcccactgcccgccccgattacctttcctccccactcttggaaaggaagggggtgtcggcaggggagactcttgtcagtgtttccctgacttgactggccccagagcagagcaccccacactcactcaaaatgtgcccaggctggcgtgggggtggggctcaggagtcctgggcttcctgtggtcacagctcacttttctctgtctctgggaatgtgtgtccagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggagcagctgacttaccagggcctcagtttcattaactggtgaatggagtcataatagaatctcctcggaggtcacaataaggatgcaatgagatgatgtgtatatttctttaacatggtggaagggacggatatattgtcaagataattcctttcctcactccatatttgcagaaacagaaatgcagaaaatgaaattgctcgctcagttttgattcccagacccactctggttttggtttctggatttccagggtttttgtgtcccttctcctacctggcggagggcagagggtgtgaccatctctcagggcccctccagctgcagctcagttatggaaccctgagagggagggctctcctggagcctggagtgtgactccagcttgacccctcaagggctggggtacttggagctgatgcaggaggcactttgggggcaggtgataggtgattcagccacacatcctagacttcaaatgtctccttctcctcctccccatcaggccctgatgtccctgttcgttttggcctccaaggatggttgggtggacatcatgtacgatgggctggatgctgtgggcgtggaccagcaggtagggctgaggtgggcaggatccatctgtgggctcaggtcactcagcatgggctgattccaggacagaaagagcaaggcagggtggcaaaatgccatgaaagaagcatcatattttacagcagaggctgttgctggtagcctgtgggccaaatctgggcatgttttattggtctacaacatgtttaacatgttttgaattagtgatgaatatttttaaactggtgaatttgggctgtgtgcagtggctcacacctgtaatgccagtgcattgggaggcctaggcaagaggatcacttgaggccaggagttggagaccagcctgggcatcatagcaagacccccagctctacaaaaaataaaaacaattagccgggtgtggtggtatcatctggagtcccagctgaggtgggaggatctcttgagcccaggagtttgaggctgcaataagctgtgatcgcaccactgcactccagcctaagcaatagaacaagaccctgtctctaaaaaaagaaaaaaaaaatggtgagttttacacagaaattcagatttgtgtctactcaggaaaagtctgaagatctgggaagactgggcttgcattccctcaaggcaggagtcagccagaacaaagaggcagttttggatggagaatctactctcccctttaccacagtccccgcccctccctactgcttcacatcaaacccacaccattcatttccatcgcctgtcaggcggctgtagctatttgggttcgcaggaacccaggctgtgggcagctcctaagacagcttgccctcgggctgatgcctccgcctgtccttcctgctccccgccagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctggtcggtagtctttccacctctctctgggtcgtgcttgaccttggccttgcgactgcagggggctgggcgctggggccgggggcagggagaagaggctcccacccccctcctcacctccttctccccaagagcatgtctgcctttagagcgagcatgaagcagaccacttcagccccatgggtagggggagctgtccccaccctggggcctcccaggacctcagcatcatcctccccagatgatgccaaatggaggttgacacccagcctccccgagcttgactctcagaggagcctcactggctgctccactgccccatgccagcatccagaggcccagggtgggcagcaagcatctcaaccctgcacccacctagtgtctgcagctgccgagcaaagcctcagcagatctcagtaatggacaacagcgtaaaagagaacccagacacccctccctccctatctctaacaaaactttctaccatgatatatatatatatatatatatatttctgctaaacttaaaaaaagaaaaagcaaaaacaaaaacaaaaaaagaaaactccccttggcttggggaagttctggaataacctggggccctggagcccctcacctcctcacctgtgctccccagcatctcttggcattgggtgggtgaagcccccatccgtccgtcctcatgcccttatgccatgggtgggccgagactaagtgagaagacagaggccaggaaggatgtgagagacacagcaggcgcccaggcccctttgtttctggggcatccccagatgcgtctgcacctgtctccctctctcccgggctccagggctcccatctgcctggtacagcgtaatctccgcgcctctctctctctctcagtcacggcccacgtctctctaagtgtctttgtgtgtgggtttatctaagcctttgtgtgtctgtctgtgtgtctctctctgtttggggtgagggtttcccatgctctcttcaccttttcacaaatcgtcttccttccgccgataagatgggtgcggtggcctgagttttcctttggtgtgttcacatgtgagtaccaccaaatgagtgaggggttgccgtgcccctgcctcccctctgccctcagctctatctccctcggcctgggagtggcactctgaggcggggggagagtgtgggagttgcagacgagggtggaggtgggagggggcctgtgttccctgtgaagagcgggagctgctccaggatgtgggggagacactggcctctgggcagcaatgggaggtgccgttctccacgtccccaaccctcactatcagcacccccaaggccttctgctcggctcagggtaggggtccgggttcggcttccctgtggatatctgcagctgagcaggtgcagtgtcccctgtggccaccgtcccactcctgctccatcctccccacccccacctcacagtcaggcagatggaattcttttggcaggcggcacttgtggcccctgcctgcccagctggctccccttctggggtctgtagctgtctcaggtgcagctgaggccacaacgcaggagaagcggacatctgttctgatgaccggctgcctgcccctcccggtgcctccctgccccgtgaccctgaccagctagccacattgcttgtcttcctcaagtgccctgtgcccccagcttcgggctggacattcagagccagccacccaatgggctcagcgcaccccacccataggcagagtgaggtgggagctgaggggaagccgcccctgaggggccctgcccagcgcacctggtccggccagtgaccaatgtcgtgtttcgttcttttagatctaatgctggacgatgtaattgcttccggcagctcagccagcgctgcgtcaggtactgcgtctggggtgtgggctcatgcgtgtggggacatgctcttcactccctccccgtggctcattgattctatcctcttggggtgaaagggtgagggtccctggggcccccaagagggcaggggctgaagcgctgggctctgcagcatcccgcaggcctgcgccaaactggacgggaggcgagggcctgaggcctctctgccgacgccctttggagagcccaccttcccagcaagggcttccttggccggccaagctccccacctcctgccacctcttccctcctgtgcctcctccttgtagctcaccggtcgattattagagctgcaaatctctcctgtctccttttgtctgaggggagactttgatccaagggagcaggatgagaggagcagagaggggaaggatttgttttaaaaatgtaacaatgaataattgaacagactcattaatagtcaagtgatcacggtggctgcgtcatcgctacaaacagcaggaattgggaatcaaaggcctgagttggccacgagcttcttccaaaaaaagccaaagatttgggagtgacttgggtccttattttcaagagccatgtctctgggaagactctcctggtccagcccaccctccatggtccctcggtcccctgctctcctctcccccactggcccccagatggaggtgtggaggctcatggagtccgtggcagggctgtggggcctcataacactatgtctccagctggtggttcccaagctgttcatccccaaggcccccagttatcatctcctccaacagacttcacactttagaaggctgtctatgaagttaagagcacttcaataatgactttctttcatcatttttactaatcagaggcgcatctaattgctaatcacagcttctgagctgcagaaggttacacactaaatgatggcaaagaaagaccatttcgtcattaaattagtctgtggggccttaacacaggcaaagtatagggtttctttcaagctttttgaagtattggaaagaacataagggccgggcacagtggctcacacctgtaatcccagcactttgggaggctgaggcgggcagatcatgaggtcaggggtttgagaccagcctggccaacatggtgaaaccccgtctctactaaaaatacaaaaattagccgggcgtggtggcatacgcctgtaatcccagctactcgggaggctgaggcaggagaatcgcttcaacccgggaggcggaggttgcagtgagccgagatcacgccactgcactccagcctgggtgacagagcgagactccatttaaaaaaaaaaaaaaaaaagagagagagagagtgagaacataaggacccccatggctgctgcaggcttggaacttcagtctgggaaccaccggctccactttccccactcctctggaagctagaatcaggcagatgctgccctggggatgttgggtgtcatgatctgtggggcctcagggacccacccaagagagaacccctgagcccccattgagtaggtcatccctgaggccctcagcgctatggccccatgatgctaagcagtggtgtttggcattgagagactgcctctctggggctcaggagtctctggctggtttgtgtctggattgccagggtccccacatctctgcatcaggctgtcttgcaaattcctgacttgttaggggatgaggggagggagggaagaagtggccttcagcttttcccttacgggcccacctggtctgtagactgaagtgtgcacactttcacactcaccccaaaacatcctagcacagggctagcccacagagacttttccaccttgggtgttatcccagaaatcaacacatgcagactctcatggctcctaagacgtgactcacccactcagtgctaaacactctcgtgacccttgcactgcactcccattccgggtaccttctgctgtgctcctgaagtggatagaccccactgtatcctggggtggcacacgcaggcatgtacaccagttaccttccctggctgttggtgaggactcagagaccccgaacaagggctcaggtcatcccatatcccacttcctaggacctgtagttctgcgtggcctatgccagagcttttcaaacttccatgtgcataagaatcacctggaaagcataaacacagattcctggggcttaccccagaggttctcctacagcagtgcagatgcactgatctacccaccagggtgatggggacagagtcaaacgcagtccagggctgctgagaatcaaacacgtgcaccgcacctccctgctagcactcctgtcctggtgctgctcccagcaggggcgggagagccagaccctagggaaaggcagaagagcggagcctgtgattatctggggaatgggcctgaccagaagcctgggtccaccccggcttcccagatggagggagggaccggggctgctgggtcatcaggctgccccacgggacggctaagcctccaacaccagctccactctccttggccacctgtggcgtcgaccttcactcactcaccctctttccttccaccaggccgggacccagtgatcaggcctggccacggcagctgaaggtgtggcctctgccgtggggggcctgtgtccttgggagtgacccctgtcttctgcctactcattgccactcccctttgcaaaccctccgccctggccatgccttgggctccctgtgactcctactaactcactgcctgttgccttgcggccctccttctgtacccttcctccctccctgccccgaagtggggacctgggctgccctagatatgcccttccccccactgtctgactctggtattttctccacctaaggcagctcatcctggtgggaggcagggaggtggtgccacagctaccaatgcatcagtgaccacaggtccaggctcctcctggactatggttggagctctcaaagcagcaggcttgcccaaggctcctcccaggggctttctatttcttctccacacctgggtgcttgcctgcagagccgaggtccagagagcagcaaaggagggtggcatcgccaggccccaactttggaggcctttgggcagaccatccaggggtgtcctctgggccaaggcctcaaagccttgtgtctgtacccacctggcaactggcgagggactcgggctggaagttcgggtccagctcggtcatgcctcgtagctagctgaatgagtcactttttgcctggcttcattctctccctctgaaaaacaaaggggttgcccgaggagatgctgatcagattggcctggtactctttggacctgtgctctaatgggggatttctggcagcctcagcacctgccgtctggggtaggggccagggtggaggggtgtttgtacagacctcaggggccgggacctgtctataagcagatgccctgcctcagtcctcctgccccgccttccttctgggcctcttggaggagggtcccggctgaattgaagcccacccaccccacagactcctagtgcaaggccagagttggtgggagcagctgctccgtttggcctggaactgcctacagagtcaggctggggtgacggggagaggagggcaactctcccagcctctcctctacattgtctcagctaataatggggctaataaggagccgctttttctaacctaattgtattcaaacattttagttaattctccattcatattttagcataatgggatcgggtgctctcggcatttatggagattaatgcagagaaaatgttccggctgctcaggcaatgcagggcgactagcgccctctggttcttgtggtactcaaggaaggaaggaagaggcccggcccacccggcccaccctccaccatcgcggtgtggatgacccgtagcctcctgtcctcccttgccccaggctctccagccccacactcttggggctctgttctcgaacaaacagagccacagttggctggccgatctctgaaaacaggaagatggcctcatgcatgcctaaggcgcagcagagtgccggggactgtctgctccgtggtcatccacacctcaaggccgatgctggagagtggccaggtgggccaggagcatggcagcccacgaggctggatgtgcaatacctgggtgctcttcttccttcagcctcgggtgggggcccaccccaggccgctccttgcctcagtttacctctctgttcaatggtcctgtgcatgggaaaggacagttacatctgagctggcctgggcccaaagcttcctgctgcccctaagccagctaccccctggctcaggcctcagaggcggcagccctcactggctggcttccccctagacctcctgagacggggaagggctgtctgggacctgaggctgccacacacctccccgtgaaaagcctcttccttctctgtggcttcgtgggagaccaatctgtcaacttcctcccaagaacatgtgccccaagttggcctggcccttcctcagcacctggaagagggcccccctgaaatctcctgcccccagatttattctgcctccttggcagcccaaccttctggctctgtgattttcataactaagtggttcactaattacgagagaaatattatgcctctgacagatctcagacagtgcttccagcccagcctgcagtctaaggctgcccaaacacccaggagcaggctgggcagtgcctcattagaaactgggtgagtccaacaggtggggccctcccagcttgagtctgggatggagcagagccccaaggcctcccctcttgctctcactgacatgagggtacaggaggcccaggccccgccttctggaggccctctgggtgggtcagtgcagccagccaagaagatgtccaatttccaatctccggttttatctccaaatcccagctctgtgtaatctcctctgctcccccgaggggctgagcttggtgaaggagcaaaagcctttgcctccctgttgatggcgcgtcctctgagcctgaggagaccagttgtttttcatcgtattgatctggccttgctgcggaacactgagtcgagggtgttatgaggggctggtggattttggaggctgcctaggggagggggctcacctggcgtctaatgtaggtggggggctctgcatgtcctgatccatcctgccctcaactgcagccagtacaacagatgcttggagggggacacgcccagacggctgcccccaccaaggggcagcgtggggagggcgaggatggtgatgattatggaatgtttcagttctggcgttagaggctggtggctgtgagggactgggggtggaggggtgcggggggcaggggcctgacgcttgctctgctcttccccctgccccatcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccaggtaggagcgagtggaccagccatctggcccccccacctccagctgaggaacctctgggcaaggttaacacagcctgagccagggtacctctgtgccaagcaagtgctaggcacactacatgggttcctcttgtgccccttggaggtgggtatcatctttgttttatagatgaggacactgaggctcagagatgttagttgatgtggccaaggtcacacagaaagggagtggaggacctggtttcttcacccagcaaatgttgagcgtctactatgagctgcactctggatctttgagggtaaaaaggcagatggatgcctgcccttctggagttgagattctagcgaacgtccagctccagagctcacctgtgaccttgccacttctccagtcagcctcccttggctgccttccagccgtcggtttccctgtccatccaatgagggggttgaatttgtaatgcacaaggccccttccagtcctggcatgccgtgtcatctagtacattctcatgtgatctcctcaccatctcccaaggagaaagatcctttagcataaggttgattcattcatgtgaataagtgccctactcccttctggggtttggtggctaatggccagccatcatgatgggaacagagaagacagggctccttggagttcccctgcctctcagacctgggcggtatgatggaggggcggggggacaagccccagccctgggccttaagggaccctgcatcttgcccccatccctgccagattctggatgaggctctgaagatctgcaactacatcttcactgtcatctttgtcttggagtcagttttcaaacttgtggcctttggtttccgtcggttcttccaggacaggtaacggagaaaaggggggtcttggggacttgcgtagagatagaaaggaatgagtctcttggggaaatacccaggaagacctagtgtctaagacttttcttaattcctgaggttcagcccccaccctgtggctgacgtaggggactaggggatgggaaggcatggtctccaggaccaggagatgggaaggcatggagagaatttgacaagacagggcctgggggatgctggcagctagaaatcagtgtgacctagcctggggcttaagagcacagagcctggagccagactgcctgaactggatttgaatcctggtctcaccacttagtagctggtggccttgggtaagttacttaacctctctgtgcctcagtttcctcatttgtaaaatgagagaaaataatagtatccacatcacagagttgtgagattatgaattcctatttggttttgagggtgtttttcgttttgttttgttttgttttgttttctgatgcccaggctggagtgcagcagctcagtcatggctcacagcagccttgacctcctgagttcaagctgtcctttcacctcagtctcccaggtagctgggactacgggcacccactgccacacgcagctaattattttttatttttatttttagtagatacagggtctcactatgttgcccaggctgttctcgaactcctgagctcaagtgatcctcccacctcagactcccaaagtgttgggactgcaggtgtgagttcctatttgtaaagctcttaaaagtgcctggtgcatagtgaacaccatataagtgctaaattaaaaataaaagcaaatgaatacaaatgaaaagcagaggcttttgagctaaagtcctagtcctactcgtgccaccagttggctgtgtggccttagataagccacgcctcttctctgtgggatgggaggctggacccgctgatgtctgccctcctttcaagccctgtctttctgtgccacgactgccccctccttcaggaaccccctcccccaactcagggagctgtattctgggctttccaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgaggttggtgcccagcccacgcacctgccctcctagggtgaccagcccagggagagagagcaagggtcggctttgtggctggtcaaggcctgggcggctgtgggttcccatgggtctttctcccagcttctgccaagggaggctggagacagggctgaggatggggatgcaacctggctggcccggagatggccatcccagcagccccagcccagccctggtcctgactctgccagctgtctggccggggacccaaagaggccagctcatgacgttgtcctgttctgcagtgctgaagctgctgaagatggctgtgggcatgcgggcgctgctggacacggtgatgcaggccctgccccaggtagccgggaggtggggggcctctggggagggggaggtgctttccagagggaaggggctcagagaagctgactgggagacccagcggcatcgtttctatttcttctccttttttccaggtggggaacctgggacttctcttcatgttgttgtttttcatctttgcagctctgggcgtggagctctttggagacctgggtgagttggggtaggggagggtggaggagccagggctggagaccagggggctcctggactaacatgggcctctccccctttccctcctcccccagagtgtgacgagacacacccctgtgagggcctgggccgtcatgccacctttcggaactttggcatggccttcctaaccctcttccgagtctccacaggtgacaattggaatggcattatgaaggtaagggcccagggttggcctaggctccagggaggcagccccacttcctgagctaggattccttgggaagatgaattggccacaaataaaagcatgtgaccttctctcccccgtgctagaacactctggaactccctctcccaggaacatgctctgactcacacttgtagtgctcctctgcccccaaacactccctcctcctccccttccttcccatcctccaatgctctgtgacaccagtgacctgattttccacaacagctccaacaactgtcctccccagcctcacccctctattccaccctccccaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggtgagcagacacccaccccagccgtgagaggagctggggcaggagaagggtgtggagggtggtgggcgggagccaagcgggcagcacacaaaccctaggctcctcctggaggctcccgccctccgtcctggatgctgagcgagcagtcactgcccctccccagggatggctgcccacactcaccccacagggccaccccagcagacgggccagcttagccatgccctgctcctccagcctggtctggcctccccttcctgactcataggttcaaggctaagttttctgtttccttcctgtttctttcttacccttgcccaactgccaaatctctttcctacccaccctttaacctgcctgattctcttccatctctccatccttttatcttctctttaccgctctctctctctccccccgccgtgggctctgctcattttccatctcccatctctccttcctccttcgccttccctcttccccaccccctcctctttttctctttgttgctgtgtgtgtttttgtgtgtgtgcacatgtgcatgtgtgttgtctgggtgtcacctctttctcctctgtttctcttgtcaatccccttccacgacacttcccatcactgccctctgacccctgctcccctgcctctccggctccccttacgggctggctccccaggacaggcagctgtttgacaccatatccctgctgatccagggctccctggagtgggagctgaagctgatggacgagctggcaggcccagggggccagccctctgccttcccttctgcccccagcctgggaggctccgacccacaggttactgtgcccctgtgctgtgccctctcccctgaccgtgctgggctgtgccacgctgtgccatgcttctggggaagctgggagtgttcctgcccactgggtatctgtagaaagtgcagccttggagcctcagttgagtgcaagaggcagtcaggggttcttctagactgagatcacctccagaaaagagctggaaggcagggctgctgagattgcccctctgatgagaagggtgtgtggaggaggagcttggggaggggagaggggatttgtaagaatctggaagagaaaagaggggatggggcagaagataagttagcagggggaccttagggggtggagggaaggaggtatcagatccagggaggaaggcctccagagacagtgtaggtggccagggagcccgctgccaagctgcagtctctctatctgctcgtgtccagcacacacttgccagtcctcagtttggtggctttttaagccatggagcccactgggcatggtgagtgctgtcaggagccactgatttctgtcctgagagagatagaaggctccagctgggagtggattttgagaacttggtgtgaaataggacttggcttcctgcccaagcccagccccttcccacagcgccacatggccctctcccccagtcccatttaattccaggtcttctgctttctgggctgttcctgccctcctcccctccccttgatcccctcaccacgacccactaccacgtgagagagggccccaccctccctccacctaggtgagaggctgcagacccggagtggagacaggtgtcagctgcagatagaaaagccgagtcctccagaggcccttttgggtggtggggcaggcaggttcttaggaagcctttagcctgatcccagaaaaatggacagtgatcctcatgtgggaagggaccttgcctcttgttgggattcagtctcagatctggcaatgacctagaatgatcagtgggaaagtgagtccctttccgaggcctccccttcctgaaagaggctcacagggaaaggttgtgggagaagaggacacgatgggaaggtgatggggttctgggagggacggtccaactgtcccctagcatcctgtgggcactgaggcaaccccctgggtcccaggtgagccagccagatggtgtggcagcccacccgagtgcgcccacttcaggctaacgggagaacatctcccagagcccaagttggagagggcgggcgggctgcaggcaggcggaggagggcccacgaggggagaagccagaatctgggggcaggccaagtcctgccaggctgttggaagccgagagaataggcagaaaacagccgtcagattggtggcattgtcgccggcgccccccgtgccgctctgtctgtgccgggaggagagacagtgctttgctggcctttcttcattttttttttttttggtatcatctttttgagagtcgcaagccctcggtcctcccgctccctccctgggtggtggtagtgtgggaggggctggggaggctcctggggtatctttagaatgcgtttctgtgtctcctcgctttgtcagtgtttgctctggctcttcagtgcctgccgcagcctctctgatcagagcagggggttgaagtgggtgcggggaggcactgtcagcttgtttggggaaagggtggggagagagaagggatgcctttttcccgcccccctgtgcttcgtgaaaagggggaagtggggactgagagagagcgcgtgtgtgcgtgtgcacgcgcgtgtgcgctgtcctggtttctcatgcctgatcatctctctccctgtctagatccctctagctgagatggaggctctgtctctgacgtcagagattgtgtctgaaccgtcctgctctctagctctgacggatgactctttgcctgatgacatgcacacactcttacttagtgccctggagagcaatgtacatacacactgccctcactgctcccggccacccccggggctggactggctgcagggctccagatcggcccagggagggtcctggggccgcctcctctcagtttgctgccaggctccacccagaggcatcaactgtcaggacctcggtggcccacgctttgctggcacaaggtcttcaggttccccactggggacaaagagattagataagtttaaattggggccttgccctgaagggtataggagcagcggcagccattatgaaaaagtgaatccagacacccaggagtgacacggcccaaaacaggtgtcatcagagtcaatctatgaatttggagccctgtgcaagccagccctccctgtgcctgttcccctcctccccaccccaccccaccccccaacaacatgagaccttcacaccacgtggtgggtgagagccgcatctctgccaccgctgccatgcccttcttcacttggagcgctgttcctgtctcctccgtcactgtccccgtgtgtccctgcgtcttcaccaaactcagtggggtgaatggggcttctctgtgctctgatagcttccctaccctttcccttctccagctcccgtcccttctgactgtgagcagccccctcctctccactgttcccctcctgttgtcagaggagggcccagctgaggcagggactggaccaccggctggggtgtccctaggggtcttgggtggctggcagtagtggagcctggggctgagaggggaagcaaaataagattgtcctccaacttagccatcctcaggcctgctggggctatttaactggctgggcctgcatggcgacagggcccctacagcctccctgggaacaaggggtgaagggttcagggggaagggggtcacagagtgatggagaaacctcttgagaacaaactaggctccctcatgctggagtccaaggctgagtacctcccttctctgaaacagagcaacaaccccactcccaccccgagtctgtccactaagggagcagctgaatttggcctccaccctcacctgccagagttattggttaaagtggaggtcagggagccagctgtgacatgcctctggtggtcatctgccattcaactcacctgaacccaacccaggccctgtgctgggacctggggctgctgtaagaactggatgaacagcctgcaacctgcaagctctcctgagctgcctggtccctgctccttgggagggtcctctccccctcacctcccccactgacagcacagggtcgtaggggctgctgttggcttttttttttttttttttttttgagacagggtctcactctgttgcctaggctggagtgcagtgatatgatcccagctcactatagctttgacccccccggctcaagcaatcctcccacctcagcctctggagtagctgggattacaggtgccacgccaccatatccagctaatttttttttttttttttttttttttttttttagaaatggggttttgccatgttgcccaggctggtctcaaactcctgagctcaagcgatctgcccaccttggcctcccaaagtgctgggattacaggcatgagccaccagccactgtgcctggcctgctgttagcttttaatcctcccctgagctgctctgggtcagggccccagcccatccctgtggacaccgggactcccttcagagcctctaaatggggcctttagaatcagcttgtgagccacctgcagggctgggggctgggggctgctctcccttctctggatacctccccgcccctccaccaccacagtgggagcttaaaggtgatacaatgtgtgcagttttgcagggggtggggggcagggcctgcagactctcccggctgcccagaccccctcctacctgcttcctccccgcgtgtggagggctcatccatgtgtctgcccctctccccagccatgctcatgcccatctctaccttgtcctgggagggcacgggggtgagggctgggcggggggcgctgctgctttctgttgtcagcgctgcctcagttaccaaacccacgcacaccctcttcctccacctccctcccctgttccttttgcagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggtaccagggctagagcaggccaatttggctcacacagggagattccatcctggcctaagccagtcctgatctgaggggatggggaactgaggcagccaaagaggtatctctgacctcaggggagcctccagcctgggggaatggctttgagtccagggggtaagggtagaggccctgatgagggggagagagtggaaagggagggctcaggtgagaacctgctcccctgaaccctccagctccattctctccccccacccctcccccgcttccctccctccacaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggtgagcagatgtggaaaggcaggcacaggcctgggggctggaccctctgctgctggtgatgacctgtgttgacactttcattcttccagcaaatatttattgtgtgccagtgatgtgccaggctcagttgcagataccagggacacagtactgggcaaagcagaagtggtctgtgccttcttgaaatttgcacccagttccttgttccactgaggaggcctggagaccagaaggggtagtgcttgcccagggtcatgcctatctggtcggaggtagaaccccagtctctggtctttccttcctcaccaaccagagctgcctcccaattcttctccccactttggactgagctatggggcacaaggcaggttttaagtgtcttcacttttggccaagcctagggcccaccttccagagcccagattctttttttttttttttttttttgagtttcgctcttgttgcccaggctggagtgcaatggcacaatcttggctccccgcaacctccgcctcctgggttcaagtgattctcctgcatcagcctcccgagtagctgggattacagacatgcgccaccatgcctggataattttgtatttttagtagagatggggtttctccatgttggtcaggctgagctcgagctcccaacctcagatgatctggccgcctcggccacccaaagtgccgggattacaggcgtgagccaccgcgcccggccccagagcccacctgtgataaggccacagcccatgccatgtgtgtgtcctgaggcatgagcgtggacacatgagaatctcaatcccacatgcttgggggagcaggcacagtccttattcattctgcaaatagtcactaagcagcctctgtgtgccaggcactggcgacacagcccctgccccctgaagctcacagtctaatagtggagacatgcctgccatcagatcattgcagcctcagctcacagctgccagacacctatgtgtggagggcagcagggacacagaaggggaaggggtcggttttacttggggacagagactgtcacacactgtgtcacagagaacctgagtccgtaaaatcgagggattcttgccaatcaggaagggtattcagagccaaaggggaagtctaggcagaggcggggaggcgtgaaggagccagctcagtgagcagagatggcctggcttctctcatatcccaggaggcaggggctgcagagagagcgattcttgcaggcttaggggagaccagagcatgggggagggaagacagggtttagtggggagagaggaggcatggtggacaacagaggtcaggctgcaatgacccctatctactagtaagagcggctaccaggacctctgcttaggatagtcctgctgtgcctggtggtggtgggcagggggcacagccagcttgacaggagggctagtccatgctggagaggagactgctgggctgagccctcccccaccccatataggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcccacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaagctaatcacggtccagagtaaaagcaaaagggatggagagttaggcacgtccagatggcattgatgagagagagatcctggagatggggagtgggcggcggggagggaagcttcagggctgcctctttgtgtgtgtatgagtgtgtatgtgtttgtgtatatgagtgcgtgtgtgtatatgagtgtgagagtgtgtgtgtctgagagtgagagaacctgaaccccttgctgtggaaggctgcacctctagcctgccctccccagccgtgaaggagaggaggagcccctccgcctggtgcaggctggggaggcagggtctcttctgctgctatcaaagctttacagcttcctctagctaggcagctcagtgaatgggagtaattccagattaactcttatttctgctgacagctatcagccgcacattgaaagctggaaattggcataatgaagctgttttggttaatggggccgactgaggctgggggaggttgcctcagaggctgcagatctggatctgtgggttggtgggggaggggggaagtgtttctgggttttccttcctgaagcttcagcacggatttgccacacttctggctggatgcgtgacctgagctgtctggacttcagcctcctgccttgggggcgggcttagctgactggcattacaggcactgtccgatggggacctcgtccacctgcccgcaatggaattaaaccgtgtcaacggagtgggctgtgcttcctgaggatgagagtccagggctgggcgtccagaggcaacctcctggtggaggtggtagggtcagaggccaggtgctgagtggggagctggccccctgggcggtgatgagcgagcgctcaagatgtttacatgcactgctgctgctgcctgcctagcgggagccagtggaggagggaggtgtgaaggtggccaggggcaggcagacaggaagagggggagtggcgtggcccaggccacctgtctggtgctactgcagacaatattctcttgtctgaaatcttggtgccaagaggtggtgaccatgggtccagccagcctgtcacctagccacctcccaaacatctgtcccaatcccactcccttgaacagccccctcccctcgcccccagggccttcaaaccccaggattggattgggtttttgaaacctcagtggcaacgctcgctcacaaaccgtctgatccggtcaactgggagctgggggcaccaggctgccgggcgagtggacctggaggcgttgtccagcattgttttctaagctgggtgagagcttttctcattgctcttttggacagaactcataccgctccttgaagccaaagcctggttttatccttttagggtgtgcaataatgtcaaactttttcctctggcctccttgggtggggagagggagtgcttgtaggagctgccatttaagataaaaaaagcaaagctgtacaaaattcctagagttctgtcacctggatctgcagactaagcttttatatttttgtagaattctatagctgtctattccctaatgacgttggagggtatggggagggggttctgggatctttcattctcctagtggttagaagattctgggtcaaggtgaagccagagagctggactcctacccctccccactcttccagcaccccctctccccgctcccgaccaccagcccagcagcactagagtactggagagttgcttaggttgagtcttagcatgcctggttctttgtgcgttcctcttcccctggcctcctcttcccagtag
